(12) United States Patent
Masignani et al.

(10) Patent No.: US 7,749,518 B2
(45) Date of Patent: Jul. 6, 2010

(54) POLYPEPTIDES FROM NON-TYPEABLE HAEMOPHILUS INFLUENZAE

(75) Inventors: Vega Masignani, Siena (IT); Beatrice Maria Arico, Siena (IT)

(73) Assignee: Novartis Vaccines and Diagnostics SRL, Siena (IT)

(*) Notice: Subject to any disclaimer, the term of this patent is extended or adjusted under 35 U.S.C. 154(b) by 0 days.

(21) Appl. No.: 11/596,557

(22) PCT Filed: May 16, 2005

(86) PCT No.: PCT/IB2005/001775

§ 371 (c)(1),
(2), (4) Date: Feb. 14, 2008

(87) PCT Pub. No.: WO2005/111066

PCT Pub. Date: Nov. 24, 2005

(65) Prior Publication Data

US 2008/0267966 A1    Oct. 30, 2008

(30) Foreign Application Priority Data

May 14, 2004  (GB) ................................ 0410866.8

(51) Int. Cl.
A61K 39/102 (2006.01)
C12P 21/04 (2006.01)
C07H 21/04 (2006.01)
C07K 14/00 (2006.01)

(52) U.S. Cl. .............. 424/256.1; 424/185.1; 424/190.1; 424/200.1; 435/69.1; 435/69.5; 435/69.7; 530/300; 530/350; 536/23.5; 536/23.7

(58) Field of Classification Search ........................ None
See application file for complete search history.

(56) References Cited

FOREIGN PATENT DOCUMENTS

| WO | WO 91/01146 A1 | 2/1991 |
|---|---|---|
| WO | WO 99/11241 A1 | 3/1999 |
| WO | WO 99/44636 A2 | 9/1999 |
| WO | WO 99/52549 A1 | 10/1999 |
| WO | WO 00/07621 A2 | 2/2000 |
| WO | WO 00/23105 A2 | 4/2000 |
| WO | WO 00/56360 A2 | 9/2000 |
| WO | WO 01/21152 A1 | 3/2001 |
| WO | WO 01/21207 A2 | 3/2001 |
| WO | WO 02/28889 A2 | 4/2002 |
| WO | WO 02/083723 A | 10/2002 |
| WO | WO03076575 A2 * | 9/2003 |
| WO | WO 2004/078949 A | 9/2004 |
| WO | WO 2006/138527 A2 | 12/2006 |
| WO | WO 2007/084053 A1 | 7/2007 |

OTHER PUBLICATIONS

Lederman et al (Molecular Immunology 28:1171-1181, 1991).*
Li et al (Proc. Natl. Acad. Sci. USA 77:3211-3214, 1980).*
Accession No. G86194(Date: Mar. 2, 2001 ).*
Brusic, et al., "Prediction Of MHC Class II-Binding Peptides Using An Evolutionary Algorithm And Artificial Neural Network," *Bioinformatics* 14(2):121-130 (1998).
Carter, "Epitope Mapping Of A Protein Using The Geysen (PEPSCAN) Procedure," *Metheds in Molecular Biology vol. 36: Peptide Analysis Protocols*, Dunn & Pennington, Eds., Humana Press, Totowa, NJ, pp. 207-223 (1994).
Davenport, et al., "An Empirical Method For The Prediction Of T-Cell Epitopes," *Immunogenetics* 42:392-397 (1995).
De Lalla, et al., "Cutting Edge: Identification Of Novel T Cell Epitopes In Lol p5a By Computational Prediction," *J Immunol* 163:1725-1729 (1999).
Erdile, et al., "Role Of Attached Lipid In Immunogenicity Of Borrelia Burgdorfei OspA," *Inf Immun* 61(1):81-90 (1993).
Feller, et al., "Identifying Antigenic T-Cell Sites," *Nature* 349:720-721 (1991).
Fleischmann, et al., "Whole-Genome Random Sequencing And Assembly Of *Haemophilus influenzae* Rd," *Science* 296:496-512 (1995).
Genbank Accession No. NC_000907, "*Haemophilus influenzae* RD KW20,", 1995.
Geysen, et al., "Use of Peptide Synthesis To Probe Viral Antigens For Epitopes To A Resolution Of A Single Amino Acid," *PNAS USA* 81:3998-4002 (1984).
Hopp, et al., "Retrospective: 12 Years Of Antigenic Determinant Predictions, And More," *Peptide Res* 6(4):183-190 (1993).
Jameson, et al., "The Antigenic Index: A Novel Algorithm For Predicting Antigenic Determinants," *Cabios* 4(1):181-186 (1988).
Li, et al., "Identification And Characterization Of Genomic Loci Unique To The Brazilian Purpuric Fever Clonal Group Of *H. influenzae* Biogroup Aegyptiud: Functionality Explored Using Meningococcal Homology," *Mol Microbiol* 47(4):1101-1111 (2003).
Maksyutov, et al., "ADEPT: A Computer Program For Prediction Of Protein Antigenic Determinants," *Cabios* 9(3):291-297 (1993).
Mason, et al., "Nontypable *Haemophilus influenzae* Gene Expression Induced In Vivo In A Chinchilla Model Of Otitis Media," *Inf Immun* 71(6):3454-3462 (2003).
McMichael, "Vaccines For Moraxella Catarrhalis," *Vaccine* 19:s101-s107 (2001).
Meister, et al., "Two Novel T Cell Epitope Prediction Algorithms Based On MHC-Binding Motifs ; Comparison Of Predicted And Published Epitopes From Myocobacterium Tuberculosis And HIV Protein Sequences," *Vaccine* 13(6):581-591 (1995).
Needleman, et al., "A General Method Applied To The Search For Similarities In The Amino Acid Sequence Of Two Proteins," *J Mol Biol* 48:443-453 (1970).

(Continued)

*Primary Examiner*—Robert B Mondesi
*Assistant Examiner*—Padma V Baskar
(74) *Attorney, Agent, or Firm*—Roberta L. Robins; Robins & Pasternak LLP

(57) ABSTRACT

Polypeptides comprising non-typeable *Haemophilus influenzae* (NTHi) amino acid sequences. Over 2500 specific NTHi proteins are disclosed. The invention also provides related polypeptides, nucleic acids, antibodies and methods. These can all be used in medicine for treating or preventing disease and/or infection caused by *H. influenzae*, such as otitis media.

6 Claims, No Drawings

OTHER PUBLICATIONS

Raddrizzani, et al., "Epitope Scanner Using Virtual Matrix-Based Algorithms," *Breifings In Bioinformatics* 1(2):179-189 (2000).

Rice, et al., "EMBOSS: The European Molecular Biology Open Software Suite," *Trends Genet* 16:276-277 (2000).

Roberts, et al., "Prediction Of HIV Peptide Epitopes By A Novel Alforithm," *AIDS Res Hum Retroviruses* 12(7):593-610 (1996).

Singhi, et al., "Evaluation Of Polymerase Chain Reaction (PCR) For Diagnosing *Haemophilus influenzae* B Meningitis," *Ann Trop Microbiol* 37(3):190-195 (2003).

Welling, et al., "Prediction Of Sequential Antigenic Regions In Proteins," *FEBS* 188(2):215-218 (1985).

Yadav, et al., "Rapid Detection Of *Haemophius influenzae* By Hel Gene Polymerase Chain Reaction," *Lett Applied Microbiol* 37:190-195 (2003).

* cited by examiner

POLYPEPTIDES FROM NON-TYPEABLE *HAEMOPHILUS INFLUENZAE*

RELATED APPLICATIONS

This application is the U.S. National Phase of International Application No. PCT/IB2005/001775, filed May 16, 2005 and published in English, which claims priority to Great Britain Application No. 0410866.8, filed May 14, 2004. The teachings of the above applications are incorporated herein in their entirety by reference.

All documents cited herein are incorporated by reference in their entirety.

INCORPORATION BY REFERENCE OF MATERIAL ON COMPACT DISC

This application incorporates by reference the Sequence Listing contained on the two compact discs (Copy 1 and Copy 2), filed concurrently herewith, containing the following file:

File name: PP022930.0003 SequenceList.txt; created Nov. 10, 2006; 6,676 KB in size.

TECHNICAL FIELD

This invention is in the field of *Haemophilus influenzae* immunology and vaccinology.

BACKGROUND ART

*Haemophilus influenzae* is a small, non-motile, Gram-negative coccobacillus. It is a respiratory pathogen that causes a wide spectrum of human infections, including: asymptomatic colonization of the upper respiratory tract (i.e. carriage); infections that extend from colonized mucosal surfaces to cause otitis media (inflammation of the middle ear), bronchitis, conjunctivitis, sinusitis, urinary tract infections and pneumonia; and invasive infections, such as bacteremia, septic arthritis, epiglottitis, pneumonia, empyema, pericarditis, cellulitis, osteomyelitis and meningitis. *H. influenzae* was the first bacterium for which a complete genome sequence was published [1].

*H. influenzae* strains are either capsulated (typeable) or non-capsulated (non-typeable), and there are six major serological types of capsulated strains (a to f). 95% of *H. influenzae*-caused invasive diseases are caused by *H. influenzae* type b ('Hib') strains. The most serious manifestation of Hib disease is meningitis, but the introduction in the 1980s of vaccines based on conjugated Hib capsular saccharides has hugely reduced incidence of this disease.

Although Hib infections can now be controlled by vaccination, other pathogenic *H. influenzae* strains remain a risk. For instance, non-typeable *H. influenzae* (NTHi) is responsible for otitis media (OM), particularly chronic OM. While OM is rarely associated with mortality, it is associated with significant morbidity. Hearing loss is the most common complication of OM, with behavioral, educational and language development delays being additional consequences of early onset OM with effusion. Acute OM is the most common bacterial infection in children in the USA. The non-typeable *H. influenzae* biogroup aegyptius causes epidemic conjunctivitis and Brazilian purpuric fever (BPF) [2], with BPF having a mortality of up to 70%.

To date, antibiotics are the main tool against the spectrum of clinical entities known collectively as OM, but widespread use of antibiotics for OM has met with controversy due to the emergence of multiple-antibiotic resistant microorganisms. Progress towards a vaccine is slow due to an incomplete understanding of both the pathogenesis of OM and the immune response to it.

The genome sequence of the serotype d strain KW20 [1,3] has been useful for understanding basic *H. influenzae* biology, but it has not been so useful in countering pathogenic *H. influenzae* strains, as serotype d strains are generally not pathogens.

It is an object of the invention to provide polypeptides for use in the development of vaccines for preventing and/or treating infections caused by non-typeable *H. influenzae* strains. In particular, it is an object to provide polypeptides for use in improved vaccines for preventing and/or treating otitis media. The polypeptides may also be useful for diagnostic purposes, and as targets for antibiotics.

DISCLOSURE OF THE INVENTION

Polypeptides

The invention provides polypeptides comprising the *H. influenzae* amino acid sequences disclosed in the examples. These amino acid sequences are the even SEQ ID NOs between 2 and 5080. There are thus 2540 amino acid sequences, and these are referred to as NTHnnnn, where nnnn is a number between 0001 and 2832 (there are 292 NTHnnnn numbers that have no sequence; see Table I). Further NTHi sequences of the invention are given as SEQ ID NOS: 5088 onwards.

The invention also provides polypeptides comprising amino acid sequences that have sequence identity to the *H. Influenzae* amino acid sequences disclosed in the examples. Depending on the particular sequence, the degree of sequence identity is preferably greater than 50% (e.g. 60%, 70%, 75%, 80%, 85%, 90%, 91%, 92%, 93%, 94%, 95%, 96%, 97%, 98%, 99% or more). These polypeptides include homologs, orthologs, allelic variants and functional mutants. Typically, 50% identity or more between two polypeptide sequences is considered to be an indication of functional equivalence. Identity between polypeptides is preferably determined by the Smith-Waterman homology search algorithm as implemented in the MPSRCH program (Oxford Molecular), using an affine gap search with parameters gap open penialty=12 and gap extension penalty=1.

These polypeptide may, compared to the NTHi sequences of the examples, include one or more (e.g. 1, 2, 3, 4, 5, 6, 7, 8, 9, 10, etc.) conservative amino acid replacements i.e. replacements of one amino acid with another which has a related side chain. Genetically-encoded amino acids are generally divided into four families: (1) acidic i.e. aspartate, glutamate; (2) basic i.e. lysine, arginine, histidine; (3) non-polar i.e. alanine, valine, leucine, isoleucine, proline, phenylalanine, methionine, tryptophan; and (4) uncharged polar i.e. glycine, asparagine, glutamine, cystine, serine, threonine, tyrosine. Phenylalanine, tryptophan, and tyrosine are sometimes classified jointly as aromatic amino acids. In general, substitution of single amino acids within these families does not have a major effect on the biological activity. The polypeptides may also include one or more (e.g. 1, 2, 3, 4, 5, 6, 7, 8, 9, 10, etc.) single amino acid deletions relative to the NTHi sequences of the examples. The polypeptides may also include one or more (e.g. 1, 2, 3, 4, 5, 6, 7, 8, 9, 10, etc.) insertions (e.g. each of 1, 2, 3, 4 or 5 amino acids) relative to the NTHi sequences of the examples.

Preferred polypeptides of the invention are listed in Table II, including polypeptides that are lipidated, that are located in the outer membrane, that are located in the inner membrane, that are located in the periplasm, or that are not found in non-pathogenic *H. Influenzae* strains. Particularly preferred polypeptides are those that fall into more than one of these categories e.g. polypeptides that are located in the outer membrane and are also not found in non-pathogenic *H. influenzae* strains.

A particularly preferred polypeptide is NTH0867. NTH0861, NTH0863 and NTH0865 are also preferred. As described below, these four proteins are embodied by SEQ ID NOS: 1566, 5095, 1570, 5094, 1574, 5093, 1578 and 5092. Within these eight SEQ ID NOS, 1566-1578 are preferred.

The invention further provides polypeptides comprising fragments of the *H. influenzae* amino acid sequences disclosed in the examples. The fragments should comprise at least n consecutive amino acids from the sequences and, depending on the particular sequence, n is 7 or more (e.g. 8, 10, 12, 14, 16, 18, 20, 22, 24, 26, 28, 30, 35, 40, 45, 50, 60, 70, 80, 90, 100 or more).

The fragment may comprise at least one T-cell or, preferably, a B-cell epitope of the sequence. T- and B-cell epitopes can be identified empirically (e.g. using PEPSCAN [4,5] or similar methods), or they can be predicted (e.g. using the Jameson-Wolf antigenic index [6], matrix-based approaches [7], TEPITOPE [8], neural networks [9], OptiMer & EpiMer [10, 11], ADEPT [12], Tsites [13], hydrophilicity [14], antigenic index [15] or the methods disclosed in reference 16 etc.). Other preferred fragments are (a) the N-terminal signal peptides of the NTHi polypeptides of the invention, (b) the NTHi polypeptides, but without their N-terminal signal peptides, (c) the NTHi polypeptides, but without their N-terminal amino acid residue.

Polypeptides of the invention can be prepared in many ways e.g. by chemical synthesis (in whole or in part), by digesting longer polypeptides using proteases, by translation from RNA, by purification from cell culture (e.g. from recombinant expression), from the organism itself (e.g. after bacterial culture, or direct from patients), etc. A preferred method for production of peptides <40 amino acids long involves in vitro chemical synthesis [17,18]. Solid-phase peptide synthesis is particularly preferred, such as methods based on tBoc or Fmoc [19] chemistry. Enzymatic synthesis [20] may also be used in part or in full. As an alternative to chemical synthesis, biological methods may be used e.g. the polypeptides may be produced by translation. This may be carried out in vitro or in vivo. Biological methods are in general restricted to the production of polypeptides based on L-amino acids, but manipulation of translation machinery (e.g. of aminoacyl tRNA molecules) can be used to allow the introduction of D-amino acids (or of other non natural amino acids, such as iodotyrosine or methylphenylalanine, azidohomoalanine, etc.) [21]. Where D-amino acids are included, however, it is preferred to use chemical synthesis. Polypeptides of the invention may have covalent modifications at the C-terminus and/or N-terminus.

Polypeptides of the invention can take various forms (e.g. native, fusions, glycosylated, non-glycosylated, lipidated, non-lipidated, phosphorylated, non-phosphorylated, myristoylated, non-myristoylated, monomeric, multimeric, particulate, denatured, etc.).

Polypeptides of the invention are preferably provided in purified or substantially purified form i.e. substantially free from other polypeptides (e.g. free from naturally-occurring polypeptides), particularly from other *Haemophilus* or host cell polypeptides, and are generally at least about 50% pure (by weight), and usually at least about 90% pure i.e. less than about 50%, and more preferably less than about 10% (e.g. 5%) of a composition is made up of other expressed polypeptides. Polypeptides of the invention are preferably *H. influenzae* polypeptides. Polypeptides of the invention preferably have the function indicated in Table III for the relevant sequence.

Polypeptides of the invention may be attached to a solid support. Polypeptides of the invention may comprise a detectable label (e.g. a radioactive or fluorescent label, or a biotin label).

The term "polypeptide" refers to amino acid polymers of any length. The polymer may be linear or branched, it may comprise modified amino acids, and it may be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art. Polypeptides can occur as single chains or associated chains. Polypeptides of the invention can be naturally or non-naturally glycosylated (i.e. the polypeptide has a glycosylation pattern that differs from the glycosylation pattern found in the corresponding naturally occurring polypeptide).

The invention provides polypeptides comprising a sequence —X—Y— or —Y—X—, wherein: —X— is an amino acid sequence as defined above and —Y— is not a sequence as defined above i.e. the invention provides fusion proteins. Where the N-terminus codon of a polypeptide-coding sequence is not ATG then that codon will be translated as the standard amino acid for that codon rather than as a Met, which occurs when the codon is a start codon.

The invention provides a process for producing polypeptides of the invention, comprising the step of culturing a host cell of to the invention under conditions which induce polypeptide expression.

The invention provides a process for producing a polypeptide of the invention, wherein the polypeptide is synthesised in part or in whole using chemical means.

The invention provides a composition comprising two or more polypeptides of the invention.

The invention also provides a hybrid polypeptide represented by the formula $NH_2$-A-[—X-L-]$_n$-B—COOH, wherein X is a polypeptide of the invention as defined above, L is an optional linker amino acid sequence, A is an optional N-terminal amino acid sequence, B is an optional C-terminal amino acid sequence, and n is an integer greater than 1. The value of n is between 2 and x, and the value of x is typically 3, 4, 5, 6, 7, 8, 9 or 10. Preferably n is 2, 3 or 4; it is more preferably 2 or 3; most preferably, n=2. For each n instances, —X— may be the same or different. For each M instances of [—X-L-], linker amino acid sequence -L- may be present or absent. For instance, when n=2 the hybrid may be $NH_2$—$X_1$-$L_1$-$X_2$-$L_2$-COOH, $NH_2$—$X_1$-$X_2$—COOH, $NH_2$—$X_1$-$L_1$-$X_2$—COOH, $NH_2$—$X_1$-$X_2$-$L_2$-COOH, etc. Linker amino acid sequence(s)-L- will typically be short (e.g. 20 or fewer amino acids i.e. 19, 18, 17, 16, 15, 14, 13, 12, 11, 10, 9, 8, 7, 6, 5, 4, 3, 2, 1). Examples include short peptide sequences which facilitate cloning, poly-glycine linkers (i.e. Gly$_n$ where n=2, 3, 4, 5, 6, 7, 8, 9, 10 or more), and histidine tags (i.e. His$_n$ where n=3, 4, 5, 6, 7, 8, 9, 10 or more). Other suitable linker amino acid sequences will be apparent to those skilled in the art. -A- and —B— are optional sequences which will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct polypeptide trafficking, or short peptide sequences which facilitate cloning or purification (e.g. histidine tags i.e. His$_n$ where n=3, 4, 5, 6, 7, 8, 9, 10 or more). Other suitable N-terminal and C-terminal amino acid sequences will be apparent to those skilled in the art.

Various tests can be used to assess the in vivo immunogenicity of polypeptides of the invention. For example, polypeptides can be expressed recombinantly and used to screen patient sera by immunoblot. A positive reaction between the polypeptide and patient serum indicates that the patient has previously mounted an immune response to the protein in question i.e. the protein is an immunogen. This method can also be used to identify immunodominant proteins.

Antibodies

The invention provides antibodies that bind to polypeptides of the invention. These may be polyclonal or monoclonal and may be produced by any suitable means (e.g. by recombinant expression). To increase compatibility with the human immune system, the antibodies may be chimeric or humanised [e.g. refs. 22 & 23], or fully human antibodies may be used. The antibodies may include a detectable label (e.g. for diagnostic assays). Antibodies of the invention may be attached to a solid support. Antibodies of the invention are preferably neutralising antibodies.

Monoclonal antibodies are particularly useful in identification and purification of the individual polypeptides against which they are directed. Monoclonal antibodies of the invention may also be employed as reagents in immunoassays, radioimmunoassays (RIA) or enzyme-linked immunosorbent assays (ELISA), etc. In these applications, the antibodies can be labelled with an analytically-detectable reagent such as a radioisotope, a fluorescent molecule or an enzyme. The monoclonal antibodies produced by the above method may also be used for the molecular identification and characterization (epitope mapping) of polypeptides of the invention.

Antibodies of the invention are preferably provided in purified or substantially purified form. Typically, the antibody will be present in a composition that is substantially free of other polypeptides e.g. where less than 90% (by weight), usually less than 60% and more usually less than 50% of the composition is made up of other polypeptides.

Antibodies of the invention can be of any isotype (e.g. IgA, IgG, IgM i.e. an α, γ or μ heavy chain), but will generally be IgG. Within the IgG isotype, antibodies may be IgG1, IgG2, IgG3 or IgG4 subclass. Antibodies of the invention may have a κ or a λ light chain.

Antibodies of the invention can take various forms, including whole antibodies, antibody fragments such as F(ab')2 and F(ab) fragments, Fv fragments (non-covalent heterodimers), single-chain antibodies such as single chain Fv molecules (scFv), minibodies, oligobodies, etc. The term "antibody" does not imply any particular origin, and includes antibodies obtained through non-conventional processes, such as phage display.

The invention provides a process for detecting polypeptides of the invention, comprising the steps of: (a) contacting an antibody of the invention with a biological sample under conditions suitable for the formation of an antibody-antigen complexes; and (b) detecting said complexes.

The invention provides a process for detecting antibodies of the invention, comprising the steps of: (a) contacting a polypeptide of the invention with a biological sample (e.g. a blood or serum sample) under conditions suitable for the formation of an antibody-antigen complexes; and (b) detecting said complexes.

Nucleic Acids

The invention provides nucleic acid comprising the *H. influenzae* nucleotide sequences disclosed in the examples. These nucleic acid sequences are the odd SEQ ID NOs between 1 and 5080.

The invention also provides nucleic acid comprising nucleotide sequences having sequence identity to the *H. influenzae* nucleotide sequences disclosed in the examples. Identity between sequences is preferably determined by the Smith-Waterman homology search algorithm as described above.

The invention also provides nucleic acid which can hybridize to the *H. influenzae* nucleic acid disclosed in the examples. Hybridization reactions can be performed under conditions of different "stringency". Conditions that increase stringency of a hybridization reaction of widely known and published in the art [e.g. page 7.52 of reference 24]. Examples of relevant conditions include (in order of increasing stringency): incubation temperatures of 25° C., 37° C., 50° C., 55° C. and 68° C.; buffer concentrations of 10×SSC, 6×SSC, 1×SSC, 0.1×SSC (where SSC is 0.15 M NaCl and 15 mM citrate buffer) and their equivalents using other buffer systems; formamide concentrations of 0%, 25%, 50%, and 75%; incubation times from 5 minutes to 24 hours; 1, 2, or more washing steps; wash incubation times of 1, 2, or 15 minutes; and wash solutions of 6×SSC, 1×SSC, 0.1×SSC, or de-ionized water. Hybridization techniques and their optimization are well known in the art [e.g. see references 24-27, etc.].

In some embodiments, nucleic acid of the invention hybridizes to a target of the invention under low stringency conditions; in other embodiments it hybridizes under intermediate stringency conditions; in preferred embodiments, it hybridizes under high stringency conditions. An exemplary set of low stringency hybridization conditions is 50° C. and 10×SSC. An exemplary set of intermediate stringency hybridization conditions is 55° C. and 1×SSC. An exemplary set of high stringency hybridization conditions is 68° C. and 0.1×SSC.

Nucleic acid comprising fragments of these sequences are also provided. These should comprise at least n consecutive nucleotides from the *H. influenzae* sequences and, depending on the particular sequence, n is 10 or more (e.g. 12, 14, 15, 18, 20, 25, 30, 35, 40, 50, 60, 70, 80, 90, 100, 150, 200 or more).

The invention provides nucleic acid of formula 5'-X—Y-Z-3', wherein: —X— is a nucleotide sequence consisting of x nucleotides; -Z- is a nucleotide sequence consisting of z nucleotides; —Y— is a nucleotide sequence consisting of either (a) a fragment of one of the odd-numbered SEQ ID NOS: 1 to 5079, or (b) the complement of (a); and said nucleic acid 5'-X—Y-Z-3' is neither (i) a fragment of one of the odd-numbered SEQ ID NOS: 1 to 5079 nor (ii) the complement of (i). The —X— and/or -Z- moieties may comprise a promoter sequence (or its complement).

The invention also provides nucleic acid encoding the polypeptides and polypeptide fragments of the invention.

The invention includes nucleic acid comprising sequences complementary to the sequences disclosed in the sequence listing (e.g. for antisense or probing, or for use as primers), as well as the sequences in the orientation actually shown.

Nucleic acids of the invention can be used in hybridisation reactions (e.g. Northern or Southern blots, or in nucleic acid microarrays or 'gene chips') and amplification reactions (e.g. PCR, SDA, SSSR, LCR, TMA, NASBA, etc.) and other nucleic acid techniques.

Nucleic acid according to the invention can take various forms (e.g. single-stranded, double-stranded, vectors, primers, probes, labelled etc.). Nucleic acids of the invention may be circular or branched, but will generally be linear. Unless otherwise specified or required, any embodiment of the invention that utilizes a nucleic acid may utilize both the double-stranded form and each of two complementary single-stranded forms which make up the double-stranded form. Primers and probes are generally single-stranded, as are antisense nucleic acids.

Nucleic acids of the invention are preferably provided in purified or substantially purified form i.e. substantially free from other nucleic acids (e.g. free from naturally-occurring nucleic acids), particularly from other *Haemophilus* or host cell nucleic acids, generally being at least about 50% pure (by weight), and usually at least about 90% pure. Nucleic acids of the invention are preferably *H. influenzae* nucleic acids.

Nucleic acids of the invention may be prepared in many ways e.g. by chemical synthesis (e.g. phosphoramidite synthesis of DNA) in whole or in part, by digesting longer nucleic acids using nucleases (e.g. restriction enzymes), by joining shorter nucleic acids or nucleotides (e.g. using ligases or polymerases), from genomic or cDNA libraries, etc.

Nucleic acid of the invention may be attached to a solid support (e.g. a bead, plate, filter, film, slide, microarray support, resin, etc.). Nucleic acid of the invention may be labelled e.g. with a radioactive or fluorescent label, or a biotin label. This is particularly useful where the nucleic acid is to be used in detection techniques e.g. where the nucleic acid is a primer or as a probe.

The term "nucleic acid" includes in general means a polymeric form of nucleotides of any length, which contain deoxyribonucleotides, ribonucleotides, and/or their analogs. It includes DNA, RNA, DNA/RNA hybrids. It also includes DNA or RNA analogs, such as those containing modified backbones (e.g. peptide nucleic acids (PNAs) or phosphorothioates) or modified bases. Thus the invention includes mRNA, tRNA, rRNA, ribozymes, DNA, cDNA, recombinant nucleic acids, branched nucleic acids, plasmids, vectors, probes, primers, etc. Where nucleic acid of the invention takes the form of RNA, it may or may not have a 5' cap.

Nucleic acids of the invention comprise NTHi sequences, but they may also comprise non-NTHi sequences (e.g. in nucleic acids of formula 5'-X—Y-Z-3', as defined above). This is particularly useful for primers, which may thus comprise a first sequence complementary to a PCAV nucleic acid target and a second sequence which is not complementary to the nucleic acid target. Any such non-complementary sequences in the primer are preferably 5' to the complementary sequences. Typical non-complementary sequences comprise restriction sites or promoter sequences.

Nucleic acids of the invention can be prepared in many ways e.g. by chemical synthesis (at least in part), by digesting longer nucleic acids using nucleases (e.g. restriction enzymes), by joining shorter nucleic acids (e.g. using ligases or polymerases), from genomic or cDNA libraries, etc.

Nucleic acids of the invention may be part of a vector i.e. part of a nucleic acid construct designed for transduction/transfection of one or more cell types. Vectors may be, for example, "cloning vectors" which are designed for isolation, propagation and replication of inserted nucleotides, "expression vectors" which are designed for expression of a nucleotide sequence in a host cell, "viral vectors" which is designed to result in the production of a recombinant virus or virus-like particle, or "shuttle vectors", which comprise the attributes of more than one type of vector. Preferred vectors are plasmids. A "host cell" includes an individual cell or cell culture which can be or has been a recipient of exogenous nucleic acid. Host cells include progeny of a single host cell, and the progeny may not necessarily be completely identical (in morphology or in total DNA complement) to the original parent cell due to natural, accidental, or deliberate mutation and/or change. Host cells include cells transfected or infected in vivo or in vitro with nucleic acid of the invention.

Where a nucleic acid is DNA, it will be appreciated that "U" in a RNA sequence will be replaced by "T" in the DNA. Similarly, where a nucleic acid is RNA, it will be appreciated that "T" in a DNA sequence will be replaced by "U" in the RNA.

The term "complement" or "complementary" when used in relation to nucleic acids refers to Watson-Crick base pairing. Thus the complement of C is G, the complement of G is C, the complement of A is T (or U), and the complement of T (or U) is A. It is also possible to use bases such as I (the purine inosine) e.g. to complement pyrimidines (C or T). The terms also imply a direction—the complement of 5'-ACAGT-3' is 5'-ACTGT-3' rather than 5'-TGTCA-3'.

Nucleic acids of the invention can be used, for example: to produce polypeptides; as hybridization probes for the detection of nucleic acid in biological samples; to generate additional copies of the nucleic acids; to generate ribozymes or antisense oligonucleotides; as single-stranded DNA primers or probes; or as triple-strand forming oligonucleotides.

The invention provides a process for producing nucleic acid of the invention, wherein the nucleic acid is synthesised in part or in whole using chemical means.

The invention provides vectors comprising nucleotide sequences of the invention (e.g. cloning or expression vectors) and host cells transformed with such vectors.

The invention also provides a kit comprising primers (e.g. PCR primers) for amplifying a template sequence contained within a *Haemophilus* bacterium (e.g. *H. influenzae*) nucleic acid sequence, the kit comprising a first primer and a second primer, wherein the first primer is substantially complementary to said template sequence and the second primer is substantially complementary to a complement of said template sequence, wherein the parts of said primers which have substantial complementarity define the termini of the template sequence to be amplified. The first primer and/or the second primer may include a detectable label (e.g. a fluorescent label).

The invention also provides a kit comprising first and second single-stranded oligonucleotides which allow amplification of a *Haemophilus* template nucleic acid sequence contained in a single- or double-stranded nucleic acid (or mixture thereof), wherein: (a) the first oligonucleotide comprises a primer sequence which is substantially complementary to said template nucleic acid sequence; (b) the second oligonucleotide comprises a primer sequence which is substantially complementary to the complement of said template nucleic acid sequence; (c) the first oligonucleotide and/or the second oligonucleotide comprise(s) sequence which is not complementary to said template nucleic acid; and (d) said primer sequences define the termini of the template sequence to be amplified. The non-complementary sequence(s) of feature (c) are preferably upstream of (i.e. 5' to) the primer sequences. One or both of these (c) sequences may comprise a restriction site [e.g. ref. 28] or a promoter sequence [e.g. 29]. The first oligonucleotide and/or the second oligonucleotide may include a detectable label (e.g. a fluorescent label).

The template sequence may be any part of a genome sequence.

The invention provides a process for detecting nucleic acid of the invention, comprising the steps of: (a) contacting a nucleic probe according to the invention with a biological sample under hybridising conditions to form duplexes; and (b) detecting said duplexes.

The invention provides a process for detecting *H. influenzae* in a biological sample (e.g. blood), comprising the step of contacting nucleic acid according to the invention with the biological sample under hybridising conditions. The process may involve nucleic acid amplification (e.g. PCR, SDA, SSSR, LCR, TMA, NASBA, etc.) or hybridisation (e.g. microarrays, blots, hybridisation with a probe in solution etc.). PCR detection of *H. influenzae* in clinical samples has been reported [e.g. see refs. 30 & 31]. Clinical assays based on nucleic acid are described in general in ref. 32.

The invention provides a process for preparing a fragment of a target sequence, wherein the fragment is prepared by extension of a nucleic acid primer. The target sequence and/or the primer are nucleic acids of the invention. The primer extension reaction may involve nucleic acid amplification (e.g. PCR, SDA, SSSR, LCR, TMA, NASBA, etc.).

Nucleic acid amplification according to the invention may be quantitative and/or real-time.

For certain embodiments of the invention, nucleic acids are preferably at least 7 nucleotides in length (e.g. 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 90, 100, 110, 120, 130, 140, 150, 160, 170, 180, 190, 200, 225, 250, 275, 300 nucleotides or longer).

For certain embodiments of the invention, nucleic acids are preferably at most 500 nucleotides in length (e.g. 450, 400, 350, 300, 250, 200, 150, 140, 130, 120, 110, 100, 90, 80, 75, 70, 65, 60, 55, 50, 45, 40, 39, 38, 37, 36, 35, 34, 33, 32, 31, 30, 29, 28, 27, 26, 25, 24, 23, 22, 21, 20, 19, 18, 17, 16, 15 nucleotides or shorter).

Primers and probes of the invention, and other nucleic acids used for hybridization, are preferably between 10 and 30 nucleotides in length (e.g. 10, 11, 12, 13, 14, 15, 16, 17, 18, 19, 20, 21, 22, 23, 24, 25, 26, 27, 28, 29, or 30 nucleotides).

Pharmaceutical Compositions

The invention provides compositions comprising: (a) polypeptide, antibody, and/or nucleic acid of the invention; and (b) a pharmaceutically acceptable carrier. These compositions may be suitable as immunogenic compositions, for instance, or as diagnostic reagents, or as vaccines. Vaccines according to the invention may either be prophylactic (i.e. to prevent infection) or therapeutic (i.e. to treat infection), but will typically be prophylactic.

A 'pharmaceutically acceptable carriers' includes any carrier that does not itself induce the production of antibodies harmful to the individual receiving the composition. Suitable carriers are typically large, slowly metabolised macromolecules such as proteins, polysaccharides, polylactic acids, polyglycolic acids, polymeric amino acids, amino acid copolymers, sucrose, trehalose, lactose, and lipid aggregates (such as oil droplets or liposomes). Such carriers are well known to those of ordinary skill in the art. The vaccines may also contain diluents, such as water, saline, glycerol, etc. Additionally, auxiliary substances, such as wetting or emulsifying agents, pH buffering substances, and the like, may be present. Sterile pyrogen-free, phosphate-buffered physiologic saline is a typical carrier. A thorough discussion of pharmaceutically acceptable excipients is available in ref. 138.

Compositions of the invention may include an antimicrobial, particularly if packaged in a multiple dose format.

Compositions of the invention may comprise detergent e.g. a Tween (polysorbate), such as Tween 80. Detergents are generally present at low levels e.g. <0.01%.

Compositions of the invention may include sodium salts (e.g. sodium chloride) to give tonicity. A concentration of 10±2 mg/ml NaCl is typical.

Compositions of the invention will generally include a buffer. A phosphate buffer is typical.

Compositions of the invention may comprise a sugar alcohol (e.g. mannitol) or a disaccharide (e.g. sucrose or trehalose) e.g. at around 15-30 mg/ml (e.g. 25 mg/ml), particularly if they are to be lyophilised or if they include material which has been reconstituted from lyophilised material. The pH of a composition for lyophilisation may be adjusted to around 6.1 prior to lyophilisation.

Polypeptides of the invention may be administered in conjunction with other immunoregulatory agents. In particular, compositions will usually include a vaccine adjuvant. Adjuvants which may be used in compositions of the invention include, but are not limited to:

A. Mineral-Containing Compositions

Mineral containing compositions suitable for use as adjuvants in the invention include mineral salts, such as aluminium salts and calcium salts. The invention includes mineral salts such as hydroxides (e.g. oxyhydroxides), phosphates (e.g. hydroxyphosphates, orthophosphates), sulphates, etc. [e.g. see chapters 8 & 9 of ref. 33], or mixtures of different mineral compounds, with the compounds taking any suitable form (e.g. gel, crystalline, amorphous, etc.), and with adsorption being preferred. The mineral containing compositions may also be formulated as a particle of metal salt [34].

Aluminium phosphates are particularly preferred, particularly in compositions which include a *H. influenzae* saccharide antigen, and a typical adjuvant is amorphous aluminium hydroxyphosphate with $PO_4/Al$ molar ratio between 0.84 and 0.92, included at 0.6 mg $Al^{3+}$/ml. Adsorption with a low dose of aluminium phosphate may be used e.g. between 50 and 100 µg $Al^{3+}$ per conjugate per dose. Where there is more than one conjugate in a composition, not all conjugates need to be adsorbed.

B. Oil Emulsions

Oil emulsion compositions suitable for use as adjuvants in the invention include squalene-water emulsions, such as MF59 [Chapter 10 of ref. 33; see also ref. 35] (5% Squalene, 0.5% Tween 80, and 0.5% Span 85, formulated into submicron particles using a microfluidizer). Complete Freund's adjuvant (CFA) and incomplete Freund's adjuvant (IFA) may also be used.

C. Saponin Formulations [chapter 22 of Ref 33]

Saponin formulations may also be used as adjuvants in the invention. Saponins are a heterologous group of sterol glycosides and triterpenoid glycosides that are found in the bark, leaves, stems, roots and even flowers of a wide range of plant species. Saponin from the bark of the *Quillaia saponaria* Molina tree have been widely studied as adjuvants. Saponin can also be commercially obtained from *Smilax ornata* (sarsaprilla), *Gypsophilla paniculata* (brides veil), and *Saponaria officianalis* (soap root). Saponin adjuvant formulations include purified formulations, such as QS21, as well as lipid formulations, such as ISCOMs. QS21 is marketed as Stimulon™.

Saponin compositions have been purified using HPLC and RP-HPLC. Specific purified fractions using these techniques have been identified, including QS7, QS17, QS18, QS21, QH-A, QH-B and QH-C. Preferably, the saponin is QS21. A method of production of QS21 is disclosed in ref. 36. Saponin formulations may also comprise a sterol, such as cholesterol [37].

Combinations of saponins and cholesterols can be used to form unique particles called immunostimulating complexes (ISCOMs) [chapter 23 of ref. 33]. ISCOMs typically also include a phospholipid such as phosphatidylethanolamine or phosphatidylcholine. Any known saponin can be used in ISCOMs. Preferably, the ISCOM includes one or more of QuilA, QHA & QHC. ISCOMs are further described in refs. 37-39. Optionally, the ISCOMS may be devoid of additional detergent [40].

A review of the development of saponin based adjuvants can be found in refs. 41 & 42.

D. Virosomes and Virus-Like Particles

Virosomes and virus-like particles (VLPs) can also be used as adjuvants in the invention. These structures generally contain one or more proteins from a virus optionally combined or formulated with a phospholipid. They are generally non-pathogenic, non-replicating and generally do not contain any of the native viral genome. The viral proteins may be recombinantly produced or isolated from whole viruses. These viral proteins suitable for use in virosomes or VLPs include proteins derived from influenza virus (such as HA or NA), Hepatitis B virus (such as core or capsid proteins), Hepatitis E virus, measles virus, Sindbis virus, Rotavirus, Foot-and-Mouth Disease virus, Retrovirus, Norwalk virus, human Papilloma virus, HIV, RNA-phages, Qβ-phage (such as coat proteins), GA-phage, fr-phage, AP205 phage, and Ty (such as retrotransposon Ty protein p1). VLPs are discussed further in refs. 43-48. Virosomes are discussed further in, for example, ref. 49

E. Bacterial or Microbial Derivatives

Adjuvants suitable for use in the invention include bacterial or microbial derivatives such as non-toxic derivatives of enterobacterial lipopolysaccharide (LPS), Lipid A derivatives, immunostimulatory oligonucleotides and ADP-ribosylating toxins and detoxified derivatives thereof.

Non-toxic derivatives of LPS include monophosphoryl lipid A (MPL) and 3-O-deacylated MPL (3dMPL). 3dMPL is a mixture of 3 de-O-acylated monophosphoryl lipid A with 4, 5 or 6 acylated chains. A preferred "small particle" form of 3 De-O-acylated monophosphoryl lipid A is disclosed in ref. 50. Such "small particles" of 3dMPL are small enough to be sterile filtered through a 0.22 μm membrane [50]. Other non-toxic LPS derivatives include monophosphoryl lipid A mimics, such as aminoalkyl glucosaminide phosphate derivatives e.g. RC-529 [51,52].

Lipid A derivatives include derivatives of lipid A from *Escherichia coli* such as OM-174. OM-174 is described for example in refs. 53 & 54.

Immunostimulatory oligonucleotides suitable for use as adjuvants in the invention include nucleotide sequences containing a CpG motif (a dinucleotide sequence containing an unmethylated cytosine linked by a phosphate bond to a guanosine). Double-stranded RNAs and oligonucleotides containing palindromic or poly(dG) sequences have also been shown to be immunostimulatory.

The CpG's can include nucleotide modifications/analogs such as phosphorothioate modifications and can be double-stranded or single-stranded. References 55, 56 and 57 disclose possible analog substitutions e.g. replacement of guanosine with 2'-deoxy-7-deazaguanosine. The adjuvant effect of CpG oligonucleotides is further discussed in refs. 58-63.

The CpG sequence may be directed to TLR9, such as the motif GTCGTT or TTCGTT [64]. The CpG sequence may be specific for inducing a Th1 immune response, such as a CpG-A ODN, or it may be more specific for inducing a B cell response, such a CpG-B ODN. CpG-A and CpG-B ODNs are discussed in refs. 65-67. Preferably, the CpG is a CpG-A ODN.

Preferably, the CpG oligonucleotide is constructed so that the 5' end is accessible for receptor recognition. Optionally, two CpG oligonucleotide sequences may be attached at their 3' ends to form "immunomers". See, for example, refs. 64 & 68-70.

Bacterial ADP-ribosylating toxins and detoxified derivatives thereof may be used as adjuvants in the invention. Preferably, the protein is derived from *E. coli* (*E. coli* heat labile enterotoxin "LT"), cholera ("CT"), or pertussis ("PT"). The use of detoxified ADP-ribosylating toxins as mucosal adjuvants is described in ref. 71 and as parenteral adjuvants in ref. 72. The toxin or toxoid is preferably in the form of a holotoxin, comprising both A and B subunits. Preferably, the A subunit contains a detoxifying mutation; preferably the B subunit is not mutated. Preferably, the adjuvant is a detoxified LT mutant such as LT-K63, LT-R72, and LT-G192. The use of ADP-ribosylating toxins and detoxified derivates thereof, particularly LT-K63 and LT-R72, as adjuvants can be found in refs. 73-80. Numerical reference for amino acid substitutions is preferably based on the alignments of the A and B subunits of ADP-ribosylating toxins set forth in ref. 81, specifically incorporated herein by reference in its entirety.

F. Human Immunomodulators

Human immunomodulators suitable for use as adjuvants in the invention include cytokines, such as interleukins (e.g. IL-1, IL-2, IL-4, IL-5, IL-6, IL-7, IL-12 [82], etc.) [83], interferons (e.g. interferon-γ), macrophage colony stimulating factor, and tumor necrosis factor.

G. Bioadhesives and Mucoadhesives

Bioadhesives and mucoadhesives may also be used as adjuvants in the invention. Suitable bioadhesives include esterified hyaluronic acid microspheres [84] or mucoadhesives such as cross-linked derivatives of poly(acrylic acid), polyvinyl alcohol, polyvinyl pyrollidone, polysaccharides and carboxymethylcellulose. Chitosan and derivatives thereof may also be used as adjuvants in the invention [85].

H. Microparticles

Microparticles may also be used as adjuvants in the invention. Microparticles (i.e. a particle of ~100 nm to ~150 μm in diameter, more preferably ~200 nm to ~30 μm in diameter, and most preferably ~500 nm to ~10 μm in diameter) formed from materials that are biodegradable and non-toxic (e.g. a poly(α-hydroxy acid), a polyhydroxybutyric acid, a polyorthoester, a polyanhydride, a polycaprolactone, etc.), with poly(lactide-co-glycolide) are preferred, optionally treated to have a negatively-charged surface (e.g. with SDS) or a positively-charged surface (e.g. with a cationic detergent, such as CTAB).

I. Liposomes (Chapters 13 & 14 of Ref 33)

Examples of liposome formulations suitable for use as adjuvants are described in refs. 86-88.

J. Polyoxyethylene Ether and Polyoxyethylene Ester Formulations

Adjuvants suitable for use in the invention include polyoxyethylene ethers and polyoxyethylene esters [89]. Such formulations further include polyoxyethylene sorbitan ester surfactants in combination with an octoxynol [90] as well as polyoxyethylene alkyl ethers or ester surfactants in combination with at least one additional non-ionic surfactant such as an octoxynol [91]. Preferred polyoxyethylene ethers are selected from the following group: polyoxyethylene-9-lauryl ether (laureth 9), polyoxyethylene-9-steoryl ether, polyoxytheylene-8-steoryl ether, polyoxyethylene-4-lauryl ether, polyoxyethylene-35-lauryl ether, and polyoxyethylene-23-lauryl ether.

K. Polyphosphazene (PCPP)

PCPP formulations are described, for example, in refs. 92 and 93.

L. Muramyl peptides

Examples of muramyl peptides suitable for use as adjuvants in the invention include N-acetyl-muramyl-L-threonyl-D-isoglutamine (thr-MDP), N-acetyl-normuramyl-L-alanyl-D-isoglutamine (nor-MDP), and N-acetylmuramyl-L-alanyl-D-isoglutaminyl-L-alanine-2-(1'-2'-dipaimitoyl-sn-glycero-3-hydroxyphosphoryloxy)-ethylamine MTP-PE).

M. Imidazoquinolone Compounds.

Examples of imidazoquinolone compounds suitable for use adjuvants in the invention include Imiquamod and its homologues (e.g. "Resiquimod 3M"), described further in refs. 94 and 95.

The invention may also comprise combinations of aspects of one or more of the adjuvants identified above. For example, the following adjuvant compositions may be used in the invention: (1) a saponin and an oil-in-water emulsion [96]; (2) a saponin (e.g. QS21)+a non-toxic LPS derivative (e.g. 3dMPL) [97]; (3) a saponin (e.g. QS21)+a non-toxic LPS derivative (e.g. 3dMPL)+a cholesterol; (4) a saponin (e.g. QS21)+3dMPL+IL-12 (optionally+a sterol) [98]; (5) combinations of 3dMPL with, for example, QS21 and/or oil-in-water emulsions [99]; (6) SAF, containing 10% squalane, 0.4% Tween 80™, 5% pluronic-block polymer $L_{121}$, and thr-MDP, either microfluidized into a submicron emulsion or vortexed to generate a larger particle size emulsion. (7) Ribi™ adjuvant system (RAS), (Ribi Immunochem) containing 2% squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); and (8) one or more mineral salts (such as an aluminum salt)+a non-toxic derivative of LPS (such as 3dMPL).

Other substances that act as immunostimulating agents are disclosed in chapter 7 of ref. 33.

The use of an aluminium hydroxide or aluminium phosphate adjuvant is particularly preferred, and antigens are generally adsorbed to these salts. Calcium phosphate is another preferred adjuvant.

The pH of compositions of the invention is preferably between 6 and 8, preferably about 7. Stable pH may be maintained by the use of a buffer. Where a composition comprises an aluminium hydroxide salt, it is preferred to use a histidine buffer [100]. The composition may be sterile and/or pyrogen-free. Compositions of the invention may be isotonic with respect to humans.

Compositions may be presented in vials, or they may be presented in ready-filled syringes. The syringes may be supplied with or without needles. A syringe will include a single dose of the composition, whereas a vial may include a single dose or multiple doses. Injectable compositions will usually be liquid solutions or suspensions. Alternatively, they may be presented in solid form (e.g. freeze-dried) for solution or suspension in liquid vehicles prior to injection.

Compositions of the invention may be packaged in unit dose form or in multiple dose form. For multiple dose forms, vials are preferred to pre-filled syringes. Effective dosage volumes can be routinely established, but a typical human dose of the composition for injection has a volume of 0.5 ml.

Where a composition of the invention is to be prepared extemporaneously prior to use (e.g. where a component is presented in lyophilised form) and is presented as a kit, the kit may comprise two vials, or it may comprise one ready-filled syringe and one vial, with the contents of the syringe being used to reactivate the contents of the vial prior to injection.

Immunogenic compositions used as vaccines comprise an immunologically effective amount of antigen(s), as well as any other components, as needed. By 'immunologically effective amount', it is meant that the administration of that amount to an individual, either in a single dose or as part of a series, is effective for treatment or prevention. This amount varies depending upon the health and physical condition of the individual to be treated, age, the taxonomic group of individual to be treated (e.g. non-human primate, primate, etc.), the capacity of the individual's immune system to synthesise antibodies, the degree of protection desired, the formulation of the vaccine, the treating doctor's assessment of the medical situation, and other relevant factors. It is expected that the amount will fall in a relatively broad range that can be determined through routine trials, and a typical quantity of each meningococcal saccharide antigen per dose is between 1 µg and 10 mg per antigen.

Pharmaceutical Uses

The invention also provides a method of treating a patient, comprising administering to the patient a therapeutically effective amount of a composition of the invention. The patient may either be at risk from the disease themselves or may be a pregnant woman ('maternal immunisation').

The invention provides nucleic acid, polypeptide, or antibody of the invention for use as medicaments (e.g. as immunogenic compositions or as vaccines) or as diagnostic reagents. It also provides the use of nucleic acid, polypeptide, or antibody of the invention in the manufacture of: (i) a medicament for treating or preventing disease and/or infection caused by *H. influenzae*; (ii) a diagnostic reagent for detecting the presence of *H. influenzae* or of antibodies raised against *H. influenzae*; and/or (iii) a reagent which can raise antibodies against *H. influenzae*. Said *H. influenzae* serotype or strain, but is preferably a non-typeable *H. influenzae*. Said disease may be, for instance, otitis media (including acute otitis media), bronchitis, conjunctivitis, sinusitis, a urinary tract infection, pneumonia, bacteremia, septic arthritis, epiglottitis, pneumonia, empyema, pericarditis, cellulitis, osteomyelitis, lower respiratory tract infection or meningitis. The invention is particularly useful for preventing inflammation of the middle ear, by eliciting an immune response that prevents bacteria from moving from the throat to the middle ear via the eustachian tube, where the middle ear is then colonised.

The patient is preferably a human. Where the vaccine is for prophylactic use, the human is preferably a child (e.g. a toddler or infant); where the vaccine is for therapeutic use, the human is preferably an adult. A vaccine intended for children may also be administered to adults e.g. to assess safety, dosage, immunogenicity, etc.

One way of checking efficacy of therapeutic treatment involves monitoring NTHi infection after administration of the composition of the invention. One way of checking efficacy of prophylactic treatment involves monitoring immune responses against an administered polypeptide after administration. Immunogenicity of compositions of the invention can be determined by administering them to test subjects (e.g. children 12-16 months age, or animal models [e.g. a chinchilla model [146]) and then determining standard parameters including ELISA titres (GMT) of IgG. These immune responses will generally be determined around 4 weeks after administration of the composition, and compared to values determined before administration of the composition. Where more than one dose of the composition is administered, more than one post-administration determination may be made.

Administration of polypeptide antigens is a preferred method of treatment for inducing immunity. Administration of antibodies of the invention is another preferred method of treatment. This method of passive immunisation is particularly useful for newborn children or for pregnant women. This method will typically use monoclonal antibodies, which will be humanised or fully human.

Compositions of the invention will generally be administered directly to a patient. Direct delivery may be accomplished by parenteral injection (e.g. subcutaneously, intraperitoneally, intravenously, intramuscularly, or to the interstitial space of a tissue), or by rectal, oral, vaginal, topical, transdermal, intranasal, ocular, aural, pulmonary or other mucosal administration. Intramuscular administration to the thigh or the upper arm is preferred. Injection may be via a needle (e.g. a hypodermic needle), but needle-free injection may alternatively be used. A typical intramuscular dose is 0.5 ml.

The invention may be used to elicit systemic and/or mucosal immunity.

Dosage treatment can be a single dose schedule or a multiple dose schedule. Multiple doses may be used in a primary immunisation schedule and/or in a booster immunisation schedule. A primary dose schedule may be followed by a booster dose schedule. Suitable timing between priming doses (e.g. between 4-16 weeks), and between priming and boosting, can be routinely determined.

Bacterial infections affect various areas of the body and so compositions may be prepared in various forms. For example, the compositions may be prepared as injectables, either as liquid solutions or suspensions. Solid forms suitable for solution in, or suspension in, liquid vehicles prior to injection can also be prepared (e.g. a lyophilised composition). The composition may be prepared for topical administration e.g. as an ointment, cream or powder. The composition be prepared for oral administration e.g. as a tablet or capsule, or as a syrup (optionally flavoured). The composition may be prepared for pulmonary administration e.g. as an inhaler, using a fine powder or a spray. The composition may be prepared as a suppository or pessary. The composition may be prepared for nasal, aural or ocular administration e.g. as spray, drops, gel or powder [e.g. refs 101 & 102].

Combinations

Within the >2500 proteins described in the examples, NTH0861, NTH0863, NTH0865 and NTH0867 are particularly preferred for use with the invention (particularly in vaccines), and these four proteins can be used in combinations. Thus the invention provides a composition comprising: (a) a NTH0861 protein; and (b) at least one further NTHi protein. The invention also provides a composition comprising: (a) a NTH0863 protein; and (b) at least one further NTHi protein. The invention also provides a composition comprising: (a) a NTH0865 protein; and (b) at least one further NTHi protein. The invention also provides a composition comprising: (a) a NTH0867 protein; and (b) at least one further NTHi protein. The further NTHi protein can be selected from proteins of the invention as described above.

The combinations are preferably selected within these four proteins, and so the invention provides a composition comprising two or more (i.e. 2, 3 or 4) of NTH0861, NTH0863, NTH0865 and/or NTH0867. Preferred compositions comprise: (1) NTH0861 and NTH0863; (2) NTH0861 and NTH0865; (3) NTH0861 and NTH0867; (4) NTH0863 and NTH0865; (5) NTH0863 and NTH0867; (6) NTH0865 and NTH0867; (7) NTH0861, NTH0863 and NTH0865; (8) NTH0861, NTH0863 and NTH0867; (9) NTH0863, NTH0865 and NTH0867; (10) NTH0861, NTH0865 and NTH0867; (11) NTH0861, NTH0863, NTH0865 and NTH0867.

The NTH0861 protein preferably comprises SEQ ID NO: 1566, SEQ ID NO: 5095, or an amino acid sequence having sequence identity (as described above) to SEQ ID NO: 1566 and/or to SEQ ID NO: 5095. The NTH0863 protein preferably comprises SEQ ID NO: 1570, SEQ ID NO: 5094, or an amino acid sequence having sequence identity (as described above) to SEQ ID NO: 1570 and/or to SEQ ID NO: 5094. The NTH0865 protein preferably comprises SEQ ID NO: 1574, SEQ ID NO: 5093, or an amino acid sequence having sequence identity (as described above) to SEQ ID NO: 1574 and/or to SEQ ID NO: 5093. The NTH0867 protein preferably comprises SEQ ID NO: 1578, SEQ ID NO: 5092, or an amino acid sequence having sequence identity (as described above) to SEQ ID NO: 1578 and/or to SEQ ID NO: 5092.

Further Antigenic Components of Compositions of the Invention

The invention also provides a composition comprising a polypeptide or the invention and one or more of the following further antigens:

a saccharide antigen from *N. meningitidis* serogroup A, C, W135 and/or Y (preferably all four), such as the oligosaccharide disclosed in ref. 103 from serogroup C [see also ref. 104] or the oligosaccharides of ref. 105.

a saccharide antigen from *Streptococcus pneumoniae* [e.g. 106, 107, 108].

an antigen from hepatitis A virus, such as inactivated virus [e.g. 109, 110].

an antigen from hepatitis B virus, such as the surface and/or core antigens [e.g. 110, 111].

a diphtheria antigen, such as a diphtheria toxoid [e.g. chapter 3 of ref. 112] e.g. the $CRM_{197}$ mutant [e.g. 113].

a tetanus antigen, such as a tetanus toxoid [e.g. chapter 4 of ref. 112].

an antigen from *Bordetella pertussis*, such as pertussis holotoxin (PT) and filamentous haemagglutinin (FHA) from *B. pertussis*, optionally also in combination with pertactin and/or agglutinogens 2 and 3 [e.g. refs. 114 & 115].

a saccharide antigen from *Haemophilus influenzae* B [e.g. 104].

polio antigen(s) [e.g. 116, 117] such as IPV.

measles, mumps and/or rubella antigens [e.g. chapters 9, 10 & 11 of ref. 112].

influenza antigen(s) [e.g. chapter 19 of ref. 112], such as the haemagglutinin and/or neuraminidase surface proteins.

an antigen from *Moraxella catarrhalis* [e.g. 118].

an protein antigen from *Streptococcus agalactiae* (group B *streptococcus*) [e.g. 119, 120].

a saccharide antigen from *Streptococcus agalactiae* (group B *streptococcus*).

an antigen from *Streptococcus pyogenes* (group A *streptococcus*) [e.g. 120, 121, 122].

an antigen from *Staphylococcus aureus* [e.g. 123].

The composition may comprise one or more of these further antigens.

Toxic protein antigens may be detoxified where necessary (e.g. detoxification of pertussis toxin by chemical and/or genetic means [115]).

Where a diphtheria antigen is included in the composition it is preferred also to include tetanus antigen and pertussis antigens. Similarly, where a tetanus antigen is included it is preferred also to include diphtheria and pertussis antigens. Similarly, where a pertussis antigen is included it is preferred also to include diphtheria and tetanus antigens. DTP combinations are thus preferred.

Saccharide antigens are preferably in the form of conjugates. Carrier proteins for the conjugates include diphtheria toxin, tetanus toxin, the *N. meningitidis* outer membrane protein [124], synthetic peptides [125,126], heat shock proteins [127,128], pertussis proteins [129,130], protein D from: *H. influenzae* [131], cytokines [132], lymphokines [132], streptococcal proteins, hormones [132], growth factors [132], toxin A or B from *C. difficile* [133], iron-uptake proteins [134], etc. A preferred carrier protein is the CRM197 diphtheria toxoid [135].

Antigens in the composition will typically be present at a concentration of at least 1 µg/ml each. In general, the concentration of any given antigen will be sufficient to elicit an immune response against that antigen.

As an alternative to using proteins antigens in the immunogenic compositions of the invention, nucleic acid (preferably DNA e.g. in the form of a plasmid) encoding the antigen may be used.

Antigens are preferably adsorbed to an aluminium salt.

Screening Methods

The invention provides a process for determining whether a test compound binds to a polypeptide of the invention. If a test compound binds to a polypeptide of the invention and this binding inhibits the life cycle of the *H. influenzae* bacterium, then the test compound can be used as an antibiotic or as a lead compound for the design of antibiotics. The process will typically comprise the steps of contacting a test compound with a polypeptide of the invention, and determining whether the test compound binds to said polypeptide. Preferred polypeptides of the invention for use in these processes are enzymes (e.g. tRNA synthetases), membrane transporters and ribosomal polypeptides. Suitable test compounds include polypeptides, polypeptides, carbohydrates, lipids, nucleic acids (e.g. DNA, RNA, and modified forms thereof), as well as small organic compounds (e.g. MW between 200 and 2000 Da). The test compounds may be provided individually, but will typically be part of a library (e.g. a combinatorial library). Methods for detecting a binding interaction include NMR, filter-binding assays, gel-retardation assays, displacement assays, surface plasmon resonance, reverse two-hybrid etc. A compound which binds to a polypeptide of the invention can be tested for antibiotic activity by contacting the compound with GBS bacteria and then monitoring for inhibition of growth. The invention also provides a compound identified using these methods.

Preferably, the process comprises the steps of: (a) contacting a polypeptide of the invention with one or more candidate compounds to give a mixture; (b) incubating the mixture to allow polypeptide and the candidate compound(s) to interact; and (c) assessing whether the candidate compound binds to the polypeptide or modulates its activity.

Once a candidate compound has been identified in vitro as a compound that binds to a polypeptide of the invention then it may be desirable to perform further experiments to confirm the in vivo function of the compound in inhibiting bacterial growth and/or survival. Thus the method comprise the further step of contacting the compound with a NTHi bacterium and assessing its effect.

The polypeptide used in the screening process may be free in solution, affixed to a solid support, located on a cell surface or located intracellularly. Preferably, the binding of a candidate compound to the polypeptide is detected by means of a label directly or indirectly associated with the candidate compound. The label may be a fluorophore, radioisotope, or other detectable label.

General

The invention provides a computer-readable medium (e.g. a floppy disk, a hard disk, a CD-ROM, a DVD etc.) and/or a computer memory and/or a computer database containing one or more of the sequences in the sequence listing.

The term "comprising" encompasses "including" as well as "consisting" e.g. a composition "comprising" X may consist exclusively of X or may include something additional e.g. X+Y.

The term "about" in relation to a numerical value x means, for example, x+10%.

The word "substantially" does not exclude "completely" e.g. a composition which is "substantially free" from Y may be completely free from Y. Where necessary, the word "substantially" may be omitted from the definition of the invention.

The N-terminus residues in the amino acid sequences in the sequence listing are given as the amino acid encoded by the first codon in the corresponding nucleotide sequence. Where the first codon is not ATG, it will be understood that it will be translated as methionine when the codon is a start codon, but will be translated as the indicated non-Met amino acid when the sequence is at the C-terminus of a fusion partner. The invention specifically discloses and encompasses each of the amino acid sequences of the sequence listing having a N-terminus methionine residue (e.g. a formyl-methionine residue) in place of any indicated non-Met residue.

Alternative start codons can be used in biology. The amino acid sequences in the sequence listing are based on particular start codons, but downstream start codons may alternatively be used. Thus the invention specifically discloses and encompasses each of the amino acid sequences of the sequence listing, starting at any methionine residue from the sequence that is downstream of the N-terminal residue shown in the sequence listing (e.g. SEQ ID NOS: 5088, 5089 & 5090).

As indicated in the above text, nucleic acids and polypeptides of the invention may include sequences that:
(a) are identical (i.e. 100% identical) to the sequences disclosed in the sequence listing;
(b) share sequence identity with the sequences disclosed in the sequence listing;
(c) have 1, 2, 3, 4, 5, 6, 7, 8, 9 or 10 single nucleotide or amino acid alterations (deletions, insertions, substitutions), which may be at separate locations or may be contiguous, as compared to the sequences of (a) or (b); and
(d) when aligned with a particular sequence from the sequence listing using a pairwise alignment algorithm, a moving window of x monomers (amino acids or nucleotides) moving from start (N-terminus or 5') to end (C-terminus of 3'), such that for an alignment that extends to p monomers (where p>x) there are p−x+1 such windows, each window has at least xy identical aligned monomers, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer. The preferred pairwise alignment algorithm is the Needleman-Wunsch global alignment algorithm [136], using default parameters (e.g. with Gap opening penalty=10.0, and with Gap extension penalty=0.5, using the EBLOSUM62 scoring matrix). This algorithm is conveniently implemented in the needle tool in the EMBOSS package [137].

The nucleic acids and polypeptides of the invention may additionally have further sequences to the N-terminus/5' and/or C-terminus/3' of these sequences (a) to (d).

The practice of the present invention will employ, unless otherwise indicated, conventional methods of chemistry, biochemistry, molecular biology, immunology and pharmacology, within the skill of the art. Such techniques are explained fully in the literature. See, e.g., references 138-145, etc.

MODES FOR CARRYING OUT THE INVENTION

Genome sequencing has been carried out on a low-passage clinical NTHi isolate (strain 86-028NP [146]). A total of 2540 coding sequences were identified in the genome, and these are given in the sequence listing together with their inferred translation products. Annotation of 1489 of the polypeptide sequences is given in Table III. From the sequenced material, polypeptide-coding sequences of particular interest were selected for further work, with particular attention to immunogenic proteins for vaccine development.

Lipoproteins

Of the 2540 coding sequences, the following 39 were identified as lipoproteins: NTH0094, NTH0163, NTH0167, NTH0255, NTH0289, NTH0838, NTH0909, NTH0997, NTH1000, NTH1016, NTH1174, NTH1298, NTH1313, NTH1413, NTH1416, NTH1552, NTH1623, NTH1675, NTH1680, NTH1739, NTH1873, NTH1922, NTH1942, NTH1974, NTH2142, NTH2169, NTH2251, NTH2349, NTH2356, NTH2358, NTH2524, NTH2588, NTH2595, NTH2641, NTH2673, NTH2715, NTH2754, NTH2758, and NTH2769. Lipoproteins are surface-exposed and, as such, they represent accessible immunological targets e.g. for diagnostic and for immunisation purposes. Moreover, it has been found in *B. burgdorferi* [147] that OspA protein is immunogenic in a lipidated form but is non-immunogenic in a non-lipidated form, and the authors concluded that post-translational lipid attachment is a critical determinant of OspA immunogenicity.

Outer Membrane

As *H. influenzae* is a Gram-negative bacterium, its cell wall includes an outer membrane. Of the 2540 coding sequences, the following 48 were identified as being located in this outer membrane: NTH0017, NTH0193, NTH0227, NTH0241, NTH0252, NTH0270, NTH0283, NTH0432, NTH0498, NTH0502, NTH0504, NTH0512, NTH0539, NTH0638, NTH0647, NTH0648, NTH0788, NTH0839, NTH0867, NTH0914, NTH1054, NTH1075, NTH1082, NTH1200, NTH1203, NTH1214, NTH1290, NTH1390, NTH1582, NTH1652, NTH1666, NTH1744, NTH1819, NTH1845, NTH1900, NTH1953, NTH1956, NTH1958, NTH1962, NTH2039, NTH2232, NTH2234, NTH2235, NTH2269, NTH2448, NTH2484, NTH2493, and NTH2727. Outer membrane proteins (OMPs) are surface-exposed and, as such, they represent accessible immunological targets e.g. for diagnostic and for immunisation purposes. OMPs are often invasins, adhesins, etc. which, if blocked, offers a means of preventing bacterial infection.

NTH1845 is an Aida-like autotransporter ('Lav') and is a preferred protein of the invention. It is conserved between NTHi strains, including one known to cause meningitis, but there is no corresponding gene in the Rd sequence or in strain R2846. It lies between the tmk and holb genes. A preferred form of NTH1845 starts at Met-22 (i.e. SEQ ID NO: 5090).

Periplasm

As *H. influenzae* is a Gram-negative bacterium, it has a periplasm between its cell cytoplasmic membrane and its outer membrane. Of the 2540 coding sequences, the following 105 were identified as being located in the periplasm: NTH0014, NTH0049, NTH0057, NTH0059, NTH0106, NTH0119, NTH0120, NTH0132, NTH0174, NTH0190, NTH0206, NTH0244, NTH0346, NTH0405, NTH0421, NTH0468, NTH0485, NTH0513, NTH0547, NTH0619, NTH0643, NTH0661, NTH0691, NTH0738, NTH0820, NTH0835, NTH0848, NTH0849, NTH0856, NTH0861, NTH0863, NTH0865, NTH0910, NTH0926, NTH0961, NTH1015, NTH1019, NTH1121, NTH1164, NTH1185, NTH1190, NTH1261, NTH1268, NTH1301, NTH1311, NTH1388, NTH1394, NTH1406, NTH1407, NTH1414, NTH1435, NTH1469, NTH1541, NTH1570, NTH1600, NTH1601, NTH1619, NTH1622, NTH1724, NTH1745, NTH1773, NTH1781, NTH1798, NTH1807, NTH1829, NTH1865, NTH1871, NTH1892, NTH1897, NTH1916, NTH1917, NTH1965, NTH1999, NTH2116, NTH2119, NTH2133, NTH2135, NTH2149, NTH2150, NTH2187, NTH2217, NTH2227, NTH2256, NTH2258, NTH2277, NTH2291, NTH2316, NTH2342, NTH2344, NTH2369, NTH2394, NTH2432, NTH2434, NTH2451, NTH2496, NTH2508, NTH2537, NTH2541, NTH2572, NTH2575, NTH2610, NTH2705, NTH2726, NTH2738, and NTH2778. Periplasmic proteins represent useful immunological targets e.g. for diagnostic and for immunisation purposes.

Inner Membrane

As *H. influenzae* is a Gram-negative bacterium, it has an inner membrane. Of the 2540 coding sequences, the following 740 were identified as being located in the inner membrane: NTH0002, NTH0015, NTH0019, NTH0020, NTH0021, NTH0025, NTH0032, NTH0034, NTH0035, NTH0041, NTH0043, NTH0045, NTH0048, NTH0050, NTH0052, NTH0060, NTH0061, NTH0067, NTH0073, NTH0076, NTH0085, NTH0089, NTH0091, NTH0097, NTH0107, NTH0110, NTH0116, NTH0118, NTH0121, NTH0128, NTH0134, NTH0135, NTH0151, NTH0155, NTH0157, NTH0158, NTH0180, NTH0184, NTH0185, NTH0186, NTH0189, NTH0199, NTH0203, NTH0208, NTH0209, NTH0223, NTH0224, NTH0228, NTH0232, NTH0237, NTH0238, NTH0242, NTH0247, NTH0248, NTH0251, NTH0253, NTH0254, NTH0256, NTH0263, NTH0269, NTH0278, NTH0279, NTH0280, NTH0290, NTH0295, NTH0297, NTH0302, NTH0307, NTH0311, NTH0317, NTH0320, NTH0321, NTH0325, NTH0326, NTH0333, NTH0334, NTH0341, NTH0347, NTH0351, NTH0352, NTH0353, NTH0356, NTH0358, NTH0366, NTH0371, NTH0372, NTH0388, NTH0397, NTH0400, NTH0401, NTH0402, NTH0407, NTH0411, NTH0412, NTH0417, NTH0418, NTH0420, NTH0426, NTH0427, NTH0434, NTH0435, NTH0437, NTH0444, NTH0453, NTH0455, NTH0457, NTH0459, NTH0460, NTH0461, NTH0462, NTH0463, NTH0465, NTH0469, NTH0473, NTH0475, NTH0478, NTH0484, NTH0489, NTH0490, NTH0493, NTH0496, NTH0507, NTH0509, NTH0518, NTH0524, NTH0526, NTH0528, NTH0529, NTH0544, NTH0545, NTH0549, NTH0565, NTH0566, NTH0574, NTH0580, NTH0581, NTH0584, NTH0585, NTH0586, NTH0587, NTH0590, NTH0617, NTH0618, NTH0622, NTH0624, NTH0626, NTH0630, NTH0636, NTH0637, NTH0642, NTH0644, NTH0646, NTH0654, NTH0656, NTH0658, NTH0673, NTH0675, NTH0676, NTH0677, NTH0678, NTH0680, NTH0694, NTH0696, NTH0702, NTH0703, NTH0706, NTH0709, NTH0710, NTH0712, NTH0715, NTH0718, NTH0728, NTH0730, NTH0740, NTH0744, NTH0745, NTH0749, NTH0750, NTH0755, NTH0762, NTH0764, NTH0765, NTH0771, NTH0774, NTH0794, NTH0795, NTH0796, NTH0797, NTH0798, NTH0802, NTH0803, NTH0804, NTH0813, NTH0814, NTH0815, NTH0821, NTH0822, NTH0827, NTH0829, NTH0834, NTH0836, NTH0850, NTH0851, NTH0852, NTH0858, NTH0872, NTH0874, NTH0875, NTH0880, NTH0887, NTH0888, NTH0894, NTH0904, NTH0913, NTH0927, NTH0928, NTH0941, NTH0948, NTH0949, NTH0950, NTH0952, NTH0953, NTH0955, NTH0964, NTH0968, NTH0973, NTH0986, NTH0987, NTH0989, NTH0994, NTH0996, NTH1002, NTH1003, NTH1004, NTH1005, NTH1009, NTH1010, NTH1012, NTH1020, NTH1021, NTH1026, NTH1028, NTH1031, NTH1032, NTH1037, NTH1039, NTH1042, NTH1043, NTH1048, NTH1052, NTH1058, NTH1063, NTH1064, NTH1069, NTH1073, NTH1080, NTH1083, NTH1084, NTH1085, NTH1086, NTH1087, NTH1089, NTH1090, NTH1091, NTH1092, NTH1098, NTH102, NTH1103, NTH1104, NTH1106, NTH1123, NTH1124, NTH1125, NTH130, NTH1138, NTH1141, NTH1150, NTH1151, NTH1178, NTH1181, NTH1184, NTH1188, NTH1189, NTH1191, NTH1192, NTH1193, NTH1201, NTH1205, NTH1216, NTH1220, NTH1221, NTH1224, NTH1225, NTH1226, NTH1229, NTH1230, NTH1231, NTH1233, NTH1234, NTH1236, NTH1238, NTH1240, NTH1241, NTH1250, NTH1252, NTH1254, NTH1255, NTH1256, NTH1262, NTH1273, NTH1275, NTH1279, NTH1280, NTH1281, NTH1282, NTH1283, NTH1286, NTH1287, NTH1293, NTH1295, NTH1297, NTH1300, NTH1302, NTH1305, NTH1306, NTH1307, NTH1308, NTH1309, NTH1315, NTH1319, NTH1321, NTH1327, NTH1332, NTH1334, NTH1336, NTH1337, NTH1341, NTH1346, NTH1348, NTH1354, NTH1357, NTH1359, NTH1363, NTH1365, NTH1368, NTH1374, NTH1376, NTH1379, NTH1380, NTH1383, NTH1391, NTH1393, NTH1398, NTH1400, NTH1411, NTH1412, NTH1420, NTH1421, NTH1425, NTH1427, NTH1428, NTH1429, NTH1430, NTH1431, NTH1434, NTH1437, NTH1438, NTH1439, NTH1447, NTH1448, NTH1450, NTH1454, NTH1455, NTH1464, NTH1467, NTH1470, NTH1471, NTH1472, NTH1473, NTH1474, NTH1479, NTH1491, NTH1492, NTH1493, NTH1495, NTH1500, NTH1503, NTH1506, NTH1510, NTH1515, NTH1525, NTH1526, NTH1527, NTH1528, NTH1531, NTH1532, NTH1537, NTH1538, NTH1540, NTH1548, NTH1559, NTH1562, NTH1567, NTH1569, NTH1573, NTH1575, NTH1581, NTH1584, NTH1586, NTH1587, NTH1588, NTH1590, NTH1594, NTH1597, NTH1599, NTH1602, NTH1605, NTH1606, NTH1608, NTH1609, NTH1617, NTH1618, NTH1620, NTH1621, NTH1625, NTH1629, NTH1631, NTH1634, NTH1637, NTH1638, NTH1653, NTH1654, NTH1657, NTH1662, NTH1664, NTH1668, NTH1671, NTH1686, NTH1687, NTH1688, NTH1689, NTH1690, NTH1692, NTH1693, NTH1698, NTH1701, NTH1707, NTH1712, NTH1718, NTH1719, NTH1722, NTH1725, NTH1729, NTH1732, NTH1735, NTH1760, NTH1767, NTH1770, NTH1778, NTH1779, NTH1782, NTH1783, NTH1788, NTH1793, NTH1795, NTH1796, NTH1799, NTH1803, NTH1805, NTH1806, NTH1813, NTH1815, NTH1820, NTH824, NTH1828, NTH1835, NTH1836, NTH1842, NTH1849, NTH1850, NTH1859, NTH1861, NTH1870, NTH1872, NTH1881, NTH1882, NTH1885, NTH1888, NTH1889, NTH1891, NTH1896, NTH1898, NTH1899, NTH1906, NTH1908, NTH1919, NTH1923, NTH1925, NTH1927, NTH1935, NTH1939, NTH1941, NTH1951, NTH1960, NTH1963, NTH1966, NTH1967, NTH1968, NTH1978, NTH1981, NTH1986, NTH1992, NTH1993, NTH1995, NTH1996, NTH1997, NTH1998, NTH2001, NTH2005, NTH2008, NTH2009, NTH2010, NTH2024, NTH2025, NTH2038, NTH2040, NTH2041, NTH2043, NTH2050, NTH2052, NTH2055, NTH2060, NTH2062, NTH2064, NTH2065, NTH2070, NTH2071, NTH2073, NTH2078, NTH2079, NTH2081, NTH2083, NTH2089, NTH2091, NTH2092, NTH2093, NTH2094, NTH2095, NTH2096, NTH2097, NTH2099, NTH2101, NTH2112, NTH2115, NTH2118, NTH2120, NTH2122, NTH2126, NTH2128, NTH2129, NTH2130, NTH2131, NTH2136, NTH2138, NTH2145, NTH2146, NTH2162, NTH2163, NTH2166, NTH2169, NTH2170, NTH2173, NTH2181, NTH2183, NTH2191, NTH2193, NTH2195, NTH2196, NTH2200, NTH2204, NTH2205, NTH2209, NTH2213, NTH2226, NTH2228, NTH2231, NTH2242, NTH2243, NTH2247, NTH2250, NTH2253, NTH2257, NTH2259, NTH2262, NTH2263, NTH2266, NTH2273, NTH2274, NTH2282, NTH2284, NTH2285, NTH2288, NTH2292, NTH2296, NTH2299, NTH2318, NTH2323, NTH2324, NTH2326, NTH2327, NTH2333, NTH2343, NTH2346, NTH2347, NTH2352, NTH2361, NTH2364, NTH2365, NTH2368, NTH2370, NTH2371, NTH2376, NTH2377, NTH2381, NTH2382, NTH2388, NTH2398, NTH2402, NTH2405, NTH2406, NTH2407, NTH2408, NTH2414, NTH2422, NTH2430, NTH2433, NTH2438, NTH2447, NTH2455, NTH2457, NTH2458, NTH2472, NTH2478, NTH2481, NTH2486, NTH2495, NTH2497, NTH2498, NTH2499, NTH2501, NTH2505, NTH2525, NTH2531, NTH2532, NTH2533, NTH2534, NTH2542, NTH2543, NTH2545, NTH2546, NTH2548, NTH2549, NTH2550, NTH2552, NTH2554, NTH2556, NTH2557, NTH2558, NTH2562, NTH2566, NTH2567, NTH2568, NTH2569, NTH2570, NTH2573, NTH2577, NTH2578, NTH2587, NTH2591, NTH2593, NTH2597, NTH2600, NTH2602, NTH2603, NTH2604, NTH2605, NTH2612, NTH2613, NTH2615, NTH2616, NTH2618, NTH2626, NTH2633, NTH2640, NTH2647, NTH2648, NTH2649, NTH2650, NTH2661, NTH2663, NTH2664, NTH2667, NTH2668, NTH2674, NTH2675, NTH2680, NTH2690, NTH2701, NTH2702, NTH2703, NTH2708, NTH2711, NTH2724, NTH2725, NTH2732, NTH2735, NTH2740, NTH2743, NTH2749, NTH2750, NTH2755, NTH2756, NTH2757, NTH2764, NTH2765, NTH2774, NTH2777, NTH2779, NTH2781, NTH2793, NTH2794, NTH2796, NTH2797, NTH2798, NTH2806, NTH2807, NTH2813, NTH2814, NTH2823, and NTH2824. Inner membrane proteins represent useful immunological targets e.g. for diagnostic and for immunisation purposes.

Of these proteins, NTH1069 in particular has been identified as a virulence-associated protein. A preferred form of this protein starts at Met-27 (i.e. SEQ ID NO: 5088). Another preferred form starts at Met-19 (SEQ ID NO: 5089).

Adhesin

An adhesin having amino acid sequence SEQ ID NO: 5091 has been identified in a NTHi strain isolated from a patient with meningitis. It is homologous to the Hia adhesin from *N. meningitidis*.

*H. influenzae* Rd

The genome sequence of the serotype d strain KW20 [1,3] was published in 1995. As serotype d strains are generally not pathogens, but the sequenced NTHi strain is from a clinical infection, expressed NTHi sequences that are not seen in serotype d are likely to be the proteins that are involved in pathogenic mechanisms. Blocking these proteins, either by antibiotic treatment or by antibody binding, thus has therapeutic potential. Of the 2540 coding sequences, the following 613 are not seen in the Rd genome: NTH0001, NTH0002, NTH0004, NTH0005, NTH0012, NTH0016, NTH0021, NTH0022, NTH0024, NTH0032, NTH0033, NTH0034, NTH0035, NTH0036, NTH0037, NTH0038, NTH0040, NTH0045, NTH050, NTH0051, NTH0052, NTH0053, NTH0064, NTH0089, NTH0092, NTH0097, NTH0101, NTH0104, NTH0110, NTH0114, NTH0122, NTH0123, NTH0124, NTH0125, NTH0129, NTH0135, NTH0136, NTH0138, NTH0140, NTH0146, NTH0148, NTH0151, NTH0153, NTH0154, NTH0159, NTH0161, NTH0164, NTH0169, NTH0173, NTH0176, NTH0177, NTH0187, NTH0191, NTH0192, NTH0193, NTH0194, NTH0195, NTH0197, NTH0198, NTH0199, NTH0226, NTH0235, NTH0236, NTH0238, NTH0250, NTH0251, NTH0254, NTH0255, NTH0256, NTH0264, NTH0265, NTH0278, NTH0279, NTH0280, NTH0282, NTH0283, NTH0284, NTH0285, NTH0289, NTH0297, NTH0298, NTH0299, NTH0300, NTH0302, NTH0307, NTH0308, NTH0310, NTH0312, NTH0313, NTH0319, NTH0327, NTH0328, NTH0331, NTH0334, NTH0335, NTH0339, NTH0341, NTH0348, NTH0363, NTH0371, NTH0375, NTH0378, NTH0379, NTH0384, NTH0385, NTH0396, NTH0407, NTH0408, NTH0411, NTH0417, NTH0419, NTH0420, NTH0424, NTH0429, NTH0430, NTH0431, NTH0432, NTH0433, NTH0434, NTH0435, NTH0438, NTH0455, NTH0478, NTH0484, NTH0485, NTH0486, NTH0487, NTH0488, NTH0489, NTH0498, NTH0500, NTH0501, NTH0506, NTH0509, NTH0510, NTH0511, NTH0520, NTH0523, NTH0526, NTH0527, NTH0531, NTH0534, NTH0536, NTH0539, NTH0559, NTH0561, NTH0573, NTH0577, NTH0579, NTH0580, NTH0581, NTH0582, NTH0583, NTH0584, NTH0585, NTH0586, NTH0588, NTH0599, NTH0603, NTH0604, NTH0606, NTH0615, NTH0617, NTH0631, NTH0637, NTH0644, NTH0645, NTH0653, NTH0662, NTH0663, NTH0664, NTH0667, NTH0668, NTH0673, NTH0677, NTH0680, NTH0681, NTH0683, NTH0687, NTH0690, NTH0691, NTH0692, NTH0694, NTH0695, NTH0696, NTH0706, NTH0707, NTH0711, NTH0715, NTH0716, NTH0717, NTH0721, NTH0724, NTH0725, NTH0726, NTH0728, NTH0729, NTH0730, NTH0749, NTH0752, NTH0756, NTH0768, NTH0776, NTH0792, NTH0797, NTH0818, NTH0827, NTH0832, NTH0839, NTH0841, NTH0843, NTH0844, NTH0862, NTH0864, NTH0866, NTH0867, NTH0877, NTH0879, NTH0885, NTH0886, NTH0892, NTH0895, NTH0896, NTH0900, NTH0901, NTH0904, NTH0906, NTH0921, NTH0924, NTH0928, NTH0929, NTH0930, NTH0931, NTH0932, NTH0933, NTH0937, NTH0938, NTH0942, NTH0949, NTH0953, NTH0955, NTH0961, NTH0964, NTH0970, NTH0971, NTH0972, NTH0973, NTH0985, NTH0987, NTH0991, NTH0992, NTH0993, NTH0994, NTH0995, NTH0996, NTH1007, NTH1016, NTH1017, NTH1020, NTH1025, NTH1026, NTH1027, NTH1028, NTH1029, NTH1037, NTH1040, NTH1049, NTH1067, NTH1069, NTH1070, NTH1073, NTH1082, NTH1086, NTH1089, NTH1090, NTH1108, NTH1111, NTH1112, NTH1114, NTH1115, NTH1116, NTH1122, NTH1129, NTH1131, NTH1142, NTH1149, NTH1150, NTH1153, NTH1157, NTH1159, NTH1161, NTH1162, NTH1176, NTH11178, NTH1179, NTH1193, NTH1195, NTH1196, NTH1204, NTH1205, NTH1207, NTH1208, NTH1209, NTH1210, NTH1211, NTH1214, NTH1216, NTH1220, NTH1225, NTH1234, NTH1235, NTH1237, NTH1241, NTH1244, NTH1245, NTH1246, NTH1247, NTH1248, NTH1249, NTH1250, NTH1251, NTH1252, NTH1253, NTH1270, NTH1271, NTH1294, NTH1299, NTH1313, NTH1315, NTH1316, NTH1325, NTH1330, NTH1333, NTH1337, NTH1339, NTH1342, NTH1353, NTH1361, NTH1367, NTH1374, NTH1375, NTH1381, NTH1382, NTH1390, NTH1391, NTH1395, NTH1396, NTH1399, NTH1414, NTH1415, NTH1418, NTH1419, NTH1437, NTH1441, NTH1454, NTH1456, NTH1471, NTH1474, NTH1487, NTH1489, NTH1490, NTH1491, NTH1492, NTH1493, NTH1494, NTH1495, NTH1496, NTH1497, NTH1504, NTH1516, NTH1540, NTH1543, NTH1555, NTH1563, NTH1564, NTH1567, NTH1571, NTH1573, NTH1574, NTH1580, NTH1587, NTH1598, NTH1599, NTH1600, NTH1601, NTH1602, NTH1603, NTH1605, NTH1606, NTH1607, NTH1611, NTH1612, NTH1615, NTH1616, NTH1626, NTH1627, NTH1628, NTH1647, NTH1656, NTH1657, NTH1658, NTH1676, NTH1677, NTH1687, NTH1697, NTH1702, NTH1703, NTH1713, NTH1734, NTH1740, NTH1742, NTH1744, NTH1745, NTH1748, NTH1749, NTH1751, NTH1752, NTH1753, NTH1754, NTH1755, NTH1756, NTH1757, NTH1758, NTH1759, NTH1760, NTH1765, NTH1769, NTH1770, NTH1778, NTH1798, NTH1804, NTH1811, NTH1812, NTH1815, NTH1816, NTH1817, NTH1818, NTH1820, NTH1821, NTH1822, NTH1829, NTH1832, NTH1833, NTH1837, NTH1842, NTH1845, NTH1854, NTH1857, NTH1904, NTH1910, NTH1914, NTH1916, NTH1920, NTH1921, NTH1922, NTH1945, NTH1946, NTH1947, NTH1948, NTH1956, NTH1962, NTH1964, NTH1968, NTH1989, NTH1994, NTH2019, NTH2031, NTH2035, NTH2043, NTH2056, NTH2060, NTH2069, NTH2075, NTH2093, NTH2096, NTH2109, NTH2110, NTH2112, NTH2113, NTH2114, NTH2117, NTH2156, NTH2159, NTH2170, NTH2197, NTH2198, NTH2199, NTH2206, NTH2207, NTH2216, NTH2217, NTH2219, NTH2220, NTH2221, NTH2222, NTH2223, NTH2226, NTH2229, NTH2245, NTH2273, NTH2284, NTH2287, NTH2305, NTH2309, NTH2315, NTH2316, NTH2323, NTH2326, NTH2330, NTH2332, NTH2343, NTH2349, NTH2353, NTH2362, NTH2363, NTH2364, NTH2386, NTH2414, NTH2442, NTH2451, NTH2455, NTH2456, NTH2457, NTH2458, NTH2460, NTH2461, NTH2463, NTH2464, NTH2466, NTH2467, NTH2468, NTH2471, NTH2480, NTH2481, NTH2482, NTH2483, NTH2484, NTH2485, NTH2486, NTH2487, NTH2488, NTH2500, NTH2510, NTH2524, NTH2525, NTH2527, NTH2528, NTH2536, NTH2537, NTH2549, NTH2562, NTH2563, NTH2572, NTH2573, NTH2575, NTH2584, NTH2585, NTH2590, NTH2604, NTH2607, NTH2608, NTH2609, NTH2635, NTH2647, NTH2648, NTH2650, NTH2655, NTH2664, NTH2668, NTH2679, NTH2684, NTH2693, NTH2694, NTH2696, NTH2697, NTH2703, NTH2704, NTH2706, NTH2707, NTH2708, NTH2709, NTH2710, NTH2711, NTH2712, NTH2713, NTH2715, NTH2716, NTH2718, NTH2719, NTH2720, NTH2721, NTH2723, NTH2724, NTH2725, NTH2726, NTH2727, NTH2729, NTH2730, NTH2731, NTH2737, NTH2744, NTH2753, NTH2778, NTH2781, NTH2783, NTH2784, NTH2785, NTH2791, NTH2804, NTH2806, NTH2809, NTH2810, and NTH2816.

NTH0861 to NTH0867

Protein NMB0419 from *Neisseria meningitidis* has been found to participate in the meningococcal invasion mechanism [2]. The protein was shown to modulate bacterial interaction with monolayers of human repiratory epithelial cells, promoting invasion. A homologous protein BPF001 is seen in *H. influenzae* biogroup aegyptius, but study of this protein was not possible.

The NTHi genome includes a region (SEQ ID NO: 5081) encoding a string of four polypeptides (NTH0861, NTH0863, NTH0865 and NTH0867) with strong similarity to NMB0419. This region and the four polypeptides are shown below:

```
                    GCCAGCTTGCTGCCTGCGGTCGACTCTANGAGACCCCTACAACAAAACATAATGCTAAAC

AAAAAATGTTTGGTTGTTTCAATTGTTGATTAATAAATGGACGATTTCTATGCGATTCAC
                                          (SEQ ID NO: 1578) NTH0867   M  R  F  T

AAAAACACTTTTTACCACCGCACTTTTAGGTGCTTCTATCTTTTCTTTTCAATCCACCGC
                     K  T  L  F  T  T  A  L  L  G  A  S  I  F  S  F  Q  S  T  A

TTGGGCGGATACGCTGGAACAGCAATTCCAACAAGGTTCTGAAGCCACTACGAGAGGCGA
                     W  A  D  T  L  E  Q  Q  F  Q  Q  G  S  E  A  T  T  R  G  D

TTATCAAACCACCTTTAAATTTTTGTTACCTCTGGCGGAGCAGGGAAATGCAGAGGCTCA
                     Y  Q  T  T  F  K  F  L  L  P  L  A  E  Q  G  N  A  E  A  Q

ATTGATGTTGGGCGTGATGTATGCAAGAGGAATAGGCGTCAAACAAGATGATTTTGAAGC
                     L  M  L  G  V  M  Y  A  R  G  I  G  V  K  Q  D  D  F  E  A

GGTGAAGTGGTATCGCCAAGCGGCGGAGCAGGGATATGCAAATGCTCAAGCTATATTGGG
                     V  K  W  Y  R  Q  A  A  E  Q  G  Y  A  N  A  Q  A  I  L  G

ATTCTCATATCTTTTAGGACAAAGCGGTGTTCAAGTAAATAAATCTTTAGCCAAAGAATG
                     F  S  Y  L  L  G  Q  S  G  V  Q  V  N  K  S  L  A  K  E  W

GTTTGGTAAGGCTTGTGATAATGGTGATCAAAATGGTTGCGAATATTATGGCAAGTTAAA
                     F  G  K  A     D  N  G  D  Q  N  G     E  Y  Y  G  K  L  N

TAGAGGGGAGCTCTAATGCCAACTTTACAATGCGAATTTTGGAATGTAGGGCAAGGGTTA
                     R  G  E  L  *

TTTTCAAGTGGGCGTATTCAAATGGGAGACGCCCCAGCCTTTCATTGGGTTTATGGTTTG

CAAGTTCCTCATCATGGTTCAAAGCCAATTTTAGTGAATAAAAATAAAAGATTATCCATT

CATTCAATTTAATAGGAAAACAAATGAAACTCACAAAAACACTTCTTACCACCGCACTTT
(SEQ ID NO: 1574) NTH0865      M  K  L  T  K  T  L  L  T  T  A  L  F

TCGGTGCTTCTATTTTTTCTTTTCAATCCACCGCTTGGGCGGATACGCCGGAACAGCAAT
                      G  A  S  I  F  S  F  Q  S  T  A  W  A  D  T  P  E  Q  Q  F

TCCAACAAGGTTTAACCGCTTATGAGCAAAGCAACTATCAAACCGCCTTTAAACTTTGGT
                      Q  Q  G  L  T  A  Y  E  Q  S  N  Y  Q  T  A  F  K  L  W  L

TACCTCTGGCGGAGCAGGGAGATGCACAGGCTCAAGGTGGTTTGGGCATGATGTATGAAA
                      P  L  A  E  Q  G  D  A  Q  A  Q  G  G  L  G  M  M  Y  E  R

GAGGACTTGGCGTAAAACAAGATGATTTTCAAAGCAGTGAACTGGTATCGCAAAGCGGCGG
                      G  L  G  V  K  Q  D  D  F  K  A  V  N  W  Y  R  K  A  A  E

AGCAGGGGGATGCAGATGCTCAATTAAATTTGGGTGCGATGTATGCAATCGGACGTGGCG
                      Q  G  D  A  D  A  Q  L  N  L  G  A  M  Y  A  I  G  R  G  V

TAAAACAAGATGGTGTTGAAGCGGTGAAGTGGTTTCGCAAAGCGGCAGAGCAGGGAAATG
                      K  Q  D  G  V  E  A  V  K  W  F  R  K  A  A  E  Q  G  N  A

CAAAGGCTCAAAATGGTTTGGGCATGATGTATGACGGAGGACTTGGCATAAAACAAGATT
                      K  A  Q  N  G  L  G  M  M  Y  D  G  G  L  G  I  K  Q  D  Y

ATTTCAAAGCGGTGAAATGGCATCGCAAAGCGGCGGAGCAGGGATATGGAGGTGCTCAAG
                      F  K  A  V  K  W  H  R  K  A  A  E  Q  G  Y  G  G  A  Q  V

TTATGTTGGGATTCTCATATCTTTCGGGAAAAGGTGTTCAAGTAAATAAATCTTTAGCCA
                      M  L  G  F  S  Y  L  S  G  K  G  V  Q  V  N  K  S  L  A  K

AAGAATGGTTTGGTAAGGCTTGTGATAATGGTGAACAAGTGGGTTGTGAATATTATGGCA
                      E  W  F  G  K  A     D  N  G  E  Q  V  G     E  Y  Y  G  K

AGCTAAATAGAGGGGAACGCTAATGCCAACTTTACAATGCGAATTTTGGAATGTAGGGCA
                      L  N  R  G  E  R  *

AGGGTTATTTTCAAGTGGGCGTATTCAAATGGGAGACGCCCAAGCCTTTCATTGGGTTTA
```

-continued

```
TGGTTTGCAAGTTCCTCATCATGGTTCAAAGCCAATTTTAGTGAATAAAAATAAAAGATT

ATCCATTCATTCAATTTAATAGGAAAACAAAATGAAACTCACAAAAACACTTCTTACCAC
   (SEQ ID NO: 1570) NTH0863   M   K   L   T   K   T   L   L   T   T

CGCACTTTTCGGTGCTTCTGTATTTTCTTTTCAATCCACCGCTTGGGCGGATACGCTGGA
 A   L   F   G   A   S   V   F   S   F   Q   S   T   A   W   A   D   T   L   E

ACAGCAATTCCAACAAGGTTTAACCGCTTATGAGCAAAGCAACTATCAAACCGCCTTTAA
 Q   Q   F   Q   Q   G   L   T   A   Y   E   Q   S   N   Y   Q   T   A   F   K

ACTTTGGTTACCTATGGCAGAGCAGGGATATGCAAAGGCTCAATTTAATTTGGGCGTGAT
 L   W   L   P   M   A   E   Q   G   Y   A   K   A   Q   F   N   L   G   V   M

GTATGCTAAGGGGCAAGGCGTCAAACAAGATGATTTTGAAGCGGTGAAGTGGTTTCGCAA
 Y   A   K   G   Q   G   V   K   Q   D   D   F   E   A   V   K   W   F   R   K

AGCGGCGGAGCAGGGATATGCAGAGGCTAAATTTAATTTGGGCCATATGTATTCTAAGGG
 A   A   E   Q   G   Y   A   E   A   K   F   N   L   G   H   M   Y   S   K   G

ACGAGGCGTCAAACAAGATGATTTTGAAGCAGTGAACTGGTATCGCAAAGCGGCGGAGCA
 R   G   V   K   Q   D   D   F   E   A   V   N   W   Y   R   K   A   A   E   Q

GGGAGATGCAGATGCTCAAGCTATATTGGGATTCTTATATCTTTTAGGAGAAAGAGGTGT
 G   D   A   D   A   Q   A   I   L   G   F   L   Y   L   L   G   E   R   G   V

CAAGTAAATAATTCTTTAGCCAAGNAATGGTNTGGTAAGGCTTGTGATAATGGTAATCAA
 K   *

AATGGCTGCGAATATTATGGCAAGCTAAATAGAGGGGAGCTCTAATGCCCACTTTTACAA

TGCGAATTNTGGAATGTAGGGCAAGGGTTATTTTCAAGTGGGCGTATTCAAGTGGAGACG

CNNCCAAGCCTTTCATTGGGTTTATGGTTTGCAAGTTCCTCATCATGGTTCANAGCCCAA

TTTAGTGNAATAAAAATAAAAGATTATCCATTCATTCAATTTAATAGGAAAACAAAATGA
                     (SEQ ID NO: 1556) NTH0861  M   K

AACTCACAAAAACACTTCTTACCACCGCACTTTTAGGTGCTTCTGTATTATCTTTTCAAT
 L   T   K   T   L   L   T   A   L   L   G   A   S   V   L   S   F   Q   S

CCACCGCTTGGGCGGATACGCTGGAACAGCAATTCCAACAAGGTTTAACCGCTTATGAGC
 T   A   W   A   D   T   L   E   Q   Q   F   Q   Q   G   L   T   A   Y   E   Q

AAAGCAACTATCAAACCGCCTTTAAACTTTGGTTACCTCTGGCGGAGCAGGGAGATGCAA
 S   N   Y   Q   T   A   F   K   L   W   L   P   A   E   Q   G   D   A   N

ATGTTCAATTTAATTTGGGCGTGATGTATGCTGAGGGGCAAGGCGTCAAACAAGATGATT
 V   Q   F   N   L   G   V   M   Y   A   E   G   Q   S   V   K   Q   D   D   F

TTGAAGCGGTGAAATGGTATCGCAAAGCGGCGGAGCAGGGAGATGCAAATGCTCAGGCTT
 E   A   V   K   W   Y   R   K   A   A   E   Q   G   D   A   N   A   Q   A   Y

ATTTAGGTTTGGCTTATACTGAAGGGCGTGGTGTAAGACAAGATTATACCGAAGCGGTGA
 L   G   L   A   Y   T   E   G   R   G   V   R   Q   D   Y   T   E   A   V   K

AGTGGTTTCGCAAAGCGGCGGAGCAGGGACATGCAAATGCTCAAGCTATATGGGATCTCT
 W   F   R   K   A   A   E   Q   G   H   A   N   A   Q   A   I   W   D   L   F

TTCTTTAGGGTACCGAGCCGAATCGATCCA
 L   *
```

The four coding sequences are aligned (ClustalW) below:

```
NTH0863  ATGAAACTCACAAAAACACTTCTTACCACCGCACTTTTCGGTGCTTCTGTATTTTCTTTT
NTH0867  ATGCGATTCACAAAAACACTTTTTACCACCGCACTTTTAGGTGCTTCTATCTTTTCTTTT
NTH0865  ATGAAACTCACAAAAACACTTCTTACCACCGCACTTTTCGGTGCTTCTATTTTTTCTTTT
NTH0861  ATGAAACTCACAAAAACACTTCTTACCACCGCACTTTTAGGTGCTTCTGTATTATCTTTT
         ***  *  ************** ******************  ********  *  ** ******

NTH0863  CAATCCACCGCTTGGGCGGATACGCTGGAACAGCAATTCCAACAAGGTTTAACCGCTTAT
NTH0867  CAATCCACCGCTTGGGCGGATACGCTGGAACAGCAATTCCAACAAGGTTCTGAAGCCACT
NTH0865  CAATCCACCGCTTGGGCGGATACGCCGGAACAGCAATTCCAACAAGGTTTAACCGCTTAT
NTH0861  CAATCCACCGCTTGGGCGGATACGCTGGAACAGCAATTCCAACAAGGTTTAACCGCTTAT
         *************************  *****************************  **    *
```

```
NTH0863 GAGCAAAGCAACTATCAAACCGCCTTTAAACTTTGGTTACCTATGGCAGAGCAGGGATAT
NTH0867 ACGAGAGGCGATTATCAAACCACCTTTAAATTTTTGTTACCTCTGGCGGAGCAGGGAAAT
NTH0865 GAGCAAAGCAACTATCAAACCGCCTTTAAACTTTGGTTACCTCTGGCGGAGCAGGGAGAT
NTH0861 GAGCAAAGCAACTATCAAACCGCCTTTAAACTTTGGTTACCTCTGGCGGAGCAGGGAGAT
         *  *  **  * ********* ********  ***  ******* ****  ********* **

NTH0863 GCAAAGGCTCAATTTAATTTGGGCGTGATGTATGCTAAGGGGCAAGGCGTCAAACAAGAT
NTH0867 GCAGAGGCTCAATTGATGTTGGGCGTGATGTATGCAAGAGGAATAGGCGTCAAACAAGAT
NTH0865 GCACAGGCTCAAGGTGGTTTGGGCATGATGTATGAAAGAGGACTTGGCGTAAAACAAGAT
NTH0861 GCAAATGTTCAATTTAATTTGGGCGTGATGTATGCTGAGGGGCAAGGCGTCAAACAAGAT
         ***  *  ****       ******  *********      **    ***** *********

NTH0863 GATTT-------------------------------------------------------
NTH0867 GATTT-------------------------------------------------------
NTH0865 GATTTCAAAGCAGTGAACTGGTATCGCAAAGCGGCGGAGCAGGGGGATGCAGATGCTCAA
NTH0861 GATTT-------------------------------------------------------
         *****

NTH0863 ---------------------------------------------------TGAAGCG
NTH0867 ---------------------------------------------------TGAAGCG
NTH0865 TTAAATTTGGGTGCGATGTATGCAATCGGACGTGGCGTAAAACAAGATGGTGTTGAAGCG
NTH0861 ---------------------------------------------------TGAAGCG
                                                            *******

NTH0863 GTGAAGTGGTTTCGCAAAGCGGCGGAGCAGGGATATGCAGAGGCTAAATTTAATTTGGGC
NTH0867 GTGAAGTGGTATCGCCAAGCGGCGGAGCAGGGATATGCAAA-------------------
NTH0865 GTGAAGTGGTTTCGCAAAGCGGCAGAGCAGGGAAATGCAAAGGCTCAAAATGGTTTGGGC
NTH0861 CTGAAATGGTATCGCAAAGCGGCGGAGCAGGGAGATGCAAA-------------------
         ***** ****  **** ******* ********  *****  *

NTH0863 CATATGTATTCTAAGGGACGAGGCGTCAAACAAGATGATTTTGAAGCAGTGAACTGGTAT
NTH0867 ------------------------------------------------------------
NTH0865 ATGATGTATGACGGAGGACTTGGCATAAAACAAGATTATTTCAAAGCGGTGAAATGGCAT
NTH0861 ------------------------------------------------------------

NTH0863 CGCAAAGCGGCGGAGCAGGGAGATGCAGATGCTCAAGCTATATTGGGATTCTTATATCTT
NTH0867 ---------------------------TGCTCAAGCTATATTGGGATTCTCATATCTT
NTH0865 CGCAAAGCGGCGGAGCAGGGATATGGAGGTGCTCAAGTTATGTTGGGATTCTCATATCTT
NTH0861 ---------------------------TGCTCAGGCTTATTTAGGTTTGGCTTATACT
                                    ******  *   **  **  **    ***  *

NTH0863 TTAGGAGAAAGAGGTGT-CAAGTAAATAATTCTTTAGCCAAGNAATGGTNTGGTAAGGCT
NTH0867 TTAGGACAAAGCGGTGTTCAAGTAAATAAATCTTTAGCCAAAGAATGGTTTGGTAAGGCT
NTH0865 TCGGGAAAA---GGTGTTCAAGTAAATAAATCTTTAGCCAAAGAATGGTTTGGTAAGGCT
NTH0861 GAAGGGCGT---GGTGTAAGACAAGATTATACCGAAGCGGTGAAGTGGTTTCGCAAAGC-
          **    *****      *    **  *    ***     * ****  *  ** **

NTH0863 TGTGATAATGGTAATCAAAATGGCTGCGAATATTATGGCAAGCTAAATAGAGGGGAGCTC
NTH0867 TGTGATAATGGTGATCAAAATGGTTGCGAATATTATGGCAAGTTAAATAGAGGGGAGCTC
NTH0865 TGTGATAATGGTGAACAAGTGGGTTGTGAATATTATGGCAAGCTAAATAGAGGGGAACGC
NTH0861 ---------GGCGGAGCAGGGACATGCAAATGCT----CAAGCTATAT----GGGATCTC
                   **        *  ** ***  *     ****  **  **    ****  * *

NTH0863 TAATGCCCACTTTTACAATGCGAATTNTGGAATGTAGGGCAAGGGTTATTTTCAAGTGGG
NTH0867 TAATGCCAACTTT-ACAATGCGAATTTTGGAATGTAGGGCAAGGGTTATTTTCAAGTGGG
NTH0865 TAATGCCAACTTT-ACAATGCGAATTTTGGAATGTAGGGCAAGGGTTATTTTCAAGTGGG
NTH0861 TTTCTTTAGGGTA-CCGAGCCGAATC----GATCCA------------------------
         *       *  * *  **   *****    **  *

NTH0863 CGTATTCAAGTGGAGACGCNNCCAAGCCTTTCATTGGGTTTATGGTTTGCAAGTTCCTCA
NTH0867 CGTATTCAAATGG-GAGACGCCCCAGCCTTTCATTGGGTTTATGGTTTGCAAGTTCCTCA
NTH0865 CGTATTCAAATGG-GAGACGCCCAAGCCTTTCATTGGGTTTATGGTTTGCAAGTTCCTCA
NTH0861 ------------------------------------------------------------

NTH0863 TCATGGTTCANAGCCCAATTTAGTGNAATAAAAATAAAAGATTATCCATTCATTCAATTT
NTH0867 TCATGGTTCAAAGCCAATTTTAGTGAA-TAAAAATAAAAGATTATCCATTCATTCAATTT
NTH0865 TCATGGTTCAAAGCCAATTTTAGTGAA-TAAAAATAAAAGATTATCCATTCATTCAATTT
NTH0861 ------------------------------------------------------------

NTH0863 AATAGGAAAACAAA   SEQ ID NO: 5083
NTH0867 AATAGGAAAACAA-   SEQ ID NO: 5085
NTH0865 AATAGGAAAACAAA   SEQ ID NO: 5084
NTH0861 --------------   SEQ ID NO: 5082
```

The encoded polypeptides are aligned below, together with the bpf001 and NMB0419 sequences:

```
NTH0861  ------------MKLTKTLLTTALLG---------ASVLSFQS---TAWADTLEQQFQQG
NTH0863  ------------MKLTKTLLTTALFG---------ASVFSFQS---TAWADTLEQQFQQG
NTH0865  ------------MKLTKTLLTTALFG---------ASIFSFQS---TAWADTPEQQFQQG
NTH0867  ------------MRFTKTLFTSALLG---------ASIFSFQS---TAWADTLEQQFQQG
BPF001   ------------MKLTKTLFTSALLG---------ASILSFHP---TVAAMDFGT--QVG
NMB0419  ------------MKQTVKWLAAALIALGLNRAVWADDVSDFRENLQAAAQGNAAAQYNLG
                     *:  *   .  :::**:.       .: .*:      :.      :  *

NTH0861  LTAYE----QSNYQTAFKLWLPLAEQ-GDANVQFNLGVMYAEGQGVKQDDFEAVKWYRKA
NTH0863  LTAYE----QSNYQTAFKLWLPMAEQ-GYAKAQFNLGVMYAKGQGVKQDDFEAVKWFRKA
NTH0865  LTAYE----QSNYQTAFKLWLPLAEQ-GDAQAQGGLGMMYERGLGVKQDDFKAVNWYRKA
NTH0867  SEATT----RGDYQTTFKFLLPLAEQ-GNAEAQLMLGVMYARGIGVKQDDFEAVKWYRQA
BPF001   IDAYR----KNDFAQAAEQFKDAGIVRGDPTAQLFLGRMYYNGEFFKQDYVEAAKWYRKA
NMB0419  AMYYKGRGVRRDDAEAVRWYRQAAEQ-GLAQAQYNLGWMYANGRGVRQDDTEAVRWYRQA
              :  :      :  .          *  . .*   ** **  .*   .:**   :*...*:*:*

NTH0861  AEQG--------------------------------------------------------
NTH0863  AEQG--------------------------------------------------------
NTH0865  AEQGDADAQLNLGAMYAIGRGVKQDGVEAVKWFRKAAEQGNAKAQNGLGMMYDGGLGIKQ
NTH0867  AEQG--------------------------------------------------------
BPF001   AEQGEEFGLLFLG------------------------------------ETYEDGEGVEK
NMB0419  AAQGVVQAQYNLG-------------------------------------VIYAEGRGVRQ
         * **

NTH0861  ----------------DANAQAYLGLAYTEGR-GVRQDYTEAVKWFRKAAEQGHANAQAI
NTH0863  ----------------YAEAKFNLGHMYSKGR-GVKQDDFEAVNWYRKAAEQGDADAQAI
NTH0865  DYFKAVKWHRKAAEQGYGGAQVMLGFSYLSGK-GVQVNKSLAKEWFGKACDNGEQVGCEY
NTH0867  ----------------YANAQAILGFSYLLGQSGVQVNKSLAKEWFGKACDNGDQNGCEY
BPF001   DYAEAAKLYRKAAEQGSAEGQMALGKMYRFGN-GVEKDYAEAIKLYRKSAEQGNFTALFF
NMB0419  DDVEAVRWFRQAAAQGVAQAQNNLGVMYAERR-GVRQDRALAQEWFGKACQNGDQDGCDN
                         . .: **   *   . **. :     *  : : *:.::*.  .

NTH0861  WDLFL----------------   SEQ ID NO: 1566
NTH0863  LGFLYLLGERGVK---------  SEQ ID NO: 1570
NTH0865  YGKLNR-GER------------  SEQ ID NO: 1574
NTH0867  YGKLNR-GEL------------  SEQ ID NO: 1578
BPF001   LGEMYDNGVGVKQNKAESQRII  SEQ ID NO: 5086
NMB0419  DQRLKAGY--------------  SEQ ID NO: 5087
              :
```

The serial repeats of four closely-related genes that are also related to genes involved in bacterial invasion is noteworthy, and NTH0861, NTH0863, NTH0865 and NTH0867 are of particular interest for immunisation purposes. NTH0867 in particular is an outer-membrane protein that is not seen in the Rd genome, and is of special interest.

Moreover, as well as being caused by NTHi, acute otitis media is often caused by *Moraxella catarrhalis* and *Streptococcus pneumoniae*. Four proteins have been identified that in the NTHi genome that have homologs in the *M. catarrhalis* genome, namely NTH0861 (SEQ ID NO: 1566), NTH0863 (SEQ ID NO: 1570), NTH0865 (SEQ ID NO: 1574) and NTH0867 (SEQ ID NO: 1578). These proteins can thus be used as antigens for a general AOM vaccine. The corresponding *M. catarrhalis* antigens can also be used, either on their own or in combination with the NTHi antigens.

A variant of SEQ ID NO: 1566 is given as SEQ ID NO: 5095:

```
              10        20        30        40        50        60        70        80
              |         |         |         |         |         |         |         |
1566  MKLTKTLLTTALLGASVLSFQSTAWADTLEQQFQQGLTAYEQSNYQTAFKLWLPLAEQGDANVQFNLGVMYAEGQGVKQD
5095  MKLTKTLLTTALLGASVFSFQSTAWADTPEQQFQQGSTAYEQSDYQTAFKLWLPMAEQGDANVQFNLGVMYAKGQGVKQD
      *****************:*********** ****** ******:*********:***********************:*******

90       100       110       120       130       140       150       160
              |         |         |         |         |         |         |
1566  DFEAVKWYRKAAEQ-------------------------------------GDANAQAYLGLAYTEGRGVRQDYTEAVKWF
5095  DFEAVKWYRKAAEQGHAKAQFNLGVMYAKGQGVKQDDFKAVKWYRKAAEQGYADAQANLGSAYSAGRGVRQDYIEAVKWF
      **************                                     *  *:*** ** **:  *********  ******

170       180       190       200       210
              |         |         |         |         |
1566  RKAAEQGHANAQAIWDLFL---------------------------------
5095  KKAAENGSADGQFKLGLVYLIQGQSIQKDRTLAKEWFGKACDNGEQRGCEYYGKLNRGEL
       :****:*  *:.*     .*.
```

A variant of SEQ ID NO: 1570 is given as SEQ ID NO: 5094:

```
              10        20        30        40        50        60        70        80
              |         |         |         |         |         |         |         |
1570   DFEAVKWYRKAAEQ-----------------------------------GDANAQAYLGLAYTEGRGVRQDYTEAVKWF
5094   DFEAVKWYRKAAEQGHAKAQFNLGVMYAKGQGVKQDDFKAVKWYRKAAEQGYADAQANLGSAYSAGRGVRQDYIEAVKWF
       **************                        *  *:***  ** **: ******** ******

90       100       110       120       130
              |         |         |         |         |
1570   DFEAVKWFRKAAEQGYAEAKFNLGHMYSKG-RGVKQDDFEAVNWYRKAAEQGDADAQAILGFLYLLGERGVK
5094   DFEAVKWFRKAAEQGHAKAQAILGFSYLLGERGVQVNKSLAKEWFGKACDNGNQDGCEYYG---KLNRGGF-
       ***************:*:*:  **.  *   * ***:  :. * :*: **.::*: *.     *  *.. *.
```

A variant of SEQ ID NO: 1574 is given as SEQ ID NO: 5093:

```
              10        20        30        40        50        60        70        80
              |         |         |         |         |         |         |         |
1574   MKLTKTLLLTTALFGASIFSFQSTAWADTPEQQFQQGLTAYEQSNYQTAFKLWLPLAEQGDAQAQGGLGMMYERGLGVKQD
5093   MKLTKTLLLTTALFGASIFSFQSTAWADTPEQQFQQGLTAYEQSDYQTAFKLWLPMAEQGYAQAQGGLGMMYERGLGVKQD
       *******************************************.**********:**** ********************

90       100       110       120       130       140       150       160
              |         |         |         |         |         |         |         |
1574   DFKAVNWYRKAAEQGDADAQLNLGAMYAIGRGVKQDGVEAVKWFRKAAEQGNAKAQNGLGMMYDGGLGIKQDYFKAVKWH
5093   DFKAVNWYRKAAEQGDADAQLNLGAMYAIGHGVKQDGVEAVKWFRKAAEQGNAKAQNGLGMMYRGRLGIKQDYFKAVKWY
       *****************************:*******************************  * *************:

170       180       190       200       210
              |         |         |         |         |
1574   RKAAEQGYGGAQVMLGFSYLSGKGVQVNKSLAKEWFGKACDNGEQVGCEYYGKLNRGER
5093   RKAAEQGYGGAQVMLGFSYLSGKGVQVNKSLAKEWFGKACDNGEQVGCEYYSKLNRGER
       ***************************************************.*******
```

A variant of SEQ ID NO: 1578 is given as SEQ ID NO: 5092:

```
              10        20        30        40        50        60        70        80
              |         |         |         |         |         |         |         |
5092   MRFTKTLFTTALLGASVFSFQSTAWADTLEQQFQQGSEATTRGDYQTTFKFLLPLAEQGNALAQMMLGVMYAKGQGVKQD
1578   MRFTKTLFTTALLGASIFSFQSTAWADTLEQQFQQGSEATTRGDYQTTFKFLLPLAEQGNAEAQLMLGVMYARGIGVKQD
       ***************:************************************************ **:*******:* *****

90       100       110       120       130       140
              |         |         |         |         |         |
5092   DVEAVKWYRKAAEQGYADAQAMLGFSYLLGQSGVQVNKSLAKEWFGKACDNGDQNGCEYYGKLNRGEL
1578   DFEAVKWYRQAAEQGYANAQAILGFSYLLGQSGVQVNKSLAKEWFGKACDNGDQNGCEYYGKLNRGEL
       *.*******:*******.***:*********************************************
```

Preferred NTH0861 proteins have identity to both of SEQ ID NOS: 1566 and 5095. Preferred NTH0863 proteins have identity to both of SEQ ID NOS: 1570 and 5094. Preferred NTH0865 proteins have identity to both of SEQ ID NOS: 1574 and 5093. Preferred NTH0867 proteins have identity to both of SEQ ID NOS: 1578 and 5092.

It will be understood that the invention has been described by way of example only and modifications may be made whilst remaining within the scope and spirit of the invention.

TABLE I

| MISSING NTHnnnn VALUES between NTH0001 and NTH2832 |||||||||||
|---|---|---|---|---|---|---|---|---|---|---|---|
| 0008 | 0031 | 0042 | 0054 | 0056 | 0066 | 0074 | 0077 | 0093 | 0111 | 0160 | 0162 |
| 0166 | 0171 | 0179 | 0210 | 0213 | 0214 | 0219 | 0229 | 0231 | 0276 | 0281 | 0288 |
| 0293 | 0322 | 0332 | 0357 | 0362 | 0381 | 0395 | 0398 | 0404 | 0406 | 0409 | 0410 |
| 0415 | 0439 | 0445 | 0446 | 0452 | 0466 | 0471 | 0491 | 0497 | 0516 | 0533 | 0538 |
| 0541 | 0546 | 0551 | 0553 | 0556 | 0569 | 0578 | 0598 | 0600 | 0610 | 0623 | 0639 |
| 0649 | 0666 | 0693 | 0713 | 0722 | 0727 | 0742 | 0746 | 0757 | 0763 | 0780 | 0789 |

TABLE I-continued

MISSING NTHnnnn VALUES between NTH0001 and NTH2832

| | | | | | | | | | | | |
|---|---|---|---|---|---|---|---|---|---|---|---|
| 0791 | 0793 | 0800 | 0809 | 0816 | 0855 | 0883 | 0891 | 0902 | 0911 | 0915 | 0916 |
| 0922 | 0943 | 0944 | 0957 | 0975 | 0978 | 0980 | 0998 | 0999 | 1013 | 1034 | 1044 |
| 1047 | 1055 | 1056 | 1065 | 1072 | 1076 | 1079 | 1099 | 1113 | 1118 | 1119 | 1128 |
| 1133 | 1134 | 1136 | 1146 | 1147 | 1158 | 1160 | 1170 | 1194 | 1199 | 1213 | 1219 |
| 1223 | 1232 | 1243 | 1257 | 1260 | 1288 | 1289 | 1296 | 1312 | 1317 | 1329 | 1335 |
| 1347 | 1350 | 1356 | 1358 | 1362 | 1364 | 1372 | 1377 | 1385 | 1452 | 1458 | 1469 |
| 1478 | 1481 | 1486 | 1488 | 1502 | 1517 | 1518 | 1529 | 1536 | 1547 | 1553 | 1557 |
| 1560 | 1566 | 1592 | 1595 | 1596 | 1604 | 1642 | 1649 | 1667 | 1669 | 1674 | 1691 |
| 1699 | 1711 | 1715 | 1721 | 1723 | 1727 | 1728 | 1731 | 1737 | 1741 | 1743 | 1746 |
| 1750 | 1761 | 1772 | 1784 | 1797 | 1810 | 1814 | 1823 | 1843 | 1844 | 1856 | 1864 |
| 1866 | 1878 | 1902 | 1909 | 1918 | 1957 | 1961 | 1979 | 1985 | 1987 | 1990 | 2004 |
| 2006 | 2015 | 2017 | 2023 | 2033 | 2037 | 2042 | 2054 | 2077 | 2080 | 2098 | 2104 |
| 2107 | 2125 | 2154 | 2167 | 2171 | 2174 | 2179 | 2194 | 2203 | 2210 | 2218 | 2237 |
| 2239 | 2240 | 2244 | 2254 | 2255 | 2267 | 2268 | 2270 | 2275 | 2278 | 2286 | 2290 |
| 2295 | 2300 | 2302 | 2312 | 2320 | 2334 | 2340 | 2355 | 2357 | 2366 | 2367 | 2374 |
| 2380 | 2400 | 2409 | 2431 | 2444 | 2459 | 2523 | 2540 | 2547 | 2551 | 2574 | 2580 |
| 2589 | 2601 | 2611 | 2614 | 2624 | 2628 | 2637 | 2639 | 2645 | 2652 | 2658 | 2662 |
| 2677 | 2692 | 2699 | 2700 | 2728 | 2734 | 2746 | 2760 | 2767 | 2773 | 2787 | 2799 |
| 2805 | 2808 | 2819 | 2822 | | | | | | | | |

TABLE II

Preferred polypeptides

| | | | | | | | |
|---|---|---|---|---|---|---|---|
| NTH0001 | NTH0002 | NTH0004 | NTH0005 | NTH0012 | NTH0014 | NTH0015 | NTH0016 |
| NTH0017 | NTH0019 | NTH0020 | NTH0021 | NTH0022 | NTH0024 | NTH0025 | NTH0032 |
| NTH0033 | NTH0034 | NTH0035 | NTH0036 | NTH0037 | NTH0038 | NTH0040 | NTH0041 |
| NTH0043 | NTH0045 | NTH0048 | NTH0049 | NTH0050 | NTH0051 | NTH0052 | NTH0053 |
| NTH0057 | NTH0059 | NTH0060 | NTH0061 | NTH0064 | NTH0067 | NTH0073 | NTH0076 |
| NTH0085 | NTH0089 | NTH0091 | NTH0092 | NTH0094 | NTH0097 | NTH0101 | NTH0104 |
| NTH0106 | NTH0107 | NTH0110 | NTH0114 | NTH0116 | NTH0118 | NTH0119 | NTH0120 |
| NTH0121 | NTH0122 | NTH0123 | NTH0124 | NTH0125 | NTH0128 | NTH0129 | NTH0132 |
| NTH0134 | NTH0135 | NTH0136 | NTH0138 | NTH0140 | NTH0146 | NTH0148 | NTH0151 |
| NTH0153 | NTH0154 | NTH0155 | NTH0157 | NTH0158 | NTH0159 | NTH0161 | NTH0163 |
| NTH0164 | NTH0167 | NTH0169 | NTH0173 | NTH0174 | NTH0176 | NTH0177 | NTH0180 |
| NTH0184 | NTH0185 | NTH0186 | NTH0187 | NTH0189 | NTH0190 | NTH0191 | NTH0192 |
| NTH0193 | NTH0194 | NTH0195 | NTH0197 | NTH0198 | NTH0199 | NTH0203 | NTH0206 |
| NTH0208 | NTH0209 | NTH0223 | NTH0224 | NTH0226 | NTH0227 | NTH0228 | NTH0232 |
| NTH0235 | NTH0236 | NTH0237 | NTH0238 | NTH0241 | NTH0242 | NTH0244 | NTH0247 |
| NTH0248 | NTH0250 | NTH0251 | NTH0252 | NTH0253 | NTH0254 | NTH0255 | NTH0256 |
| NTH0263 | NTH0264 | NTH0265 | NTH0269 | NTH0270 | NTH0278 | NTH0279 | NTH0280 |
| NTH0282 | NTH0283 | NTH0284 | NTH0285 | NTH0289 | NTH0290 | NTH0295 | NTH0297 |
| NTH0298 | NTH0299 | NTH0300 | NTH0302 | NTH0307 | NTH0308 | NTH0310 | NTH0311 |
| NTH0312 | NTH0313 | NTH0317 | NTH0319 | NTH0320 | NTH0321 | NTH0325 | NTH0326 |
| NTH0327 | NTH0328 | NTH0331 | NTH0333 | NTH0334 | NTH0335 | NTH0339 | NTH0341 |
| NTH0346 | NTH0347 | NTH0348 | NTH0351 | NTH0352 | NTH0353 | NTH0356 | NTH0358 |
| NTH0363 | NTH0366 | NTH0371 | NTH0372 | NTH0375 | NTH0378 | NTH0379 | NTH0384 |
| NTH0385 | NTH0388 | NTH0396 | NTH0397 | NTH0400 | NTH0401 | NTH0402 | NTH0405 |
| NTH0407 | NTH0408 | NTH0411 | NTH0412 | NTH0417 | NTH0418 | NTH0419 | NTH0420 |
| NTH0421 | NTH0424 | NTH0426 | NTH0427 | NTH0429 | NTH0430 | NTH0431 | NTH0432 |
| NTH0433 | NTH0434 | NTH0435 | NTH0437 | NTH0438 | NTH0444 | NTH0453 | NTH0455 |
| NTH0457 | NTH0459 | NTH0460 | NTH0461 | NTH0462 | NTH0463 | NTH0465 | NTH0468 |
| NTH0469 | NTH0473 | NTH0475 | NTH0478 | NTH0484 | NTH0485 | NTH0486 | NTH0487 |
| NTH0488 | NTH0489 | NTH0490 | NTH0493 | NTH0496 | NTH0498 | NTH0500 | NTH0501 |
| NTH0502 | NTH0504 | NTH0506 | NTH0507 | NTH0509 | NTH0510 | NTH0511 | NTH0512 |
| NTH0513 | NTH0518 | NTH0520 | NTH0523 | NTH0524 | NTH0526 | NTH0527 | NTH0528 |
| NTH0529 | NTH0531 | NTH0534 | NTH0536 | NTH0539 | NTH0544 | NTH0545 | NTH0547 |
| NTH0549 | NTH0559 | NTH0561 | NTH0565 | NTH0566 | NTH0573 | NTH0574 | NTH0577 |
| NTH0579 | NTH0580 | NTH0581 | NTH0582 | NTH0583 | NTH0584 | NTH0585 | NTH0586 |
| NTH0587 | NTH0588 | NTH0590 | NTH0599 | NTH0603 | NTH0604 | NTH0606 | NTH0615 |
| NTH0617 | NTH0618 | NTH0619 | NTH0622 | NTH0624 | NTH0626 | NTH0630 | NTH0631 |
| NTH0636 | NTH0637 | NTH0638 | NTH0642 | NTH0643 | NTH0644 | NTH0645 | NTH0646 |
| NTH0647 | NTH0648 | NTH0653 | NTH0654 | NTH0656 | NTH0658 | NTH0661 | NTH0662 |
| NTH0663 | NTH0664 | NTH0667 | NTH0668 | NTH0673 | NTH0675 | NTH0676 | NTH0677 |
| NTH0678 | NTH0680 | NTH0681 | NTH0683 | NTH0687 | NTH0690 | NTH0691 | NTH0692 |
| NTH0694 | NTH0695 | NTH0696 | NTH0702 | NTH0703 | NTH0706 | NTH0707 | NTH0709 |
| NTH0710 | NTH0711 | NTH0712 | NTH0715 | NTH0716 | NTH0717 | NTH0718 | NTH0721 |
| NTH0724 | NTH0725 | NTH0726 | NTH0728 | NTH0729 | NTH0730 | NTH0738 | NTH0740 |
| NTH0744 | NTH0745 | NTH0749 | NTH0750 | NTH0752 | NTH0755 | NTH0756 | NTH0762 |
| NTH0764 | NTH0765 | NTH0768 | NTH0771 | NTH0774 | NTH0776 | NTH0788 | NTH0792 |
| NTH0794 | NTH0795 | NTH0796 | NTH0797 | NTH0798 | NTH0802 | NTH0803 | NTH0804 |
| NTH0813 | NTH0814 | NTH0815 | NTH0818 | NTH0820 | NTH0821 | NTH0822 | NTH0827 |
| NTH0829 | NTH0832 | NTH0834 | NTH0835 | NTH0836 | NTH0838 | NTH0839 | NTH0841 |
| NTH0843 | NTH0844 | NTH0848 | NTH0849 | NTH0850 | NTH0851 | NTH0852 | NTH0856 |

TABLE II-continued

Preferred polypeptides

| | | | | | | | |
|---|---|---|---|---|---|---|---|
| NTH0858 | NTH0861 | NTH0862 | NTH0863 | NTH0864 | NTH0865 | NTH0866 | NTH0867 |
| NTH0872 | NTH0874 | NTH0875 | NTH0877 | NTH0879 | NTH0880 | NTH0885 | NTH0886 |
| NTH0887 | NTH0888 | NTH0892 | NTH0894 | NTH0895 | NTH0896 | NTH0900 | NTH0901 |
| NTH0904 | NTH0906 | NTH0909 | NTH0910 | NTH0913 | NTH0914 | NTH0921 | NTH0924 |
| NTH0926 | NTH0927 | NTH0928 | NTH0929 | NTH0930 | NTH0931 | NTH0932 | NTH0933 |
| NTH0937 | NTH0938 | NTH0941 | NTH0942 | NTH0948 | NTH0949 | NTH0950 | NTH0952 |
| NTH0953 | NTH0955 | NTH0961 | NTH0964 | NTH0968 | NTH0970 | NTH0971 | NTH0972 |
| NTH0973 | NTH0985 | NTH0986 | NTH0987 | NTH0989 | NTH0991 | NTH0992 | NTH0993 |
| NTH0994 | NTH0995 | NTH0996 | NTH0997 | NTH1000 | NTH1002 | NTH1003 | NTH1004 |
| NTH1005 | NTH1007 | NTH1009 | NTH1010 | NTH1012 | NTH1015 | NTH1016 | NTH1017 |
| NTH1018 | NTH1020 | NTH1021 | NTH1025 | NTH1026 | NTH1027 | NTH1028 | NTH1029 |
| NTH1031 | NTH1032 | NTH1037 | NTH1039 | NTH1040 | NTH1042 | NTH1043 | NTH1048 |
| NTH1049 | NTH1052 | NTH1054 | NTH1058 | NTH1063 | NTH1064 | NTH1067 | NTH1069 |
| NTH1070 | NTH1073 | NTH1075 | NTH1080 | NTH1082 | NTH1083 | NTH1084 | NTH1085 |
| NTH1086 | NTH1087 | NTH1089 | NTH1090 | NTH1091 | NTH1092 | NTH1098 | NTH1102 |
| NTH1103 | NTH1104 | NTH1106 | NTH1108 | NTH1111 | NTH1112 | NTH1114 | NTH1115 |
| NTH1116 | NTH1121 | NTH1122 | NTH1123 | NTH1124 | NTH1125 | NTH1129 | NTH1130 |
| NTH1131 | NTH1138 | NTH1141 | NTH1142 | NTH1149 | NTH1150 | NTH1151 | NTH1153 |
| NTH1157 | NTH1159 | NTH1161 | NTH1162 | NTH1164 | NTH1174 | NTH1176 | NTH1178 |
| NTH1179 | NTH1181 | NTH1184 | NTH1185 | NTH1188 | NTH1189 | NTH1190 | NTH1191 |
| NTH1192 | NTH1193 | NTH1195 | NTH1196 | NTH1200 | NTH1201 | NTH1203 | NTH1204 |
| NTH1205 | NTH1207 | NTH1208 | NTH1209 | NTH1210 | NTH1211 | NTH1214 | NTH1216 |
| NTH1220 | NTH1221 | NTH1224 | NTH1225 | NTH1226 | NTH1229 | NTH1230 | NTH1231 |
| NTH1233 | NTH1234 | NTH1235 | NTH1236 | NTH1237 | NTH1238 | NTH1240 | NTH1241 |
| NTH1244 | NTH1245 | NTH1246 | NTH1247 | NTH1248 | NTH1249 | NTH1250 | NTH1251 |
| NTH1252 | NTH1253 | NTH1254 | NTH1255 | NTH1256 | NTH1261 | NTH1262 | NTH1268 |
| NTH1270 | NTH1271 | NTH1273 | NTH1275 | NTH1279 | NTH1280 | NTH1281 | NTH1282 |
| NTH1283 | NTH1286 | NTH1287 | NTH1290 | NTH1293 | NTH1294 | NTH1295 | NTH1297 |
| NTH1298 | NTH1299 | NTH1300 | NTH1301 | NTH1302 | NTH1305 | NTH1306 | NTH1307 |
| NTH1308 | NTH1309 | NTH1311 | NTH1313 | NTH1315 | NTH1316 | NTH1319 | NTH1321 |
| NTH1325 | NTH1327 | NTH1330 | NTH1332 | NTH1333 | NTH1334 | NTH1336 | NTH1337 |
| NTH1339 | NTH1341 | NTH1342 | NTH1346 | NTH1348 | NTH1353 | NTH1354 | NTH1357 |
| NTH1359 | NTH1361 | NTH1363 | NTH1365 | NTH1367 | NTH1368 | NTH1374 | NTH1375 |
| NTH1376 | NTH1379 | NTH1380 | NTH1381 | NTH1382 | NTH1383 | NTH1388 | NTH1390 |
| NTH1391 | NTH1393 | NTH1394 | NTH1395 | NTH1396 | NTH1398 | NTH1399 | NTH1400 |
| NTH1406 | NTH1407 | NTH1411 | NTH1412 | NTH1413 | NTH1414 | NTH1415 | NTH1416 |
| NTH1418 | NTH1419 | NTH1420 | NTH1421 | NTH1425 | NTH1427 | NTH1428 | NTH1429 |
| NTH1430 | NTH1431 | NTH1434 | NTH1435 | NTH1437 | NTH1438 | NTH1439 | NTH1441 |
| NTH1447 | NTH1448 | NTH1450 | NTH1454 | NTH1455 | NTH1456 | NTH1464 | NTH1467 |
| NTH1468 | NTH1470 | NTH1471 | NTH1472 | NTH1473 | NTH1474 | NTH1479 | NTH1487 |
| NTH1489 | NTH1490 | NTH1491 | NTH1492 | NTH1493 | NTH1494 | NTH1495 | NTH1496 |
| NTH1497 | NTH1500 | NTH1503 | NTH1504 | NTH1506 | NTH1510 | NTH1515 | NTH1516 |
| NTH1525 | NTH1526 | NTH1527 | NTH1528 | NTH1531 | NTH1532 | NTH1537 | NTH1538 |
| NTH1540 | NTH1541 | NTH1543 | NTH1548 | NTH1552 | NTH1555 | NTH1559 | NTH1562 |
| NTH1563 | NTH1564 | NTH1567 | NTH1569 | NTH1570 | NTH1571 | NTH1573 | NTH1574 |
| NTH1575 | NTH1580 | NTH1581 | NTH1582 | NTH1584 | NTH1586 | NTH1587 | NTH1588 |
| NTH1590 | NTH1594 | NTH1597 | NTH1598 | NTH1599 | NTH1600 | NTH1601 | NTH1602 |
| NTH1603 | NTH1605 | NTH1606 | NTH1607 | NTH1608 | NTH1609 | NTH1611 | NTH1612 |
| NTH1615 | NTH1616 | NTH1617 | NTH1618 | NTH1619 | NTH1620 | NTH1621 | NTH1622 |
| NTH1623 | NTH1625 | NTH1626 | NTH1627 | NTH1628 | NTH1629 | NTH1631 | NTH1634 |
| NTH1637 | NTH1638 | NTH1647 | NTH1652 | NTH1653 | NTH1654 | NTH1656 | NTH1657 |
| NTH1658 | NTH1662 | NTH1664 | NTH1666 | NTH1668 | NTH1671 | NTH1675 | NTH1676 |
| NTH1677 | NTH1680 | NTH1686 | NTH1687 | NTH1688 | NTH1689 | NTH1690 | NTH1692 |
| NTH1693 | NTH1697 | NTH1698 | NTH1701 | NTH1702 | NTH1703 | NTH1707 | NTH1712 |
| NTH1713 | NTH1718 | NTH1719 | NTH1722 | NTH1724 | NTH1725 | NTH1729 | NTH1732 |
| NTH1734 | NTH1735 | NTH1739 | NTH1740 | NTH1742 | NTH1744 | NTH1745 | NTH1748 |
| NTH1749 | NTH1751 | NTH1752 | NTH1753 | NTH1754 | NTH1755 | NTH1756 | NTH1757 |
| NTH1758 | NTH1759 | NTH1760 | NTH1765 | NTH1767 | NTH1769 | NTH1770 | NTH1773 |
| NTH1778 | NTH1779 | NTH1781 | NTH1782 | NTH1783 | NTH1788 | NTH1793 | NTH1795 |
| NTH1796 | NTH1798 | NTH1799 | NTH1803 | NTH1804 | NTH1805 | NTH1806 | NTH1807 |
| NTH1811 | NTH1812 | NTH1813 | NTH1815 | NTH1816 | NTH1817 | NTH1818 | NTH1819 |
| NTH1820 | NTH1821 | NTH1822 | NTH1824 | NTH1828 | NTH1829 | NTH1832 | NTH1833 |
| NTH1835 | NTH1836 | NTH1837 | NTH1842 | NTH1845 | NTH1849 | NTH1850 | NTH1854 |
| NTH1857 | NTH1859 | NTH1861 | NTH1865 | NTH1870 | NTH1871 | NTH1872 | NTH1873 |
| NTH1881 | NTH1882 | NTH1885 | NTH1888 | NTH1889 | NTH1891 | NTH1892 | NTH1896 |
| NTH1897 | NTH1898 | NTH1899 | NTH1900 | NTH1904 | NTH1906 | NTH1908 | NTH1910 |
| NTH1914 | NTH1916 | NTH1917 | NTH1919 | NTH1920 | NTH1921 | NTH1922 | NTH1923 |
| NTH1925 | NTH1927 | NTH1935 | NTH1939 | NTH1941 | NTH1942 | NTH1945 | NTH1946 |
| NTH1947 | NTH1948 | NTH1951 | NTH1953 | NTH1956 | NTH1958 | NTH1960 | NTH1962 |
| NTH1963 | NTH1964 | NTH1965 | NTH1966 | NTH1967 | NTH1968 | NTH1974 | NTH1978 |
| NTH1981 | NTH1986 | NTH1989 | NTH1992 | NTH1993 | NTH1994 | NTH1995 | NTH1996 |
| NTH1997 | NTH1998 | NTH1999 | NTH2001 | NTH2005 | NTH2008 | NTH2009 | NTH2010 |
| NTH2019 | NTH2024 | NTH2025 | NTH2031 | NTH2035 | NTH2038 | NTH2039 | NTH2040 |
| NTH2041 | NTH2043 | NTH2050 | NTH2052 | NTH2055 | NTH2056 | NTH2060 | NTH2062 |
| NTH2064 | NTH2065 | NTH2069 | NTH2070 | NTH2071 | NTH2073 | NTH2075 | NTH2078 |
| NTH2079 | NTH2081 | NTH2083 | NTH2089 | NTH2091 | NTH2092 | NTH2093 | NTH2094 |
| NTH2095 | NTH2096 | NTH2097 | NTH2099 | NTH2101 | NTH2109 | NTH2110 | NTH2112 |

TABLE II-continued

Preferred polypeptides

| | | | | | | | |
|---|---|---|---|---|---|---|---|
| NTH2113 | NTH2114 | NTH2115 | NTH2116 | NTH2117 | NTH2118 | NTH2119 | NTH2120 |
| NTH2122 | NTH2126 | NTH2128 | NTH2129 | NTH2130 | NTH2131 | NTH2133 | NTH2135 |
| NTH2136 | NTH2138 | NTH2142 | NTH2145 | NTH2146 | NTH2149 | NTH2150 | NTH2156 |
| NTH2159 | NTH2162 | NTH2163 | NTH2166 | NTH2169 | NTH2170 | NTH2173 | NTH2181 |
| NTH2183 | NTH2187 | NTH2191 | NTH2193 | NTH2195 | NTH2196 | NTH2197 | NTH2198 |
| NTH2199 | NTH2200 | NTH2204 | NTH2205 | NTH2206 | NTH2207 | NTH2209 | NTH2213 |
| NTH2216 | NTH2217 | NTH2219 | NTH2220 | NTH2221 | NTH2222 | NTH2223 | NTH2226 |
| NTH2227 | NTH2228 | NTH2229 | NTH2231 | NTH2232 | NTH2234 | NTH2235 | NTH2242 |
| NTH2243 | NTH2245 | NTH2247 | NTH2250 | NTH2251 | NTH2253 | NTH2256 | NTH2257 |
| NTH2258 | NTH2259 | NTH2262 | NTH2263 | NTH2266 | NTH2269 | NTH2273 | NTH2274 |
| NTH2277 | NTH2282 | NTH2284 | NTH2285 | NTH2287 | NTH2288 | NTH2291 | NTH2292 |
| NTH2296 | NTH2299 | NTH2305 | NTH2309 | NTH2315 | NTH2316 | NTH2318 | NTH2323 |
| NTH2324 | NTH2326 | NTH2327 | NTH2330 | NTH2332 | NTH2333 | NTH2342 | NTH2343 |
| NTH2344 | NTH2346 | NTH2347 | NTH2349 | NTH2352 | NTH2353 | NTH2356 | NTH2358 |
| NTH2361 | NTH2362 | NTH2363 | NTH2364 | NTH2365 | NTH2368 | NTH2369 | NTH2370 |
| NTH2371 | NTH2376 | NTH2377 | NTH2381 | NTH2382 | NTH2386 | NTH2388 | NTH2394 |
| NTH2398 | NTH2402 | NTH2405 | NTH2406 | NTH2407 | NTH2408 | NTH2414 | NTH2414 |
| NTH2422 | NTH2430 | NTH2432 | NTH2433 | NTH2434 | NTH2438 | NTH2442 | NTH2447 |
| NTH2448 | NTH2451 | NTH2455 | NTH2456 | NTH2457 | NTH2458 | NTH2460 | NTH2461 |
| NTH2463 | NTH2464 | NTH2466 | NTH2467 | NTH2468 | NTH2471 | NTH2472 | NTH2478 |
| NTH2480 | NTH2481 | NTH2482 | NTH2483 | NTH2484 | NTH2485 | NTH2486 | NTH2487 |
| NTH2488 | NTH2493 | NTH2495 | NTH2496 | NTH2497 | NTH2498 | NTH2499 | NTH2500 |
| NTH2501 | NTH2505 | NTH2508 | NTH2510 | NTH2524 | NTH2525 | NTH2527 | NTH2528 |
| NTH2531 | NTH2532 | NTH2533 | NTH2534 | NTH2536 | NTH2537 | NTH2541 | NTH2542 |
| NTH2543 | NTH2545 | NTH2546 | NTH2548 | NTH2549 | NTH2550 | NTH2552 | NTH2554 |
| NTH2556 | NTH2557 | NTH2558 | NTH2562 | NTH2563 | NTH2566 | NTH2567 | NTH2568 |
| NTH2569 | NTH2570 | NTH2572 | NTH2573 | NTH2575 | NTH2577 | NTH2578 | NTH2584 |
| NTH2585 | NTH2587 | NTH2588 | NTH2590 | NTH2591 | NTH2593 | NTH2595 | NTH2597 |
| NTH2600 | NTH2602 | NTH2603 | NTH2604 | NTH2605 | NTH2607 | NTH2608 | NTH2609 |
| NTH2610 | NTH2612 | NTH2613 | NTH2615 | NTH2616 | NTH2618 | NTH2626 | NTH2633 |
| NTH2635 | NTH2640 | NTH2641 | NTH2647 | NTH2648 | NTH2649 | NTH2650 | NTH2655 |
| NTH2661 | NTH2663 | NTH2664 | NTH2667 | NTH2668 | NTH2673 | NTH2674 | NTH2675 |
| NTH2679 | NTH2680 | NTH2684 | NTH2690 | NTH2693 | NTH2694 | NTH2696 | NTH2697 |
| NTH2701 | NTH2702 | NTH2703 | NTH2704 | NTH2705 | NTH2706 | NTH2707 | NTH2708 |
| NTH2709 | NTH2710 | NTH2711 | NTH2712 | NTH2713 | NTH2715 | NTH2716 | NTH2718 |
| NTH2719 | NTH2720 | NTH2721 | NTH2723 | NTH2724 | NTH2725 | NTH2726 | NTH2727 |
| NTH2729 | NTH2730 | NTH2731 | NTH2732 | NTH2735 | NTH2737 | NTH2738 | NTH2740 |
| NTH2743 | NTH2744 | NTH2749 | NTH2750 | NTH2753 | NTH2754 | NTH2755 | NTH2756 |
| NTH2757 | NTH2758 | NTH2764 | NTH2765 | NTH2769 | NTH2774 | NTH2777 | NTH2778 |
| NTH2779 | NTH2781 | NTH2783 | NTH2784 | NTH2785 | NTH2791 | NTH2793 | NTH2794 |
| NTH2796 | NTH2797 | NTH2798 | NTH2804 | NTH2806 | NTH2807 | NTH2809 | NTH2810 |
| NTH2813 | NTH2814 | NTH2816 | NTH2823 | | | | |

TABLE III

Annotations

| NTH | aa | PSORT | Annotation |
|---|---|---|---|
| 0003 | 274 | cytoplasm | Diaminopimelate epimerase (dapF) |
| 0007 | 61 | cytoplasm | tldD protein tldD |
| 0010 | 158 | cytoplasm | transcriptional regulator |
| 0011 | 93 | cytoplasm | usg-1 protein (usg1) |
| 0013 | 274 | cytoplasm | excinuclease ABC, subunit C (uvrC) |
| 0014 | 64 | periplasmic | excinuclease ABC, subunit C (uvrC) |
| 0017 | 161 | outer | 2',3'-cyclic-nucleotide 2'-phosphodiesterase (cpdB) |
| 0018 | 130 | cytoplasm | 16s pseudouridylate 516 synthase (rsuA) |
| 0019 | 98 | inner 1 | bicyclomycin resistance protein (bcr) |
| 0020 | 181 | inner 4 | Na(+)-translocating NADH-quinone reductase, subunit |
| 0023 | 110 | cytoplasm | sigma-E factor regulatory protein (rseB) |
| 0025 | 195 | inner 1 | sigma-E factor negative regulatory protein (mclA) |
| 0026 | 157 | cytoplasm | RNA polymerase sigma-E factor (rpoE) |
| 0027 | 100 | cytoplasm | cell division protein (ftsQ) |
| 0028 | 37 | cytoplasm | cell division protein (ftsA) |
| 0029 | 34 | cytoplasm | cell division protein (ftsA) |
| 0030 | 268 | cytoplasm | aspartate--ammonia ligase (asnA) |
| 0039 | 311 | cytoplasm | ADP-heptose--LPS heptosyltransferase II (rfaF) |
| 0043 | 194 | inner 3 | sodium:dicarboxylate symporter protein |
| 0044 | 79 | cytoplasm | ferritin (rsgA) |
| 0047 | 219 | cytoplasm | heat shock protein (hslU)/ATP-dependent Clp protease, ATP-binding subunit |
| 0048 | 55 | inner 2 | L-lactate permease (lctP) |
| 0049 | 90 | periplasmic | transferrin-binding protein or TonB-dependent receptor |
| 0055 | 92 | cytoplasm | heat shock protein (hslV) |
| 0057 | 235 | periplasmic | acid phosphatase |

TABLE III-continued

Annotations

| NTH | aa | PSORT | Annotation |
|---|---|---|---|
| 0058 | 206 | cytoplasm | rod shape-determining protein (mreB) or cell division protein FtsA ftsA |
| 0059 | 54 | periplasmic | rod shape-determining protein (mreC) |
| 0060 | 104 | inner 0 | ribosomal protein S8 (rpS8) |
| 0061 | 313 | inner 2 | ribosomal protein L6 (rpL6) |
| 0063 | 257 | cytoplasm | fumarate (and nitrate) reduction regulatory protein (fnr) |
| 0065 | 266 | cytoplasm | thiamin ABC transporter, periplasmic-binding protein (tbpA) |
| 0067 | 86 | inner 1 | thiamin ABC transporter, permease protein |
| 0068 | 52 | cytoplasm | UDP-N-acetylenolpyruvoylglucosamine reductase (murB) |
| 0069 | 149 | cytoplasm | RNA polymerase sigma-32 factor (rpoH) |
| 0070 | 127 | cytoplasm | RNA polymerase sigma-32 factor (rpoH) |
| 0071 | 64 | cytoplasm | NifR3/SMM1 family protein |
| 0072 | 201 | cytoplasm | acetolactate synthase III large subunit (ilvI) |
| 0073 | 142 | inner 1 | acetolactate synthase III large subunit (ilvI) |
| 0075 | 166 | cytoplasm | acetolactate synthase III small subunit (ilvH) |
| 0078 | 119 | cytoplasm | orotate phosphoribosyltransferase (pyrE) |
| 0079 | 36 | cytoplasm | orotate phosphoribosyltransferase (pyrE) |
| 0082 | 144 | cytoplasm | DNA polymerase III, chi subunit (holC) |
| 0083 | 85 | cytoplasm | methylglyoxal synthase (mgsA) |
| 0085 | 340 | inner 7 | cytochrome C-type biogenesis protein (ccmF) |
| 0086 | 45 | cytoplasm | cytochrome C-type biogenesis protein (ccmE) |
| 0087 | 312 | cytoplasm | histidyl-tRNA synthetase (hisS) |
| 0088 | 214 | cytoplasm | topoisomerase IV, subunit A (parC) |
| 0091 | 212 | inner 1 | 4-hydroxy-2-oxoglutarate |
| 0094 | 338 | lipo | zinc protease |
| 0098 | 358 | cytoplasm | homoserine O-acetyltransferase (met2) |
| 0099 | 60 | cytoplasm | DNA gyrase, subunit A (gyrA) |
| 0100 | 56 | cytoplasm | DNA gyrase, subunit A (gyrA) |
| 0102 | 102 | cytoplasm | universal stress protein A (uspA) |
| 0103 | 290 | cytoplasm | alanyl-tRNA synthetase (alaS) |
| 0104 | 81 | cytoplasm | alanyl-tRNA synthetase (alaS) |
| 0105 | 557 | cytoplasm | protective surface antigen D15 (Omp85) |
| 0106 | 110 | periplasmic | outer membrane protein |
| 0107 | 257 | inner 1 | cell division protein (ftsZ) |
| 0108 | 352 | cytoplasm | cell division protein (ftsA) |
| 0109 | 496 | cytoplasm | DNA topoisomerase I (topA) |
| 0112 | 259 | cytoplasm | penicillin-binding protein 1B (ponB) |
| 0113 | 35 | cytoplasm | penicillin-binding protein 1B (ponB) |
| 0115 | 279 | cytoplasm | penicillin-binding protein 1A (ponA) |
| 0116 | 310 | inner 1 | GTP-binding protein |
| 0117 | 243 | cytoplasm | phosphomannomutase (yhxB) |
| 0118 | 84 | inner 0 | phosphomannomutase (yhxB) |
| 0119 | 89 | periplasmic | tonB protein |
| 0120 | 147 | periplasmic | biopolymer transport protein (exbD) |
| 0121 | 49 | inner 1 | biopolymer transport protein (exbB) |
| 0126 | 77 | cytoplasm | integrase/recombinase |
| 0128 | 111 | inner 1 | xanthine-guanine phosphoribosyltransferase (gptB) |
| 0130 | 184 | cytoplasm | aminoacyl-histidine dipeptidase (pepD) |
| 0131 | 35 | cytoplasm | aminoacyl-histidine dipeptidase (pepD) |
| 0134 | 182 | inner 1 | phosphoribosylglycinamide formyltransferase (purN) |
| 0137 | 58 | cytoplasm | GTP-binding membrane protein (lepA) |
| 0141 | 78 | cytoplasm | uracil DNA glycosylase (ung) |
| 0142 | 76 | cytoplasm | aldose 1-epimerase (galM) |
| 0143 | 129 | cytoplasm | galactokinase (galK) |
| 0144 | 197 | cytoplasm | galactokinase (galK) |
| 0145 | 346 | cytoplasm | GTP-binding protein TypA |
| 0147 | 179 | cytoplasm | queuine tRNA-ribosyltransferase (tgt) |
| 0150 | 239 | cytoplasm | ribosomal large subunit pseudouridine synthase C |
| 0152 | 463 | cytoplasm | galactoside ABC transporter, ATP-binding protein (mglA) |
| 0153 | 247 | cytoplasm | hemagglutinin/hemolysin-related protein |
| 0154 | 240 | cytoplasm | hemagglutinin/hemolysin-related protein |
| 0155 | 302 | inner 7 | phosphate permease |
| 0157 | 124 | inner 2 | cytochrome D ubiquinol oxidase, subunit I (cydA) or iron(III) ABC transporter, permease protein fbpB |
| 0158 | 103 | inner 2 | cytochrome D ubiquinol oxidase, subunit II (cydB) |
| 0163 | 154 | lipo | 15 kDa peptidoglycan-associated lipoprotein (lpp) |
| 0165 | 165 | cytoplasm | membrane-bound lytic murein transglycosylase C (mltC) |
| 0167 | 194 | lipo | membrane-bound lytic murein transglycosylase C (mltC) |
| 0170 | 51 | cytoplasm | hflK protein (hflK) |
| 0174 | 40 | periplasmic | tail specific protease (prc) |
| 0178 | 116 | cytoplasm | recombination protein (rec2) or competence protein ComA comA |
| 0180 | 147 | inner 2 | ABC transporter, ATP-binding protein (msbA) |
| 0185 | 220 | inner 0 | chorismate synthase (aroC) |
| 0186 | 156 | inner 2 | ATP-binding transport protein (cydD) |
| 0189 | 162 | inner 2 | rod shape-determining protein (mreD) |
| 0190 | 188 | periplasmic | rod shape-determining protein (mreC) |

TABLE III-continued

Annotations

| NTH | aa | PSORT | Annotation |
|---|---|---|---|
| 0196 | 68 | cytoplasm | sigma factor |
| 0200 | 68 | cytoplasm | mercuric ion scavenger protein (merP) |
| 0201 | 68 | cytoplasm | mercuric ion scavenger protein (merP) |
| 0202 | 68 | cytoplasm | mercuric ion scavenger protein (merP) |
| 0203 | 63 | inner 0 | orfJ protein |
| 0204 | 306 | cytoplasm | penicillin-binding protein 1A (ponA) |
| 0205 | 38 | cytoplasm | penicillin-binding protein 1A (ponA) |
| 0207 | 175 | cytoplasm | extragenic suppressor (suhB) |
| 0208 | 64 | inner 1 | cytochrome C-type biogenesis |
| 0209 | 117 | inner 2 | 1,4-dihydroxy-2-naphthoate octaprenyltransferase (menA) |
| 0212 | 203 | cytoplasm | lysyl-tRNA synthetase analog (genX) |
| 0215 | 204 | cytoplasm | fumarate reductase, flavoprotein subunit (frdA) or succinate dehydrogenase, flavoprotein subunit sdhA |
| 0216 | 48 | cytoplasm | fumarate reductase, flavoprotein subunit (frdA) |
| 0217 | 40 | cytoplasm | fumarate reductase, flavoprotein subunit (frdA) |
| 0218 | 310 | cytoplasm | nitrogen fixation protein (nifR3) |
| 0220 | 99 | cytoplasm | Hin recombinational enhancer binding protein (fis) or factor-for-inversion stimulation protein Fis, |
| 0221 | 48 | cytoplasm | small protein B (smpB) |
| 0222 | 222 | cytoplasm | magnesium and cobalt transport protein (corA) |
| 0223 | 91 | inner 1 | magnesium and cobalt transport protein (corA) |
| 0225 | 426 | cytoplasm | exoribonuclease II (rnb) or ribonuclease II family protein vacB |
| 0233 | 114 | cytoplasm | uridylate kinase (pyrH) |
| 0234 | 41 | cytoplasm | uridylate kinase (pyrH) |
| 0236 | 35 | cytoplasm | phospho-2-dehydro-3-deoxyheptonate aldolase (phenylalanine |
| 0239 | 322 | cytoplasm | heat shock (chaperone) protein (hscA) |
| 0240 | 44 | cytoplasm | heat shock (chaperone) protein (hscA) |
| 0241 | 193 | outer | usg-1 protein (usg1) |
| 0242 | 268 | inner 2 | tryptophan synthase alpha subunit (trpA) |
| 0243 | 58 | cytoplasm | tryptophan synthase beta subunit (trpB) |
| 0244 | 245 | periplasmic | stationary phase survival protein SurA or peptidyl-prolyl cis-trans isomerase |
| 0245 | 191 | cytoplasm | pyrimidine operon regulatory protein (pyrR) or hypoxanthine-guanine phosphoribosyltransferase, |
| 0246 | 153 | cytoplasm | mazG protein (mazG) |
| 0247 | 159 | inner 3 | ATP synthase F0, subunit a (atpB) |
| 0249 | 203 | cytoplasm | glucose-inhibited division protein (gidB) |
| 0257 | 289 | cytoplasm | selenocysteine-specific elongation factor (selB) |
| 0258 | 212 | cytoplasm | pyruvate dehydrogenase, E1 component (aceE) |
| 0259 | 61 | cytoplasm | pyruvate dehydrogenase, E1 component (aceE) |
| 0260 | 505 | cytoplasm | ribonuclease E (rne) |
| 0262 | 303 | cytoplasm | ATP-dependent helicase (dinG) |
| 0263 | 276 | inner 7 | thiamin ABC transporter, permease protein |
| 0266 | 121 | cytoplasm | N utilization substance protein B (nusB) |
| 0267 | 160 | cytoplasm | thiamin-monophosphate kinase (thiL) |
| 0268 | 144 | cytoplasm | thiamin-monophosphate kinase (thiL) |
| 0269 | 163 | inner 3 | phosphatidylglycerophosphatase A (pgpA) |
| 0272 | 44 | cytoplasm | ribosomal protein L34 (rpL34) |
| 0273 | 119 | cytoplasm | ribonuclease P (rnpA) |
| 0275 | 146 | cytoplasm | impA protein |
| 0277 | 218 | cytoplasm | phospho-2-dehydro-3-deoxyheptonate aldolase (phenylalanine |
| 0286 | 288 | cytoplasm | GTP-binding protein |
| 0287 | 422 | cytoplasm | formate dehydrogenase, beta subunit (fdxH) or ferredoxin, 4Fe—4S bacterial type |
| 0291 | 109 | cytoplasm | mannonate dehydratase (uxuA) |
| 0292 | 46 | cytoplasm | mannonate dehydratase (uxuA) |
| 0294 | 171 | cytoplasm | dihydroxyacid dehydratase (ilvD) |
| 0295 | 308 | inner 1 | threonine deaminase (ilvA) |
| 0296 | 239 | cytoplasm | galactose-1-phosphate uridylyltransferase (galT) |
| 0303 | 283 | cytoplasm | hemoglobin-binding protein |
| 0304 | 68 | cytoplasm | ribosomal protein L24 (rpL24) |
| 0305 | 123 | cytoplasm | ribosomal protein L14 (rpL14) |
| 0309 | 82 | cytoplasm | inorganic pyrophosphatase (ppa) |
| 0311 | 185 | inner 4 | phosphatidylglycerophosphate synthase (pgsA) or CDP-diacylglycerol--glycerol-3-phosphate |
| 0314 | 274 | cytoplasm | dihydrolipoamide dehydrogenase (lpdA) or pyruvate dehydrogenase, E3 component, lipoamide |
| 0315 | 38 | cytoplasm | dihydrolipoamide dehydrogenase (lpdA) |
| 0318 | 358 | cytoplasm | DNA topoisomerase III (topB) or DNA topoisomerase I topA |
| 0320 | 411 | inner 1 | Nqr6 subunit of Na-translocating NADH-quinone reductase |
| 0321 | 191 | inner 1 | single-stranded DNA binding protein (ssb) |
| 0323 | 141 | cytoplasm | excinuclease ABC, subunit A (uvrA) |
| 0324 | 319 | cytoplasm | type IV pilus assembly protein pilF |
| 0325 | 200 | inner 1 | pilus assembly protein PilG pilG |
| 0326 | 386 | inner 8 | branched chain amino acid transport system II carrier |
| 0329 | 395 | cytoplasm | cystathionine beta-lyase (metC) or trans-sulfuration enzyme family protein |

TABLE III-continued

Annotations

| NTH | aa | PSORT | Annotation |
|---|---|---|---|
| 0330 | 109 | cytoplasm | sanA protein (sanA) |
| 0333 | 96 | inner 1 | folylpolyglutamate synthase/dihydrofolate synthase (folC) |
| 0336 | 133 | cytoplasm | short chain dehydrogenase/reductase or oxidoreductase, short-chain dehydrogenase/reductase |
| 0337 | 391 | cytoplasm | tryptophan synthase beta subunit (trpB) |
| 0340 | 151 | cytoplasm | cell division protein (ftsH) |
| 0342 | 147 | cytoplasm | peptide methionine sulfoxide reductase pilB |
| 0346 | 46 | periplasmic | small protein A |
| 0347 | 273 | inner 7 | transport protein |
| 0349 | 66 | cytoplasm | protease |
| 0351 | 412 | inner 1 | penicillin-binding protein 1B (ponB) |
| 0352 | 291 | inner 5 | carbon starvation protein A cstA |
| 0354 | 227 | cytoplasm | GTP pyrophosphokinase (relA) |
| 0355 | 367 | cytoplasm | GTP pyrophosphokinase (relA) |
| 0356 | 65 | inner 1 | diacylglycerol kinase (dgkA) |
| 0358 | 56 | inner 1 | diacylglycerol kinase (dgkA) |
| 0359 | 275 | cytoplasm | esterase |
| 0360 | 216 | cytoplasm | UDP-3-O-(3-hydroxymyristoyl)-glucosamine N-acyltransferase |
| 0361 | 141 | cytoplasm | translation elongation factor Ts (tsf) (EF-TS) |
| 0365 | 91 | cytoplasm | exodeoxyribonuclease III (xthA) |
| 0366 | 432 | inner 1 | heme-hemopexin utilization protein A (hxuA) |
| 0367 | 184 | cytoplasm | carboxy-terminal tail specific protease (prc) |
| 0368 | 204 | cytoplasm | carboxy-terminal tail specific protease (prc) |
| 0369 | 163 | cytoplasm | dihydroxyacid dehydratase (ilvD) |
| 0370 | 201 | cytoplasm | acetohydroxy acid synthase II or acetolactate synthase III, large subunit ilvI |
| 0372 | 306 | inner 7 | sodium-dependent transporter or sodium- and chloride-dependent transporter |
| 0373 | 42 | cytoplasm | aminotransferase |
| 0374 | 307 | cytoplasm | aminotransferase |
| 0376 | 128 | cytoplasm | ribosomal protein L17 (rplQ) |
| 0377 | 193 | cytoplasm | DNA-directed RNA polymerase, alpha chain (rpoA) |
| 0380 | 33 | cytoplasm | acylneuraminate cytidylyltransferase (neuA) |
| 0382 | 359 | cytoplasm | peptidyl-prolyl cis-trans isomerse |
| 0386 | 111 | cytoplasm | DNA gyrase, subunit A (gyrA) |
| 0387 | 52 | cytoplasm | DNA gyrase, subunit A (gyrA) |
| 0388 | 242 | inner 3 | sodium/proline symporter (proline permease) (putP) |
| 0391 | 256 | cytoplasm | anaerobic ribonucleoside-triphosphate reductase (nrdD) |
| 0392 | 87 | cytoplasm | anaerobic ribonucleoside-triphosphate reductase (nrdD) |
| 0393 | 211 | cytoplasm | aminotransferase |
| 0394 | 117 | cytoplasm | aerobic respiration control protein ARCA (arcA) or DNA-binding response regulator |
| 0397 | 444 | inner 8 | thiol:disulfide interchange protein (dsbD) |
| 0399 | 362 | cytoplasm | GTP-binding membrane protein (lepA) |
| 0400 | 437 | inner 9 | sodium-dependent transporter |
| 0401 | 206 | inner 5 | nitrite reductase, transmembrane protein (nrfD) |
| 0402 | 138 | inner 3 | cytochrome C-type biogenesis protein or thiol:disulfide interchange protein DsbD dsbD |
| 0403 | 84 | cytoplasm | peptide methionine sulfoxide reductase (msrA) |
| 0405 | 299 | periplasmic | peptide methionine sulfoxide reductase (msrA) |
| 0418 | 297 | inner 3 | cytochrome D ubiquinol oxidase, subunit I (cydA) |
| 0421 | 287 | periplasmic | CTP synthetase (pyrG) |
| 0423 | 385 | cytoplasm | exodeoxyribonuclease VII, large subunit (xseA) |
| 0425 | 92 | cytoplasm | oligopeptide ABC transporter, ATP-binding protein (oppD) |
| 0426 | 311 | inner 6 | oligopeptide ABC transporter, permease protein (oppC) |
| 0427 | 232 | inner 6 | oligopeptide ABC transporter, permease protein (oppB) or iron(III) ABC transporter, permease protein |
| 0428 | 316 | cytoplasm | cysteine synthetase (cysK) |
| 0431 | 116 | cytoplasm | C-5 cytosine-specific DNA-methylase |
| 0436 | 341 | cytoplasm | peptide chain release factor 3 (prfC) |
| 0437 | 295 | inner 1 | enoyl-(acyl-carrier-protein) reductase (fabI) |
| 0441 | 66 | cytoplasm | L-2,4-diaminobutyrate decarboxylase |
| 0442 | 222 | cytoplasm | formamidopyrimidine-DNA glycosylase (fpg) |
| 0443 | 160 | cytoplasm | peptidase T (pepT) |
| 0444 | 178 | inner 0 | fuculokinase (fucK) |
| 0447 | 323 | cytoplasm | L-fucose isomerase (fucI) |
| 0448 | 119 | cytoplasm | L-fucose isomerase (fucI) |
| 0449 | 193 | cytoplasm | dethiobiotin synthase (bioD-1) |
| 0451 | 88 | cytoplasm | GTP cyclohydrolase I (folE) |
| 0453 | 113 | inner 1 | GTP cyclohydrolase I (folE) |
| 0454 | 78 | cytoplasm | GTP cyclohydrolase I (folE) |
| 0456 | 212 | cytoplasm | protein-PII uridylyl transferase (glnD) |
| 0457 | 288 | inner 9 | undecaprenyl-phosphate alpha-N-acetylglucosaminyltransferase or phospho-N-acetylmuramoyl-pentapeptide-transferase |
| 0458 | 293 | cytoplasm | penicillin tolerance protein (lytB) |
| 0459 | 57 | inner 1 | lipoprotein signal peptidase (lspA) |

TABLE III-continued

Annotations

| NTH | aa | PSORT | Annotation |
|---|---|---|---|
| 0460 | 122 | inner 1 | lipoprotein signal peptidase (lspA) |
| 0461 | 433 | inner 2 | YhbX/YhjW/YijP/YjdB family protein |
| 0462 | 107 | inner 2 | transporter protein |
| 0463 | 159 | inner 3 | transporter protein |
| 0464 | 349 | cytoplasm | 2',3'-cyclic-nucleotide 2'-phosphodiesterase (cpdB) |
| 0465 | 73 | inner 1 | iron (chelated) ABC transporter, permease protein (yfeD) |
| 0467 | 215 | cytoplasm | transcriptional activator |
| 0468 | 314 | periplasmic | thiamine biosynthesis protein |
| 0469 | 76 | inner 1 | ABC transporter, permease protein |
| 0470 | 328 | cytoplasm | alanyl-tRNA synthetase (alaS) |
| 0472 | 122 | cytoplasm | alanyl-tRNA synthetase (alaS) |
| 0473 | 89 | inner 0 | phosphatidylserine decarboxylase proenzyme (psd) |
| 0474 | 261 | cytoplasm | glutathione reductase (gor) or 2-oxoglutarate dehydrogenase, E3 component, |
| 0475 | 241 | inner 5 | phosphatidylglycerophosphatase B (pgpB) |
| 0476 | 119 | cytoplasm | GTP cyclohydrolase II (ribA) |
| 0477 | 153 | cytoplasm | DNA polymerase III, delta subunit (holA) |
| 0479 | 369 | cytoplasm | glycyl-tRNA synthetase, beta chain (glyS) |
| 0480 | 305 | cytoplasm | UDP-3-0-(3-hydroxymyristoyl) N-acetylglucosamine deacetylase |
| 0481 | 116 | cytoplasm | chorismate mutase/prephenate dehydratase (pheA) |
| 0483 | 271 | cytoplasm | urease accessory protein (ureH) |
| 0490 | 179 | inner 4 | glutamate permease (gltS) sodium/glutamate symporter |
| 0492 | 95 | cytoplasm | ribosomal protein S6 modification protein (rimK) or glutathione synthetase gshB |
| 0493 | 123 | inner 2 | Na+/H+ antiporter (nhaC) |
| 0494 | 326 | cytoplasm | xylose operon regulatory protein (xylR) |
| 0495 | 144 | cytoplasm | lipopolysaccharide biosynthesis protein or lacto-N-neotetraose biosynthesis glycosyl |
| 0496 | 257 | inner 1 | lipopolysaccharide biosynthesis protein |
| 0502 | 46 | outer | penicillin-binding protein 7 |
| 0503 | 138 | cytoplasm | transcription elongation factor (greA) |
| 0504 | 115 | outer | D-alanyl-D-alanine |
| 0505 | 370 | cytoplasm | D-alanyl-D-alanine or penicillin-binding protein 3 |
| 0506 | 38 | cytoplasm | IS1016 family transposase |
| 0507 | 158 | inner 1 | IS1016-V6 protein (IS1016-V6) |
| 0508 | 111 | cytoplasm | IS1016C2 transposase |
| 0514 | 296 | cytoplasm | aminopeptidase A/I (pepA) |
| 0515 | 113 | cytoplasm | stringent starvation protein B (sspB) |
| 0517 | 312 | cytoplasm | 1-deoxyxylulose-5-phosphate synthase (dxs) |
| 0518 | 150 | inner 0 | short chain dehydrogenase/reductase |
| 0519 | 348 | cytoplasm | phosphoribosylaminoimidazole synthetase (purM) |
| 0521 | 40 | cytoplasm | phosphoglycerate mutase (gpmA) |
| 0522 | 70 | cytoplasm | ribosomal protein L31 (rpL31) |
| 0524 | 158 | inner 0 | A/G-specific adenine glycosylase (mutY) |
| 0525 | 86 | cytoplasm | A/G-specific adenine glycosylase (mutY) |
| 0528 | 170 | inner 2 | formate dehydrogenase, gamma subunit (fdxI) |
| 0529 | 319 | inner 2 | fdhE protein (fdhE) |
| 0530 | 137 | cytoplasm | DNA transformation protein (sxy) |
| 0532 | 571 | cytoplasm | immunoglobin A1 protease (iga1) or hemagglutinin/hemolysin-related protein |
| 0535 | 289 | cytoplasm | threonyl-tRNA synthetase (thrS) |
| 0540 | 184 | cytoplasm | competence protein E (comE) |
| 0542 | 213 | cytoplasm | competence protein F (comF) |
| 0543 | 220 | cytoplasm | hflK protein (hflK) or stomatin/Mec-2 family protein |
| 0544 | 295 | inner 1 | hflC protein (hflC) or stomatin/Mec-2 family protein |
| 0547 | 74 | periplasmic | sodium/proline symporter (proline permease) (putP) |
| 0548 | 304 | cytoplasm | cytoplasmic axial filament protein (cafA) |
| 0549 | 108 | inner 1 | cytoplasmic axial filament protein (cafA) |
| 0550 | 93 | cytoplasm | cytoplasmic axial filament protein (cafA) |
| 0552 | 217 | cytoplasm | cell division protein (mukB) |
| 0554 | 248 | cytoplasm | killing protein suppressor (kicA) |
| 0557 | 245 | cytoplasm | fdhD protein (fdhD) |
| 0558 | 38 | cytoplasm | fdhD protein (fdhD) |
| 0560 | 30 | cytoplasm | phosphatidylserine decarboxylase proenzyme (psd) |
| 0563 | 56 | cytoplasm | ribosomal protein L32 (rpL32) |
| 0564 | 225 | cytoplasm | beta-ketoacyl-ACP synthase III (fabH) or 3-oxoacyl-(acyl-carrier-protein) synthase III fabH |
| 0565 | 368 | inner 7 | tryptophan-specific transport protein (mtr) |
| 0566 | 409 | inner 1 | L-serine deaminase (sdaA) |
| 0571 | 292 | cytoplasm | cytidine deaminase (cdd) |
| 0574 | 212 | inner 2 | lipoprotein |
| 0575 | 65 | cytoplasm | transcriptional regulator (bolA) |
| 0576 | 158 | cytoplasm | NADH:ubiquinone oxidoreductase subunit A, Na translocating or Na(+)-translocating NADH-quinone reductase, subunit |
| 0580 | 160 | inner 0 | translation initiation factor 2 (infB) |

TABLE III-continued

Annotations

| NTH | aa | PSORT | Annotation |
|---|---|---|---|
| 0591 | 200 | cytoplasm | beta-phosphoglucomutase pgmB |
| 0592 | 462 | cytoplasm | cell division protein (mukB) |
| 0594 | 393 | cytoplasm | traN-related protein |
| 0595 | 31 | cytoplasm | GTP cyclohydrolase II (ribA) |
| 0596 | 57 | cytoplasm | GTP cyclohydrolase II (ribA) |
| 0597 | 345 | cytoplasm | oligopeptide transporter, periplasmic-binding protein, |
| 0599 | 32 | cytoplasm | oligopeptide transporter, periplasmic-binding protein, |
| 0601 | 240 | cytoplasm | aminopeptidase P (pepP) |
| 0604 | 37 | cytoplasm | aldose 1-epimerase (galM) |
| 0605 | 195 | cytoplasm | aldose 1-epimerase (galM) |
| 0607 | 318 | cytoplasm | C-5 cytosine-specific DNA-methylase |
| 0608 | 104 | cytoplasm | killing protein (kicB) |
| 0609 | 144 | cytoplasm | DNA polymerase III, delta subunit (holA) |
| 0611 | 69 | cytoplasm | rare lipoprotein B |
| 0613 | 75 | cytoplasm | transcriptional regulator (nadR) |
| 0614 | 310 | cytoplasm | transcriptional regulator (nadR) |
| 0616 | 69 | cytoplasm | aerobic respiration control protein ARCA (arcA) |
| 0618 | 368 | inner 7 | sodium/alanine symporter |
| 0619 | 303 | periplasmic | elongation factor Tu (tufB) |
| 0622 | 218 | inner 4 | dedA protein |
| 0626 | 164 | inner 5 | lic-1 operon protein (licB) |
| 0627 | 321 | cytoplasm | lic-1 operon protein (licA) |
| 0628 | 235 | cytoplasm | UDP-N-acetylenolpyruvoylglucosamine reductase (murB) |
| 0629 | 179 | cytoplasm | nitrate/nitrite sensor protein (narQ) |
| 0630 | 151 | inner 1 | small major protein B (smpB) |
| 0632 | 53 | cytoplasm | 6-phosphofructokinase (pfkA) |
| 0633 | 290 | cytoplasm | 6-phosphofructokinase (pfkA) |
| 0635 | 355 | cytoplasm | type I modification enzyme (hsdM) |
| 0636 | 158 | inner 2 | cysteine synthetase (cysZ) |
| 0638 | 328 | outer | cell division protein ZipA |
| 0640 | 122 | cytoplasm | ribosomal protein S12 (rps12) |
| 0641 | 346 | cytoplasm | glucose inhibited division protein (gidA) |
| 0646 | 257 | inner 5 | Na+/H+ antiporter (nhaC) |
| 0647 | 37 | outer | Na+/H+ antiporter (nhaC) |
| 0648 | 362 | outer | colicin tolerance protein (tolB) |
| 0650 | 497 | cytoplasm | cell division protein (mukB) |
| 0651 | 391 | cytoplasm | heme-binding lipoprotein (dppA) |
| 0652 | 78 | cytoplasm | octaprenyl-diphosphate synthase (ispB) |
| 0654 | 103 | inner 1 | ribosomal protein L21 (rpL21) |
| 0655 | 85 | cytoplasm | ribosomal protein L27 (rpL27) |
| 0657 | 83 | cytoplasm | GTP-binding protein (yhbZ) |
| 0658 | 75 | inner 1 | lipopolysaccharide biosynthesis protein |
| 0659 | 55 | cytoplasm | lipopolysaccharide biosynthesis protein |
| 0660 | 255 | cytoplasm | molybdenum transport protein (modE) |
| 0661 | 34 | periplasmic | molybdenum ABC transporter, periplasmic-binding protein |
| 0665 | 144 | cytoplasm | single-stranded DNA binding protein (ssb) |
| 0670 | 366 | cytoplasm | histidinol-phosphate aminotransferase (hisH) |
| 0671 | 31 | cytoplasm | phosphoserine aminotransferase (serC) |
| 0672 | 31 | cytoplasm | phosphoserine aminotransferase (serC) |
| 0674 | 140 | cytoplasm | ribosomal protein L3 (rpL3) |
| 0675 | 200 | inner 1 | ribosomal protein L4 (rpL4) |
| 0676 | 139 | inner 1 | ribosomal protein L23 (rpL23) |
| 0679 | 51 | cytoplasm | ampD signalling protein (ampD) |
| 0682 | 96 | cytoplasm | hemolysin |
| 0684 | 208 | cytoplasm | spermidine/putrescine ABC transporter, ATP-binding protein |
| 0685 | 52 | cytoplasm | lysyl-tRNA synthetase analog (genX) |
| 0686 | 227 | cytoplasm | DNA-binding response regulator (cpxR) |
| 0688 | 256 | cytoplasm | aminoacyl-histidine dipeptidase (pepD) |
| 0689 | 185 | cytoplasm | integrase/recombinase (xerC) |
| 0698 | 399 | cytoplasm | nifS protein |
| 0699 | 51 | cytoplasm | nuclease |
| 0701 | 153 | cytoplasm | DnaA-related protein |
| 0702 | 279 | inner 7 | uracil permease (uraA) |
| 0703 | 129 | inner 3 | uracil permease (uraA) |
| 0704 | 135 | cytoplasm | uracil phosphoribosyltransferase (upp) |
| 0705 | 341 | cytoplasm | glutaminyl-tRNA synthetase (glnS) |
| 0708 | 78 | cytoplasm | cytoplasmic axial filament protein (cafA) |
| 0709 | 258 | inner 5 | anaerobic C4-dicarboxylate membrane transporter protein |
| 0710 | 43 | inner 1 | anaerobic C4-dicarboxylate membrane transporter protein |
| 0714 | 169 | cytoplasm | protein-export protein (secB) |
| 0718 | 175 | inner 1 | glucose inhibited division protein (gidA) |
| 0719 | 224 | cytoplasm | threonyl-tRNA synthetase (thrS) |
| 0720 | 194 | cytoplasm | acyl carrier protein phosphodiesterase (acpD) |
| 0723 | 146 | cytoplasm | DNA topoisomerase I (topA) |
| 0732 | 200 | cytoplasm | recombination protein RecR (recR) |

TABLE III-continued

Annotations

| NTH | aa | PSORT | Annotation |
|---|---|---|---|
| 0733 | 202 | cytoplasm | DNA topoisomerase III (topB) |
| 0734 | 322 | cytoplasm | S-adenosylmethionine synthetase (metX) |
| 0735 | 193 | cytoplasm | anthranilate synthase component II (trpG) or para-aminobenzoate synthase glutamine |
| 0736 | 210 | cytoplasm | para-aminobenzoate synthetase component |
| 0737 | 118 | cytoplasm | folylpolyglutamate synthase/dihydrofolate synthase (folC) |
| 0738 | 184 | periplasmic | acetyl-CoA carboxylase, carboxyl transferase subunit beta |
| 0739 | 93 | cytoplasm | acetyl-CoA carboxylase, carboxyl transferase subunit beta |
| 0740 | 177 | inner 1 | periplasmic serine protease |
| 0741 | 321 | cytoplasm | periplasmic serine protease |
| 0743 | 269 | cytoplasm | tRNA pseudouridylate synthase I (truA) |
| 0745 | 235 | inner 2 | peptide ABC transporter, ATP-binding protein (sapF) |
| 0747 | 37 | cytoplasm | peptide ABC transporter, ATP-binding protein (sapF) |
| 0748 | 44 | cytoplasm | peptide ABC transporter, ATP-binding protein (sapD) |
| 0751 | 86 | cytoplasm | pseudouridine synthase RluD (rluD) |
| 0753 | 198 | cytoplasm | tRNA (guanine-N1)-methyltransferase (trmD) |
| 0754 | 116 | cytoplasm | ribosomal protein L19 (rpL19) |
| 0758 | 235 | cytoplasm | ribosomal protein S3 (rpS3) |
| 0759 | 110 | cytoplasm | ribosomal protein L22 (rpL22) |
| 0760 | 91 | cytoplasm | ribosomal protein S19 (rpS19) |
| 0761 | 180 | cytoplasm | ribosomal protein L2 (rpL2) |
| 0762 | 221 | inner 5 | protein-export membrane protein (secD) |
| 0764 | 406 | inner 1 | protein-export membrane protein (secD) |
| 0765 | 97 | inner 1 | preprotein translocase, YajC subunit (yajC) |
| 0769 | 37 | cytoplasm | queuine tRNA-ribosyltransferase (tgt) |
| 0770 | 371 | cytoplasm | tRNA |
| 0772 | 55 | cytoplasm | thiamine biosynthesis lipoprotein ApbE lipoprotein |
| 0773 | 35 | cytoplasm | lipoprotein |
| 0774 | 299 | inner 1 | thiamine biosynthesis lipoprotein ApbE lipoprotein |
| 0777 | 63 | cytoplasm | ribosomal protein L29 (rpL29) |
| 0778 | 74 | cytoplasm | ribosomal protein L16 (rpL16) |
| 0779 | 335 | cytoplasm | dihydrolipoamide acetyltransferase (aceF) or pyruvate dehydrogenase, E2 component, |
| 0781 | 35 | cytoplasm | dihydrolipoamide acetyltransferase (aceF) |
| 0782 | 549 | cytoplasm | pyruvate dehydrogenase, E1 component (aceE) |
| 0787 | 297 | cytoplasm | glycine cleavage system transcriptional activator (gcvA) or transcriptional regulator, LysR family |
| 0788 | 159 | outer-hand | penicillin-binding protein 1A (ponA) |
| 0790 | 164 | cytoplasm | competence protein A (comA) |
| 0794 | 168 | inner 1 | competence protein B (comB) |
| 0795 | 134 | inner 1 | competence protein C (comC) |
| 0796 | 172 | inner 1 | competence protein D (comD) |
| 0798 | 166 | inner 1 | competence protein E (comE) |
| 0801 | 583 | cytoplasm | arginyl-tRNA synthetase (argS) |
| 0802 | 100 | inner 1 | glutaredoxin (grx) |
| 0803 | 406 | inner 0 | beta-ketoacyl-ACP synthase I (fabB) |
| 0804 | 137 | inner 1 | monofunctional biosynthetic peptidoglycan transglycosylase |
| 0805 | 101 | cytoplasm | trp operon repressor (trpR) |
| 0806 | 305 | cytoplasm | soluble lytic murein transglycosylase |
| 0807 | 267 | cytoplasm | 2-hydroxyacid (glycerate) dehydrogenase |
| 0808 | 30 | cytoplasm | 2-dehydro-3-deoxyphosphooctonate aldolase (kdsA) |
| 0810 | 249 | cytoplasm | 2-dehydro-3-deoxyphosphooctonate aldolase (kdsA) |
| 0812 | 84 | cytoplasm | hemK protein (hemK) |
| 0813 | 202 | inner 1 | hemK protein (hemK) |
| 0817 | 411 | cytoplasm | hydrolase |
| 0821 | 240 | inner 1 | transcriptional regulatory protein (ygiX) |
| 0822 | 154 | inner 1 | sensor protein (ygiY) |
| 0823 | 66 | inner 1 | sensor protein (ygiY) |
| 0824 | 316 | cytoplasm | glutamyl-tRNA synthetase (gltX) |
| 0825 | 80 | cytoplasm | glutamyl-tRNA synthetase (gltX) |
| 0826 | 79 | cytoplasm | glutamyl-tRNA synthetase (gltX) |
| 0828 | 45 | cytoplasm | ribonuclease PH (rph) |
| 0829 | 278 | inner 1 | amidophosphoribosyltransferase (purF) |
| 0830 | 484 | cytoplasm | DNA gyrase, subunit A (gyrA) |
| 0831 | 54 | cytoplasm | DNA gyrase, subunit A (gyrA) |
| 0833 | 583 | cytoplasm | hemin receptor (hemR) or iron-regulated outer membrane protein FrpB frpB |
| 0834 | 143 | inner 2 | colicin transport protein (tolQ) or biopolymer transport protein ExbB exbB |
| 0835 | 139 | periplasmic | colicin transport protein (tolR) or biopolymer transport protein ExbD exbD |
| 0836 | 337 | inner 1 | outer membrane integrity protein (tolA) or IgA-specific serine endopeptidase iga |
| 0840 | 76 | cytoplasm | ABC transporter, ATP-binding protein |
| 0842 | 31 | cytoplasm | type I restriction enzyme (hsdR) |
| 0844 | 53 | cytoplasm | modification methylase |
| 0845 | 184 | cytoplasm | ADP-heptose synthase (rfaE) or aut protein aut |
| 0847 | 389 | cytoplasm | argininosuccinate lyase (argH) |

TABLE III-continued

Annotations

| NTH | aa | PSORT | Annotation |
|---|---|---|---|
| 0848 | 295 | periplasmic | glucosephosphate uridylyltransferase (galU) or UTP--glucose-1-phosphate uridylyltransferase galU |
| 0849 | 63 | periplasmic | carbon storage regulator (csrA) |
| 0850 | 461 | inner 4 | ATP-binding protein protein (cydD) |
| 0851 | 94 | inner 2 | ATP-binding protein protein (cydD) |
| 0852 | 160 | inner 1 | NAD(P)H oxidoreductase |
| 0856 | 133 | periplasmic | protease IV (sppA) |
| 0857 | 152 | cytoplasm | molybdenum ABC transporter, periplasmic-binding protein |
| 0858 | 242 | inner 5 | molybdenum ABC transporter, permease protein (modB) or sulfate ABC transporter, permease protein cysT |
| 0859 | 40 | cytoplasm | molybdenum ABC transporter, ATP-binding protein (modC) |
| 0860 | 245 | cytoplasm | molybdenum ABC transporter, ATP-binding protein (modC) or sulfate ABC transporter, ATP-binding protein cysA |
| 0868 | 119 | cytoplasm | type I restriction/modification specificity protein (hsdS) |
| 0869 | 90 | cytoplasm | anthranilate synthase component I trpE |
| 0873 | 145 | cytoplasm | phosphoserine aminotransferase (serC) |
| 0874 | 234 | inner 2 | succinyl-CoA synthetase, beta subunit (sucC) |
| 0875 | 293 | inner 1 | succinyl-CoA synthetase, alpha subunit (sucD) |
| 0882 | 93 | cytoplasm | mazG protein (mazG) |
| 0887 | 285 | inner 1 | 3-oxoacyl-(acyl-carrier-protein) reductase fabG-2 |
| 0890 | 153 | cytoplasm | DNA polymerase III, delta' subunit (holB) |
| 0892 | 41 | cytoplasm | thiol:disulfide interchange protein (dsbD) |
| 0893 | 60 | cytoplasm | thiol:disulfide interchange protein (dsbD) |
| 0897 | 234 | cytoplasm | phosphoribosylaminoimidazolecarboxamide formyltransferase |
| 0898 | 552 | cytoplasm | ATP-dependent RNA helicase DeaD (deaD) |
| 0900 | 64 | cytoplasm | type I restriction/modification specificity protein (hsdS) |
| 0903 | 248 | cytoplasm | type I restriction enzyme (hsdR) |
| 0905 | 106 | cytoplasm | 2-isopropylmalate synthase (leuA) |
| 0907 | 373 | cytoplasm | DNA processing chain A (dprA) |
| 0910 | 106 | periplasmic | nitrite reductase, Fe—S protein (nrfC) |
| 0912 | 98 | cytoplasm | nitrite reductase, cytochrome C-type protein (nrfB) |
| 0913 | 277 | inner 1 | cell division protein FtsK-related protein |
| 0914 | 205 | outer | outer membrane lipoproteins carrier protein (lolA) |
| 0918 | 286 | cytoplasm | glycogen phosphorylase (glgP) |
| 0919 | 323 | cytoplasm | glycogen phosphorylase (glgP) |
| 0920 | 117 | cytoplasm | glycogen phosphorylase (glgP) |
| 0923 | 253 | cytoplasm | glycogen synthase (glgA) |
| 0925 | 105 | cytoplasm | phosphoglycerate mutase (gpmA) |
| 0934 | 242 | cytoplasm | 3-ketoacyl-acyl carrier protein reductase (fabG) |
| 0935 | 48 | cytoplasm | malonyl CoA-acyl carrier protein transacylase (fabD) |
| 0936 | 222 | cytoplasm | malonyl CoA-acyl carrier protein transacylase (fabD) |
| 0939 | 111 | cytoplasm | 3-oxoacyl-(acyl-carrier-protein) synthase III fabH |
| 0945 | 125 | cytoplasm | molybdopterin biosynthesis protein (moeB) or thiF protein thiF |
| 0946 | 404 | cytoplasm | molybdopterin biosynthesis protein (moeA) |
| 0947 | 55 | cytoplasm | GTP cyclohydrolase I (folE) |
| 0950 | 353 | inner 2 | protease (sohB) |
| 0954 | 274 | cytoplasm | recombination associated protein RdgC rdgC |
| 0956 | 354 | cytoplasm | adenosylmethionine-8-amino-7-oxononanoate aminotransferase |
| 0958 | 379 | cytoplasm | 8-amino-7-oxononanoate synthase (bioF) |
| 0960 | 80 | cytoplasm | ABC transporter, ATP-binding protein |
| 0962 | 66 | cytoplasm | ABC transporter, ATP-binding protein |
| 0963 | 317 | cytoplasm | ABC transporter, ATP-binding protein (msbA) |
| 0965 | 313 | cytoplasm | tetraacyldisaccharide 4'-kinase lpxK |
| 0966 | 254 | cytoplasm | 3-deoxy-D-manno-octulosonate cytidylyltransferase (kdsB) |
| 0967 | 77 | cytoplasm | excinuclease ABC, subunit C (uvrC) |
| 0969 | 204 | cytoplasm | ABC transporter, ATP-binding protein |
| 0974 | 90 | cytoplasm | dethiobiotin synthase (bioD-2) |
| 0976 | 223 | cytoplasm | biotin synthesis protein BioC |
| 0977 | 549 | cytoplasm | long chain fatty acid coA ligase |
| 0983 | 574 | cytoplasm | phosphoenolpyruvate carboxylase (ppc) |
| 0984 | 303 | cytoplasm | gcpE protein (gcpE) |
| 0988 | 226 | cytoplasm | rbs repressor (rbsR) |
| 0989 | 322 | inner 1 | ribokinase (rbsK) or ADP-heptose synthase |
| 0990 | 156 | cytoplasm | D-ribose ABC transporter, periplasmic-binding protein (rbsB) |
| 0992 | 223 | cytoplasm | baseplate assembly protein V |
| 0994 | 52 | inner 0 | adhesin/invasin |
| 0997 | 454 | lipo | multidrug efflux pump channel protein mtrE |
| 1001 | 273 | cytoplasm | transcription termination factor (rho) |
| 1002 | 230 | inner 5 | type 4 prepilin-like protein specific leader peptidase |
| 1003 | 143 | inner 1 | pilus assembly protein PilG pilG |
| 1007 | 39 | cytoplasm | glycerol-3-phosphate regulon repressor (glpR) |
| 1008 | 306 | cytoplasm | fructose-1,6-bisphosphatase (fbp) |
| 1012 | 233 | inner 8 | hydroxyacylglutathione hydrolase |
| 1014 | 182 | cytoplasm | tellurite resistance protein (tehB) |
| 1015 | 541 | periplasmic | oligopeptide ABC transporter, periplasmic-binding protein |

TABLE III-continued

Annotations

| NTH | aa | PSORT | Annotation |
|---|---|---|---|
| 1018 | 45 | periplasmic | oligopeptide ABC transporter, permease protein (oppB) |
| 1019 | 256 | cytoplasm | methylenetetrahydrofolate |
| 1021 | 428 | inner 0 | L-fucose permease (fucP) or glucose/galactose transporter gluP |
| 1022 | 216 | cytoplasm | L-fuculose phosphate aldolase (fucA) |
| 1023 | 144 | cytoplasm | fucose operon protein (fucU) |
| 1024 | 30 | cytoplasm | fuculokinase (fucK) |
| 1030 | 492 | cytoplasm | anaerobic glycerol-3-phosphate dehydrogenase, subunit A |
| 1031 | 320 | inner 1 | anaerobic glycerol-3-phosphate dehydrogenase, subunit B |
| 1032 | 242 | inner 5 | transporter |
| 1033 | 116 | cytoplasm | arsenate reductase |
| 1041 | 70 | cytoplasm | hypoxanthine phosphoribosyltransferase (hpt) |
| 1043 | 460 | inner 9 | proton glutamate symport protein or sodium/dicarboxylate symporter family protein |
| 1045 | 155 | cytoplasm | anaerobic ribonucleoside-triphosphate reductase activating |
| 1046 | 242 | cytoplasm | transport ATP-binding protein (cydC) ABC transporter |
| 1048 | 212 | inner 4 | transport ATP-binding protein (cydC) |
| 1050 | 359 | cytoplasm | fructose-bisphosphate aldolase (fba) |
| 1051 | 346 | cytoplasm | ADP-heptose-LPS heptosyltransferase II rfaF |
| 1053 | 56 | cytoplasm | peptidyl-prolyl cis-trans isomerse |
| 1054 | 201 | outer | peptidyl-prolyl cis-trans isomerse |
| 1057 | 452 | cytoplasm | thiophene and furan oxidation protein (thdF) |
| 1058 | 224 | inner 2 | inner membrane protein, 60 kDa (yidC) |
| 1059 | 58 | cytoplasm | ribosomal protein S18 (rpS18) |
| 1060 | 149 | cytoplasm | ribosomal protein L9 (rpL9) |
| 1061 | 577 | cytoplasm | heat shock protein (groEL) |
| 1062 | 102 | cytoplasm | chaperonin (groES) |
| 1063 | 190 | inner 4 | urease, gamma subunit (ureA) |
| 1064 | 216 | inner 5 | rod shape-determining protein (rodA) or cell division protein FtsW ftsW |
| 1066 | 66 | cytoplasm | penicillin-binding protein 2 (pbp2) |
| 1068 | 66 | cytoplasm | cell division protein FtsK-related protein |
| 1071 | 447 | cytoplasm | protease IV (sppA) |
| 1074 | 286 | cytoplasm | lic-1 operon protein (licD) |
| 1075 | 213 | outer | aminopeptidase A/I (pepA) |
| 1077 | 141 | cytoplasm | nucleoside diphosphate kinase (ndk) |
| 1078 | 227 | cytoplasm | GTP-binding protein (yhbZ) |
| 1080 | 317 | inner 1 | phosphoribosylamine-glycine ligase (purD) |
| 1081 | 198 | cytoplasm | phosphoribosylaminoimidazolecarboxamide formyltransferase |
| 1082 | 31 | outer | phosphoribosylaminoimidazolecarboxamide formyltransferase |
| 1083 | 45 | inner 0 | phosphoribosylaminoimidazolecarboxamide formyltransferase |
| 1084 | 199 | inner 0 | sufI protein (sufI) |
| 1085 | 125 | inner 1 | 1-acyl-glycerol-3-phosphate acyltransferase (plsC) |
| 1087 | 75 | inner 1 | 1-acyl-glycerol-3-phosphate acyltransferase (plsC) |
| 1091 | 199 | inner 4 | sodium- and chloride-dependent transporter |
| 1092 | 217 | inner 2 | potassium/copper-transporting ATPase |
| 1093 | 68 | cytoplasm | mercuric ion scavenger protein (merP) |
| 1094 | 68 | cytoplasm | mercuric ion scavenger protein (merP) |
| 1095 | 68 | cytoplasm | mercuric ion scavenger protein (merP) |
| 1096 | 144 | cytoplasm | transcriptional regulator, merR family |
| 1097 | 105 | cytoplasm | met repressor (metJ) |
| 1098 | 109 | inner 1 | transcription termination factor (rho) |
| 1100 | 317 | cytoplasm | fumarate reductase, flavoprotein subunit (frdA) or succinate dehydrogenase, flavoprotein subunit sdhA |
| 1101 | 276 | cytoplasm | fumarate reductase, iron-sulfur protein (frdB) or succinate dehydrogenase, iron-sulfur protein sdhB |
| 1102 | 132 | inner 3 | fumarate reductase, 15 kDa hydrophobic protein (frdC) |
| 1103 | 114 | inner 1 | fumarate reductase, 13 kDa hydrophobic protein (frdD) |
| 1109 | 170 | cytoplasm | terminase, small subunit |
| 1116 | 51 | cytoplasm | heme-hemopexin utilization protein A (hxuA) |
| 1117 | 165 | cytoplasm | heme-hemopexin utilization protein A (hxuA) |
| 1120 | 118 | cytoplasm | dihydroneopterin aldolase (folB) |
| 1124 | 338 | inner 1 | nitrate/nitrite sensor protein (narQ) |
| 1125 | 225 | inner 1 | topoisomerase IV, subunit A (parC) |
| 1127 | 139 | cytoplasm | glucose kinase |
| 1132 | 202 | cytoplasm | type I modification enzyme (hsdM) |
| 1135 | 260 | cytoplasm | type I modification enzyme (hsdM) |
| 1137 | 362 | cytoplasm | type I restriction/modification specificity protein (hsdS) |
| 1138 | 226 | inner 0 | thiamin-phosphate pyrophosphorylase |
| 1139 | 254 | cytoplasm | phosphomethylpyrimidine kinase (thiD) |
| 1140 | 32 | cytoplasm | phosphomethylpyrimidine kinase (thiD) |
| 1141 | 263 | inner 1 | hydroxyethylthiazole kinase |
| 1143 | 70 | cytoplasm | outer membrane protein NsgA |
| 1144 | 51 | cytoplasm | ribonuclease E (rne) |
| 1145 | 75 | cytoplasm | ribonuclease E (rne) |
| 1148 | 42 | cytoplasm | ribonuclease E (rne) |
| 1151 | 180 | inner 1 | adenine phosphoribosyltransferase (apt) |

TABLE III-continued

Annotations

| NTH | aa | PSORT | Annotation |
|---|---|---|---|
| 1152 | 311 | cytoplasm | DNA polymerase III, subunits gamma and tau (dnaX) |
| 1154 | 221 | cytoplasm | DNA polymerase III, subunits gamma and tau (dnaX) |
| 1155 | 173 | cytoplasm | DNA polymerase III, subunits gamma and tau (dnaX) |
| 1156 | 60 | cytoplasm | uracil phosphoribosyltransferase (upp) |
| 1165 | 406 | cytoplasm | nifS protein (nifS) |
| 1166 | 151 | cytoplasm | iscU protein (iscU) |
| 1167 | 107 | cytoplasm | HesB/YadR/YfhF family protein |
| 1168 | 174 | cytoplasm | co-chaperone Hsc20 (hscB) |
| 1171 | 151 | cytoplasm | heat shock protein (hscA) |
| 1172 | 53 | cytoplasm | D-lactate dehydrogenase (dld) |
| 1173 | 36 | cytoplasm | type I restriction enzyme EcoR124II R protein, |
| 1174 | 183 | lipo | lipoprotein (spr) |
| 1175 | 194 | cytoplasm | tldD protein tldD |
| 1177 | 44 | cytoplasm | hemoglobin-binding protein |
| 1180 | 234 | cytoplasm | peptidase E (pepE) |
| 1182 | 386 | cytoplasm | ribosomal protein S1 (rpS1) |
| 1183 | 94 | cytoplasm | integration host factor, beta-subunit (himD) |
| 1186 | 194 | cytoplasm | orotidine 5'-phosphate decarboxylase (pyrF) |
| 1188 | 181 | inner 1 | lipopolysaccharide biosynthesis protein |
| 1189 | 264 | inner 1 | alpha-1,2-N-acetylglucosamine transferase rfaK |
| 1190 | 57 | periplasmic | lipopolysaccharide biosynthesis protein |
| 1191 | 304 | inner 2 | alpha-2,3-sialyltransferase |
| 1192 | 160 | inner 4 | lipopolysaccharide biosynthesis protein |
| 1197 | 124 | cytoplasm | uridine kinase (udk) |
| 1198 | 195 | cytoplasm | deoxycytidine triphosphate deaminase (dcd) |
| 1201 | 402 | inner 10 | drug resistance translocase family protein |
| 1202 | 158 | cytoplasm | GTP-binding protein |
| 1203 | 55 | outer | hemoglobin-binding protein |
| 1206 | 736 | cytoplasm | TonB-dependent receptor or hemoglobin receptor hmbR |
| 1207 | 91 | cytoplasm | transcriptional regulator, HTH_3 family |
| 1212 | 230 | cytoplasm | glycyl-tRNA synthetase, beta chain (glyS) |
| 1218 | 244 | cytoplasm | glycyl-tRNA synthetase, alpha chain (glyQ) |
| 1228 | 198 | cytoplasm | seryl-tRNA synthetase (serS) |
| 1229 | 282 | inner 2 | cytochrome C-type biogenesis protein (nrfF) |
| 1230 | 176 | inner 1 | thiol:disulfide interchange protein (dsbE) |
| 1231 | 507 | inner 9 | cytochrome C-type biogenesis |
| 1233 | 380 | inner 1 | glutamate dehydrogenase (gdhA) |
| 1242 | 135 | cytoplasm | transcriptional regulator |
| 1253 | 266 | cytoplasm | transcriptional regulatory protein |
| 1254 | 101 | inner 3 | galactoside ABC transporter, permease protein (mglC) |
| 1256 | 185 | inner 6 | intracellular septation protein A ispA |
| 1258 | 154 | cytoplasm | acyl CoA thioester hydrolase family protein |
| 1261 | 158 | periplasmic | soluble lytic murein transglycosylase |
| 1263 | 229 | cytoplasm | pyridoxamine phosphate oxidase (pdxH) |
| 1264 | 162 | cytoplasm | GTP-binding protein |
| 1266 | 69 | cytoplasm | NAD(P)H-flavin oxidoreductase |
| 1267 | 386 | cytoplasm | ATP-binding protein (mrp) |
| 1268 | 460 | periplasmic | methionyl-tRNA synthetase (metG) |
| 1269 | 70 | cytoplasm | phosphoribosylaminoimidazole carboxylase, catalytic |
| 1272 | 596 | cytoplasm | aminopeptidase N (pepN) |
| 1273 | 175 | inner 1 | dihydrodipicolinate reductase (dapB) |
| 1274 | 82 | cytoplasm | ferredoxin |
| 1276 | 329 | cytoplasm | phenylalanyl-tRNA synthetase, alpha subunit (pheS) |
| 1277 | 373 | cytoplasm | phenylalanyl-tRNA synthetase, beta subunit (pheT) |
| 1278 | 286 | cytoplasm | DNA adenine methylase (dam) |
| 1279 | 298 | inner 1 | 3-dehydroquinate synthase (aroB) |
| 1280 | 74 | inner 2 | NADH:ubiquinone oxidoreductase, Na translocating |
| 1281 | 208 | inner 6 | NADH:ubiquinone oxidoreductase, Na translocating |
| 1282 | 269 | inner 1 | NADH:ubiquinone oxidoreductase, Na translocating |
| 1283 | 411 | inner 7 | NADH:ubiquinone oxidoreductase, subunit B (nqrB) |
| 1284 | 48 | cytoplasm | NADH:ubiquinone oxidoreducatase subunit A, Na translocating |
| 1285 | 254 | cytoplasm | NADH:ubiquinone oxidoreducatase subunit A, Na translocating |
| 1286 | 85 | inner 1 | nitrogen fixation protein (rnfG) |
| 1287 | 358 | inner 9 | Na(+)-translocating NADH-quinone reductase, subunit |
| 1290 | 679 | outer | ferredoxin, 4Fe—4S bacterial type |
| 1291 | 58 | cytoplasm | ferredoxin, 4Fe—4S bacterial type |
| 1295 | 406 | inner 1 | polyribonucleotide nucleotidyltransferase pnp |
| 1297 | 296 | inner 1 | polyribonucleotide nucleotidyltransferase pnp |
| 1302 | 452 | inner 1 | O-succinylbenzoate-CoA ligase (menE) or long-chain-fatty-acid-CoA ligase fadD-2 |
| 1303 | 201 | cytoplasm | seqA protein (seqA) |
| 1304 | 85 | cytoplasm | esterase/lipase |
| 1305 | 65 | inner 1 | esterase/lipase |
| 1306 | 144 | inner 0 | esterase/lipase |
| 1307 | 41 | inner 1 | iron (chelated) ABC transporter, permease protein (yfeD) |

TABLE III-continued

Annotations

| NTH | aa | PSORT | Annotation |
|---|---|---|---|
| 1308 | 147 | inner 2 | iron (chelated) ABC transporter, permease protein (yfeD) |
| 1309 | 282 | inner 8 | iron (chelated) ABC transporter, permease protein (yfeC) |
| 1310 | 306 | cytoplasm | iron (chelated) transporter, ATP-binding protein (yfeB) |
| 1311 | 293 | periplasmic | iron (chelated) ABC transporter, periplasmic-binding protein |
| 1313 | 154 | lipo | outer membrane integrity protein (tolA) or IgA-specific serine endopeptidase iga |
| 1314 | 253 | cytoplasm | penicillin-binding protein 7 |
| 1318 | 41 | cytoplasm | transcriptional activator (ilvY) |
| 1319 | 292 | inner 9 | rarD protein |
| 1320 | 105 | cytoplasm | glpE protein (glpE) |
| 1321 | 263 | inner 1 | triosephosphate isomerase (tpiA) |
| 1323 | 107 | cytoplasm | integrase/recombinase (xerC) |
| 1324 | 100 | cytoplasm | dnaK suppressor protein (dksA) |
| 1326 | 58 | cytoplasm | poly(A) polymerase (pcnB) |
| 1327 | 450 | inner 10 | C4-dicarboxylate transporter |
| 1331 | 131 | cytoplasm | uracil DNA glycosylase (ung) |
| 1332 | 124 | inner 2 | bicyclomycin resistance protein (bcr) |
| 1338 | 50 | cytoplasm | gamma-glutamyl phosphate reductase (proA) |
| 1339 | 47 | cytoplasm | gamma-glutamyl phosphate reductase (proA) |
| 1340 | 39 | cytoplasm | gamma-glutamyl phosphate reductase (proA) |
| 1341 | 319 | inner 1 | gamma-glutamyl phosphate reductase (proA) |
| 1343 | 98 | cytoplasm | heat shock protein (dnaJ) |
| 1344 | 133 | cytoplasm | acetyl-CoA carboxylase, biotin carboxyl carrier protein |
| 1345 | 443 | cytoplasm | acetyl-CoA carboxylase, biotin carboxylase (accC) |
| 1348 | 320 | inner 7 | sodium/pantothenate symporter (panF) |
| 1349 | 493 | cytoplasm | cell division protein (ftsH) |
| 1351 | 201 | cytoplasm | dihydropteroate synthase (folP-2) |
| 1352 | 445 | cytoplasm | mrsA protein (mrsA) or phosphoglucomutase/phosphomannomutase family |
| 1355 | 438 | cytoplasm | DNA-directed RNA polymerase, beta' chain (rpoC) |
| 1357 | 172 | inner 2 | rod shape-determining protein (rodA) |
| 1359 | 621 | inner 1 | penicillin-binding protein 2 (pbp2) |
| 1361 | 193 | cytoplasm | modification methylase NlaIV |
| 1363 | 432 | inner 1 | 3-phosphoshikimate-1-carboxyvinyltransferase (aroA) or 3- |
| 1365 | 298 | inner 1 | formyltetrahydrofolate deformylase (purU) or phosphoribosylglycinamide formyltransferase purN |
| 1366 | 138 | cytoplasm | DNA-binding protein H-NS (hns) |
| 1369 | 66 | cytoplasm | DNA polymerase III, alpha subunit (dnaE) |
| 1370 | 35 | cytoplasm | DNA polymerase III, alpha subunit (dnaE) |
| 1371 | 847 | cytoplasm | DNA polymerase III, alpha subunit (dnaE) |
| 1373 | 118 | cytoplasm | threonine deaminase (ilvA) |
| 1378 | 196 | cytoplasm | MutT/nudix family protein |
| 1379 | 382 | inner 1 | glutamate 5-kinase (gamma-glutamyl kinase) (proB) |
| 1380 | 128 | inner 0 | dihydrofolate reductase (folA) |
| 1381 | 46 | cytoplasm | dihydrofolate reductase (folA) |
| 1383 | 392 | inner 2 | multidrug resistance protein A (emrA) or fatty acid efflux system protein farA |
| 1384 | 343 | cytoplasm | poly(A) polymerase (pcnB) |
| 1386 | 106 | cytoplasm | 2-amino-4-hydroxy-6-hydroxymethyldihydropteridine- |
| 1388 | 432 | periplasmic | N-acetylmuramoyl-L-alanine amidase |
| 1389 | 227 | cytoplasm | DNA mismatch repair protein (mutL) |
| 1392 | 247 | cytoplasm | hemY protein (hemY) |
| 1393 | 175 | inner 1 | hemY protein (hemY) |
| 1394 | 377 | periplasmic | uroporphyrin-III C-methyltransferase (hemX) |
| 1398 | 194 | inner 0 | transcriptional activator (ilvY) |
| 1400 | 492 | inner 1 | ketol-acid reductoisomerase (ilvC) |
| 1401 | 426 | cytoplasm | anaerobic glycerol-3-phosphate dehydrogenase, subunit C |
| 1402 | 30 | cytoplasm | tRNA (guanine-N1)-methyltransferase (trmD) |
| 1403 | 59 | cytoplasm | 16S rRNA processing protein RimM rimM |
| 1404 | 81 | cytoplasm | 16S rRNA processing protein RimM rimM |
| 1405 | 82 | cytoplasm | ribosomal protein S16 (rpS16) |
| 1407 | 603 | periplasmic | 5'-nucleotidase |
| 1408 | 128 | cytoplasm | shikimic acid kinase I (arok) |
| 1410 | 249 | cytoplasm | stationary-phase survival protein (surE) |
| 1411 | 128 | inner 2 | lipoprotein B (lppB) |
| 1412 | 74 | inner 1 | lipoprotein B (lppB) |
| 1416 | 354 | lipo | lipoprotein NlpD |
| 1417 | 56 | cytoplasm | lipoprotein NlpD |
| 1420 | 62 | inner 1 | phosphate ABC transporter, permease protein (pstC) |
| 1421 | 282 | inner 5 | phosphate ABC transporter, permease protein (pstA) or sulfate ABC transporter, permease protein cysT |
| 1422 | 255 | cytoplasm | amino acid ABC transporter, ATP-binding protein or sulfate ABC transporter, ATP-binding protein cysA |
| 1423 | 154 | cytoplasm | phosphate regulon transcriptional regulatory protein (phoB) or DNA-binding response regulator NULL |
| 1424 | 72 | cytoplasm | phosphate regulon transcriptional regulatory protein (phoB) |

TABLE III-continued

Annotations

| NTH | aa | PSORT | Annotation |
|---|---|---|---|
| 1425 | 425 | inner 1 | phosphate regulon sensor protein (phoR) or sensor histidine kinase NULL |
| 1426 | 44 | cytoplasm | exodeoxyribonuclease I (sbcB) |
| 1427 | 474 | inner 1 | exodeoxyribonuclease I (sbcB) |
| 1428 | 158 | inner 1 | aminopeptidase A/l (pepA) |
| 1429 | 480 | inner 5 | high-affinity choline transport protein (betT) |
| 1430 | 132 | inner 2 | high-affinity choline transport protein (betT) |
| 1431 | 57 | inner 0 | sensor protein (ygiY) |
| 1432 | 139 | cytoplasm | high affinity ribose transport protein (rbsD) |
| 1433 | 493 | cytoplasm | D-ribose ABC transporter, ATP-binding protein (rbsA) |
| 1434 | 323 | inner 9 | D-ribose ABC transporter, permease protein (rbsC) |
| 1435 | 53 | periplasmic | D-ribose ABC transporter, periplasmic-binding protein |
| 1436 | 88 | cytoplasm | D-ribose ABC transporter, periplasmic-binding protein (rbsB) |
| 1438 | 246 | inner 6 | heme exporter protein C (ccmC) or cytochrome c-type biogenesis protein |
| 1439 | 221 | inner 6 | heme exporter protein B (ccmB) |
| 1440 | 212 | cytoplasm | heme exporter ATP-binding protein A (ccmA) or amino acid ABC transporter, ATP-binding protein |
| 1442 | 215 | cytoplasm | superoxide dismutase (sodA) |
| 1443 | 231 | cytoplasm | ABC transporter, ATP-binding protein |
| 1445 | 105 | cytoplasm | anti-sigma factor B antagonist |
| 1446 | 99 | cytoplasm | BolA/YrbA family protein |
| 1447 | 424 | inner 3 | UDP-N-acetylglucosamine 1-carboxyvinyltransferase (murZ) |
| 1448 | 110 | inner 1 | amino acid ABC transporter, periplasmic-binding protein |
| 1449 | 135 | cytoplasm | amino acid ABC transporter, periplasmic-binding protein |
| 1450 | 234 | inner 3 | amino acid ABC transporter, permease protein |
| 1456 | 51 | cytoplasm | ATP-dependent Clp protease, ATPase subunit (clpB) |
| 1457 | 246 | cytoplasm | RNA methyltransferase, TrmH family |
| 1459 | 782 | cytoplasm | virulence-associated protein (vacB) or ribonuclease II family protein vacB |
| 1460 | 83 | cytoplasm | peptidyl-prolyl cis-trans isomerase, FkbP-type (slyD) or FKBP-type peptidyl-prolyl cis-trans isomerase |
| 1462 | 128 | cytoplasm | ribosome binding factor A (rbfA) |
| 1463 | 306 | cytoplasm | tRNA pseudouridine 55 synthase (truB) |
| 1464 | 379 | inner 1 | chorismate mutase/prephenate dehydrogenase (tyrA) |
| 1467 | 38 | inner 1 | chorismate synthase (aroC) |
| 1468 | 286 | periplasmic | penicillin-insensitive murein endopeptidase (mepA) |
| 1472 | 318 | inner 2 | lipid A biosynthesis (kdo)2-(lauroyl)-lipid IVA or HtrB/MsbB family protein |
| 1473 | 126 | inner 1 | oligopeptide transporter, periplasmic-binding protein, |
| 1475 | 696 | cytoplasm | oligopeptidase A (prlC) |
| 1476 | 292 | cytoplasm | type I modification enzyme (hsdM) |
| 1477 | 196 | cytoplasm | type I modification enzyme (hsdM) |
| 1480 | 204 | cytoplasm | riboflavin synthase, alpha chain (ribE) |
| 1482 | 212 | cytoplasm | aminopeptidase N (pepN) |
| 1483 | 140 | cytoplasm | glutaminyl-tRNA synthetase (glnS) |
| 1485 | 699 | cytoplasm | 4-alpha-glucanotransferase (malQ) |
| 1499 | 273 | cytoplasm | glutamine synthetase (glnA) |
| 1500 | 96 | inner 1 | glutamine synthetase (glnA) |
| 1501 | 50 | cytoplasm | glutamine synthetase (glnA) |
| 1503 | 347 | inner 0 | DTDP-glucose 4,6-dehydratase (rffG) |
| 1505 | 527 | cytoplasm | topoisomerase IV, subunit B (parE) |
| 1506 | 315 | inner 1 | lipid A biosynthesis lauroyl acyltransferase (htrB) |
| 1507 | 308 | inner 1 | ADP-heptose synthase (rfaE) |
| 1508 | 83 | cytoplasm | DNA-directed RNA polymerase, beta' chain (rpoC) |
| 1509 | 829 | cytoplasm | DNA-directed RNA polymerase, beta' chain (rpoC) |
| 1510 | 332 | inner 8 | tellurite resistance protein (tehA) |
| 1511 | 81 | cytoplasm | ribosomal protein L13 (rpL13) |
| 1512 | 153 | cytoplasm | ribosomal protein S9 (rpS9) |
| 1513 | 101 | cytoplasm | urease, beta subunit (ureB) |
| 1514 | 572 | cytoplasm | urease, alpha subunit (ureC) |
| 1515 | 185 | inner 1 | urease accessory protein (ureE) |
| 1519 | 183 | cytoplasm | urease accessory protein (ureF) |
| 1520 | 107 | cytoplasm | urease accessory protein (ureG) |
| 1523 | 334 | cytoplasm | ornithine carbamoyltransferase (arcB) |
| 1524 | 310 | cytoplasm | carbamate kinase (arcC) |
| 1526 | 193 | inner 3 | efflux pump component MtrF mtrF |
| 1527 | 113 | inner 2 | anaerobic C4-dicarboxylate membrane transporter protein |
| 1528 | 136 | inner 1 | NADH dehydrogenase (ndh) |
| 1530 | 315 | cytoplasm | NADH dehydrogenase (ndh) |
| 1531 | 410 | inner 1 | glycerol-3-phosphate acyltransferase (plsB) |
| 1532 | 367 | inner 0 | glycerol-3-phosphate acyltransferase (plsB) |
| 1533 | 75 | cytoplasm | lexA repressor (lexA) |
| 1534 | 121 | cytoplasm | opacity protein or outer membrane protein NsgA nsgA |
| 1537 | 227 | inner 4 | arginine ABC transporter, permease protein (artM) |
| 1538 | 221 | inner 4 | arginine ABC transporter, permease protein (artQ) |
| 1539 | 72 | cytoplasm | arginine ABC transporter, periplasmic-binding protein (artI) |
| 1541 | 99 | periplasmic | arginine ABC transporter, periplasmic-binding protein |
| 1542 | 243 | cytoplasm | arginine ABC transporter, ATP-binding protein (artP) |

TABLE III-continued

Annotations

| NTH | aa | PSORT | Annotation |
|---|---|---|---|
| 1544 | 69 | cytoplasm | phosphoheptose isomerase (gmhA) |
| 1545 | 73 | cytoplasm | shikimate 5-dehydrogenase-related protein |
| 1546 | 267 | cytoplasm | serine acetyltransferase (cysE) |
| 1548 | 332 | inner 1 | glycerol-3-phosphate dehydrogenase (NAD+) (gpsA) |
| 1549 | 567 | cytoplasm | adenylate cyclase (cyaA) |
| 1550 | 42 | cytoplasm | adenylate cyclase (cyaA) |
| 1551 | 228 | cytoplasm | adenylate cyclase (cyaA) |
| 1552 | 110 | lipo | ribosomal-protein-alanine acetyltransferase (rimI) |
| 1554 | 134 | cytoplasm | DNA polymerase III, psi subunit (holD) |
| 1556 | 222 | cytoplasm | hemK protein hemK |
| 1558 | 181 | cytoplasm | GTP-binding protein (era) |
| 1559 | 125 | inner 0 | GTP-binding protein (era) |
| 1561 | 227 | cytoplasm | ribonuclease III (rnc) |
| 1562 | 349 | inner 3 | signal peptidase I (lepB) |
| 1565 | 345 | cytoplasm | tail fibre protein |
| 1568 | 395 | cytoplasm | tyrosyl tRNA synthetase (tyrS) |
| 1569 | 315 | inner 1 | phosphoribosylpyrophosphate synthetase (prsA) |
| 1575 | 72 | inner 1 | IS1016-V6 protein |
| 1576 | 563 | cytoplasm | glucose-6-phosphate isomerase (pgi) |
| 1577 | 360 | cytoplasm | alanine racemase, biosynthetic (alr) |
| 1578 | 126 | cytoplasm | replicative DNA helicase (dnaB) |
| 1579 | 303 | cytoplasm | replicative DNA helicase (dnaB) |
| 1582 | 991 | outer-hand | hemoglobin-binding protein |
| 1583 | 237 | cytoplasm | zinc protease |
| 1584 | 276 | inner 1 | adenylosuccinate synthetase (purA) |
| 1585 | 41 | cytoplasm | adenylosuccinate synthetase (purA) |
| 1586 | 297 | inner 1 | 2,3,4,5-tetrahydropyridine-2-carboxylate |
| 1588 | 336 | inner 1 | purine nucleotide synthesis repressor (purR) |
| 1589 | 78 | cytoplasm | phosphoenolpyruvate carboxylase (ppc) |
| 1590 | 45 | inner 1 | ribosomal protein S1 (rpS1) |
| 1591 | 244 | cytoplasm | cytidylate kinase 2 (cmkB) |
| 1593 | 291 | cytoplasm | singlet oxygen resistance protein |
| 1597 | 549 | inner 1 | D-lactate dehydrogenase (dld) |
| 1609 | 462 | inner 1 | oxidoreductase |
| 1610 | 199 | cytoplasm | spermidine/putrescine ABC transporter, periplasmic-binding |
| 1613 | 41 | cytoplasm | carbonic anhydrase |
| 1614 | 647 | cytoplasm | ABC transporter, ATP-binding protein |
| 1618 | 289 | inner 6 | cytochrome C-type biogenesis protein (ccmF) |
| 1619 | 181 | periplasmic | thiol:disulfide interchange protein (dsbE) |
| 1624 | 152 | cytoplasm | DNA ligase (lig) |
| 1625 | 1027 | inner 1 | type I restriction enzyme (hsdR) |
| 1627 | 123 | cytoplasm | anticodon nuclease prrC |
| 1629 | 177 | inner 1 | oligopeptide ABC transporter, ATP-binding protein (oppD) or sulfate ABC transporter, ATP-binding protein cysA |
| 1630 | 356 | cytoplasm | oligopeptide ABC transporter, ATP-binding protein (oppF) or sulfate ABC transporter, ATP-binding protein cysA |
| 1631 | 292 | inner 1 | membrane protein (lapB) |
| 1635 | 683 | cytoplasm | 5-methyltetrahydropteroyltriglutamate-homocysteine |
| 1636 | 73 | cytoplasm | 5-methyltetrahydropteroyltriglutamate-homocysteine |
| 1639 | 363 | cytoplasm | GTP-binding protein |
| 1640 | 194 | cytoplasm | peptidyl-tRNA hydrolase (pth) |
| 1645 | 163 | cytoplasm | exodeoxyribonuclease VII, large subunit (xseA) |
| 1646 | 183 | cytoplasm | YhbX/YhjW/YijP/YjdB family protein |
| 1648 | 242 | cytoplasm | heat shock protein (dnaJ) |
| 1650 | 320 | cytoplasm | heat shock protein 70 (dnaK) |
| 1651 | 327 | cytoplasm | heat shock protein 70 (dnaK) |
| 1653 | 411 | inner 8 | gluconate permease gntP |
| 1659 | 269 | cytoplasm | molybdenum cofactor biosynthesis protein A (moaA) |
| 1662 | 337 | inner 2 | sugar isomerase, KpsF/GutQ family |
| 1664 | 531 | inner 1 | single-stranded-DNA-specific exonuclease (recJ) |
| 1665 | 39 | cytoplasm | single-stranded-DNA-specific exonuclease (recJ) |
| 1666 | 235 | outer | thiol:disulfide interchange protein (dsbA) |
| 1668 | 230 | inner 1 | pfs protein (pfs) or 5-methylthioadenosine |
| 1670 | 565 | cytoplasm | transferrin-binding protein or TonB-dependent receptor |
| 1671 | 568 | inner 1 | lon protease or ATP-dependent protease La lon |
| 1672 | 139 | cytoplasm | 3-hydroxydecanoyl-(acyl carrier-protein) dehydratase (fabA) |
| 1678 | 155 | cytoplasm | bacterioferritin comigratory protein (bcp) |
| 1679 | 286 | cytoplasm | dihydrodipicolinate synthetase (dapA) |
| 1680 | 209 | lipo | lipoprotein |
| 1681 | 107 | cytoplasm | sigma(54) modulation protein |
| 1682 | 312 | cytoplasm | glycosyl transferase |
| 1688 | 613 | inner 2 | sensor histidine kinase |
| 1690 | 145 | inner 1 | UDP-N-acetylglucosamine acetyltransferase (lpxA) |
| 1692 | 403 | inner 0 | lipid-A-disaccharide synthetase (lpxB) |
| 1693 | 197 | inner 1 | ribonuclease HII (rnhB) |

TABLE III-continued

Annotations

| NTH | aa | PSORT | Annotation |
|---|---|---|---|
| 1694 | 146 | cytoplasm | modification methylase |
| 1696 | 185 | cytoplasm | ribosome releasing factor (rrf) |
| 1698 | 226 | inner 1 | 1-deoxy-D-xylulose 5-phosphate reductoisomerase (dxr) |
| 1700 | 171 | cytoplasm | 1-deoxy-D-xylulose 5-phosphate reductoisomerase (dxr) |
| 1704 | 370 | cytoplasm | ribonucleoside-diphosphate reductase, alpha chain (nrdA) |
| 1705 | 39 | cytoplasm | ribonucleoside diphosphate reductase, beta chain (nrdB) |
| 1706 | 311 | cytoplasm | ribonucleoside diphosphate reductase, beta chain (nrdB) |
| 1707 | 409 | inner 1 | 2-oxoglutarate dehydrogenase E2 component, dihydrolipoamide |
| 1708 | 222 | cytoplasm | 2-oxoglutarate dehydrogenase E1 component (sucA) |
| 1709 | 184 | cytoplasm | ribosomal protein S4 (rpS4) |
| 1712 | 314 | inner 2 | phosphoserine phosphatase (serB) |
| 1714 | 680 | cytoplasm | transketolase 1 (tktA) |
| 1716 | 333 | cytoplasm | biotin synthetase (bioB) |
| 1717 | 217 | cytoplasm | thiamin ABC transporter, ATP-binding protein or spermidine/putrescine ABC transporter, ATP-binding |
| 1718 | 84 | inner 1 | thiamin ABC transporter, permease protein |
| 1719 | 77 | inner 1 | molybdopeterin biosynthesis protein (mog) |
| 1720 | 112 | cytoplasm | nitrogen regulatory protein P-II (glnB) |
| 1722 | 348 | inner 6 | transporter |
| 1724 | 264 | periplasmic | primosomal protein N' (priA) |
| 1725 | 487 | inner 1 | primosomal protein N' (priA) |
| 1726 | 102 | cytoplasm | PTS system, glucose-specific IIA component (crr) |
| 1729 | 581 | inner 1 | phosphoenolpyruvate-protein phosphotransferase (ptsI) |
| 1730 | 92 | cytoplasm | phosphocarrier protein HPr (ptsH) |
| 1733 | 189 | cytoplasm | oligoribonuclease orn |
| 1735 | 294 | inner 2 | phenylalanyl-tRNA synthetase, beta subunit (pheT) |
| 1736 | 53 | cytoplasm | integration host factor, alpha-subunit (himA) |
| 1738 | 47 | cytoplasm | integration host factor, alpha-subunit (himA) |
| 1739 | 161 | lipo | lipoprotein (nlpC) |
| 1747 | 87 | cytoplasm | pyruvate kinase, type II (pykA) |
| 1758 | 387 | cytoplasm | modification methylase NlaIV |
| 1766 | 90 | cytoplasm | exodeoxyribonuclease, small subunit (xseB) |
| 1767 | 296 | inner 1 | geranyltranstransferase (ispA) |
| 1768 | 316 | cytoplasm | 1-deoxyxylulose-5-phosphate synthase (dxs) |
| 1770 | 99 | inner 1 | glycosyl transferase |
| 1771 | 464 | cytoplasm | fumarate hydratase, class II (fumC) |
| 1776 | 315 | cytoplasm | dihydroorotate dehydrogenase (pyrD) |
| 1780 | 669 | cytoplasm | transferrin-binding protein 2 precursor (tbp2) |
| 1781 | 560 | periplasmic | transferrin-binding protein 1 precursor (tbp1) |
| 1782 | 152 | inner 1 | deoxyuridinetriphosphatase (dut) |
| 1783 | 400 | inner 1 | DNA/pantothenate metabolism flavoprotein (dfp) |
| 1785 | 234 | cytoplasm | DNA repair protein (radC) |
| 1786 | 82 | cytoplasm | ribosomal protein L28 (rpL28) |
| 1787 | 56 | cytoplasm | ribosomal protein L33 (rpL33) |
| 1788 | 454 | inner 1 | L-2,4-diaminobutyrate:2-ketoglutarate 4-aminotransferase or acetylornithine aminotransferase argD |
| 1790 | 132 | cytoplasm | virulence associated protein C (vapC) |
| 1791 | 443 | cytoplasm | L-2,4-diaminobutyrate decarboxylase |
| 1792 | 434 | cytoplasm | ATP-dependent RNA helicase (hrpa) |
| 1793 | 780 | inner 1 | ATP-dependent RNA helicase (hrpa) |
| 1794 | 122 | cytoplasm | ATP-dependent helicase (hrpa) |
| 1799 | 243 | inner 5 | cytochrome D ubiquinol oxidase, subunit II (cydB) |
| 1800 | 198 | cytoplasm | uxu operon regulator (uxuR) |
| 1801 | 51 | cytoplasm | mannonate dehydratase (uxuA) |
| 1802 | 33 | cytoplasm | acyl carrier protein (acpP) |
| 1803 | 220 | inner 5 | anaerobic C4-dicarboxylate membrane transporter protein |
| 1805 | 486 | inner 5 | NAD(P) transhydrogenase, subunit alpha (pntA) |
| 1806 | 474 | inner 7 | NAD(P) transhydrogenase, subunit beta (pntB) |
| 1807 | 305 | periplasmic | transcriptional regulator |
| 1808 | 70 | cytoplasm | DNA topoisomerase I (topA) |
| 1809 | 50 | cytoplasm | signal recognition particle protein (ffh) |
| 1812 | 88 | cytoplasm | type I restriction enzyme (hsdR) |
| 1813 | 646 | inner 1 | type I restriction enzyme (hsdR) |
| 1815 | 418 | inner 1 | type I restriction/modification specificity protein (hsdS) |
| 1819 | 545 | outer | heme-hemopexin utilization protein B (hxuB) |
| 1825 | 402 | cytoplasm | xylose isomerase (xylA) |
| 1826 | 493 | cytoplasm | xylulose kinase |
| 1827 | 308 | cytoplasm | ADP-L-glycero-D-mannoheptose-6-epimerase (rfaD) |
| 1828 | 167 | inner 1 | thioredoxin |
| 1830 | 223 | cytoplasm | deoxyribose-phosphate aldolase (deoC) |
| 1831 | 509 | cytoplasm | competence protein (comM) |
| 1834 | 72 | cytoplasm | glucose kinase |
| 1835 | 288 | inner 1 | RpiR/YebK/YfhH family protein |
| 1836 | 293 | inner 0 | N-acetylneuraminate lyase (nanA) or dihydrodipicolinate synthase dapA |
| 1838 | 270 | cytoplasm | glucosamine-6-phosphate isomerase (nagB) |

TABLE III-continued

Annotations

| NTH | aa | PSORT | Annotation |
|---|---|---|---|
| 1839 | 381 | cytoplasm | N-acetylglucosamine-6-phosphate deacetylase (nagA) |
| 1840 | 107 | cytoplasm | outer membrane protein P2 (ompP2) |
| 1841 | 38 | cytoplasm | DNA polymerase III, delta' subunit (holB) |
| 1845 | 716 | outer-hand | LavA virulence protein |
| 1846 | 237 | cytoplasm | thymidylate kinase |
| 1848 | 265 | cytoplasm | argininosuccinate synthetase (argG) |
| 1855 | 97 | cytoplasm | exoribonuclease II (rnb) |
| 1858 | 188 | cytoplasm | L-lactate dehydrogenase (lctD) |
| 1859 | 269 | inner 1 | glutamate racemase (murI) |
| 1860 | 693 | cytoplasm | ATP-dependent DNA helicase (recG) |
| 1861 | 515 | inner 1 | guanosine-3',5'-bis(diphosphate) 3'-pyrophosphohydrolase |
| 1867 | 69 | cytoplasm | molybdenum-pterin binding protein (mopI) |
| 1868 | 109 | cytoplasm | desulfoviridin gamma subunit |
| 1870 | 393 | inner 1 | killing protein (kicB) |
| 1871 | 343 | periplasmic | enolase (eno) |
| 1875 | 508 | cytoplasm | catalase (hktE) |
| 1876 | 50 | cytoplasm | glucosamine-fructose-6-phosphate aminotransferase (glmS) |
| 1877 | 232 | cytoplasm | glycogen synthase (glgA) |
| 1879 | 174 | cytoplasm | glucose-1-phosphate adenylyltransferase (glgC) |
| 1880 | 283 | cytoplasm | glucose-1-phosphate adenylyltransferase (glgC) |
| 1881 | 435 | inner 1 | glycogen operon protein (glgX) |
| 1882 | 229 | inner 1 | glycogen operon protein (glgX) |
| 1883 | 685 | cytoplasm | 1,4-alpha-glucan branching enzyme (glgB) |
| 1884 | 119 | cytoplasm | ribosomal protein S10 (rpS10) |
| 1885 | 315 | inner 1 | cys regulon transcriptional activator cysB |
| 1886 | 217 | cytoplasm | acetate CoA-transferase, alpha subunit |
| 1887 | 233 | cytoplasm | acetate CoA-transferase, beta subunit (atoA) |
| 1888 | 344 | inner 5 | short-chain fatty acids transporter (atoE) |
| 1889 | 84 | inner 1 | short-chain fatty acids transporter (atoE) |
| 1890 | 393 | cytoplasm | acetyl-CoA acetyltransferase (atoB) |
| 1891 | 310 | inner 4 | cell division protein (ftsX) |
| 1892 | 119 | periplasmic | cell division ATP-binding protein (ftsE) |
| 1893 | 129 | cytoplasm | cell division ATP-binding protein (ftsE) |
| 1894 | 175 | cytoplasm | signal recognition particle-docking protein FtsY (ftsY) |
| 1895 | 243 | cytoplasm | peptide ABC transporter, ATP-binding protein (sapD) |
| 1896 | 105 | inner 2 | peptide ABC transporter, permease protein (sapC) |
| 1897 | 50 | periplasmic | peptide ABC transporter, permease protein (sapC) |
| 1898 | 184 | inner 4 | peptide ABC transporter, permease protein (sapC) |
| 1899 | 321 | inner 6 | peptide ABC transporter, permease protein (sapB) |
| 1900 | 564 | outer | peptide ABC transporter, periplasmic-binding protein (sapA) |
| 1903 | 72 | cytoplasm | phosphoenolpyruvate carboxylase (ppc) |
| 1905 | 337 | cytoplasm | oxidoreductase |
| 1906 | 624 | inner 1 | oxidoreductase |
| 1908 | 323 | inner 0 | ferrochelatase (hemH) |
| 1913 | 321 | cytoplasm | thioredoxin reductase (trxB) |
| 1915 | 127 | cytoplasm | thiol peroxidase (tpx) |
| 1917 | 286 | periplasmic | phosphoribosylformylglycinamidine synthase (purL) |
| 1919 | 960 | inner 1 | phosphoribosylformylglycinamidine synthase (purL) |
| 1923 | 247 | inner 0 | lipooligosaccharide biosynthesis protein |
| 1925 | 172 | inner 5 | glp protein |
| 1926 | 235 | cytoplasm | ribosomal large subunit pseudouridine synthase D |
| 1927 | 923 | inner 1 | ATP-dependent helicase (hepA) |
| 1928 | 249 | cytoplasm | L-fucose operon activator (fucR) or transcriptional regulator, DeoR family |
| 1929 | 568 | cytoplasm | ABC transporter, ATP-binding protein |
| 1932 | 440 | cytoplasm | hemoglobin-binding protein |
| 1933 | 158 | cytoplasm | hemoglobin-binding protein |
| 1934 | 140 | cytoplasm | 3,4-dihydroxy-2-butanone 4-phosphate synthase (ribB) or GTP cyclohydrolase |
| 1935 | 282 | inner 1 | lipooligosaccharide biosynthesis protein or lacto-N-neotetraose biosynthesis glycosyl |
| 1936 | 160 | cytoplasm | rRNA methylase |
| 1938 | 355 | cytoplasm | signal recognition particle-docking protein FtsY (ftsY) |
| 1939 | 622 | inner 9 | O-antigen acetylase |
| 1940 | 380 | cytoplasm | ribonuclease D (rnd) |
| 1941 | 562 | inner 2 | long chain fatty acid coenzyme A ligase (fadD) |
| 1942 | 183 | lipo | outer membrane protein |
| 1944 | 158 | cytoplasm | ATP-dependent helicase (dinG) |
| 1949 | 357 | cytoplasm | hemagglutinin/hemolysin-related protein |
| 1950 | 270 | cytoplasm | traN-related protein |
| 1953 | 232 | outer | outer membrane protein P2 (ompP2) |
| 1954 | 366 | cytoplasm | queuosine biosynthesis protein (queA) or S-adenosylmethionine:tRNA |
| 1958 | 1392 | outer | Adhesion and penetration protein |
| 1959 | 504 | cytoplasm | excinuclease ABC, subunit A (uvrA) |
| 1960 | 220 | inner 1 | excinuclease ABC, subunit A (uvrA) |
| 1962 | 384 | outer | membrane-bound lytic murein transglycosylase A |

TABLE III-continued

Annotations

| NTH | aa | PSORT | Annotation |
|---|---|---|---|
| 1963 | 261 | inner 1 | HesA/MoeB/ThiF family protein |
| 1965 | 333 | periplasmic | adhesin |
| 1967 | 467 | inner 1 | NMB1183 |
| 1969 | 156 | cytoplasm | transcriptional regulator (ttk) |
| 1971 | 224 | cytoplasm | catabolite gene activator (crp) |
| 1972 | 392 | cytoplasm | tRNA (uracil-5-)-methyltransferase trmA |
| 1973 | 351 | cytoplasm | beta-hexosaminidase (exoII) or glycosyl hydrolase, family 3 |
| 1975 | 299 | cytoplasm | long-chain fatty acid transport protein (fadL) or outer membrane protein P1 |
| 1976 | 189 | cytoplasm | methylated-DNA-protein-cysteine methyltransferase (dat1) |
| 1977 | 87 | cytoplasm | DNA mismatch repair protein (mutH) |
| 1978 | 53 | inner 0 | DNA mismatch repair protein (mutH) |
| 1980 | 71 | cytoplasm | DNA mismatch repair protein (mutH) |
| 1981 | 430 | inner 1 | cell cycle protein (mesJ) |
| 1982 | 34 | cytoplasm | pyridoxine kinase |
| 1983 | 186 | cytoplasm | acetyl-CoA carboxylase, carboxyl transferase subunit alpha |
| 1984 | 141 | cytoplasm | acetyl-CoA carboxylase, carboxyl transferase subunit alpha |
| 1986 | 261 | inner 9 | membrane protein |
| 1988 | 212 | cytoplasm | ABC transporter, ATP-binding protein (yebM) |
| 1989 | 127 | cytoplasm | selenocysteine-specific elongation factor (selB) |
| 1991 | 55 | cytoplasm | selenocysteine-specific elongation factor (selB) or translation elongation factor Tu tufA |
| 1992 | 461 | inner 1 | L-seryl-tRNA selenium transferase (selA) |
| 1993 | 861 | inner 1 | DNA mismatch repair protein (mutS) |
| 1995 | 74 | inner 2 | tryptophan-specific transport protein (mtr) |
| 1996 | 339 | inner 5 | tryptophan-specific transport protein (mtr) |
| 1997 | 81 | inner 2 | ATP synthase F0, subunit a (atpB) |
| 1998 | 88 | inner 1 | ATP synthase F0, subunit c (atpE) |
| 1999 | 156 | periplasmic | ATP synthase F0, subunit b (atpF) |
| 2000 | 144 | cytoplasm | ATP synthase F1, subunit delta (atpH) |
| 2001 | 41 | inner 0 | ATP synthase F1, subunit delta (atpH) |
| 2002 | 513 | cytoplasm | ATP synthase F1, subunit alpha (atpA) |
| 2003 | 289 | cytoplasm | ATP synthase F1, subunit gamma (atpG) |
| 2005 | 76 | inner 1 | ATP synthase F1, subunit beta (atpD) |
| 2007 | 372 | cytoplasm | ATP synthase F1, subunit beta (atpD) |
| 2008 | 147 | inner 1 | ATP synthase F1, subunit epsilon (atpC) |
| 2009 | 54 | inner 1 | tyrosine-specific transport protein (tyrP) |
| 2010 | 117 | inner 1 | ribosomal protein L20 (rpL20) |
| 2011 | 77 | cytoplasm | exodeoxyribonuclease V, beta chain (recB) |
| 2012 | 1086 | cytoplasm | exodeoxyribonuclease V, beta chain (recB) |
| 2013 | 288 | cytoplasm | exodeoxyribonuclease V, alpha chain (recD) |
| 2014 | 47 | cytoplasm | exodeoxyribonuclease V, alpha chain (recD) |
| 2016 | 194 | cytoplasm | exodeoxyribonuclease V, alpha chain (recD) |
| 2021 | 107 | cytoplasm | virulence associated protein A (vapA) |
| 2022 | 556 | cytoplasm | ABC transporter, ATP-binding protein |
| 2028 | 435 | cytoplasm | transcription-repair coupling factor (mfd) |
| 2029 | 228 | cytoplasm | transcription-repair coupling factor (mfd) |
| 2030 | 392 | cytoplasm | transcription-repair coupling factor (mfd) |
| 2031 | 36 | cytoplasm | transcription-repair coupling factor (mfd) |
| 2032 | 86 | cytoplasm | leucyl-tRNA synthetase (leuS) |
| 2034 | 688 | cytoplasm | leucyl-tRNA synthetase (leuS) |
| 2036 | 281 | cytoplasm | undecaprenyl diphosphate synthase |
| 2038 | 288 | inner 7 | CDP-diglyceride synthetase (cdsA) |
| 2041 | 283 | inner 2 | protective surface antigen D15 Omp85 |
| 2044 | 256 | cytoplasm | RNA polymerase sigma-70 factor (rpoD) |
| 2045 | 300 | cytoplasm | RNA polymerase sigma-70 factor (rpoD) |
| 2046 | 347 | cytoplasm | DNA primase (dnaG) |
| 2047 | 191 | cytoplasm | DNA primase (dnaG) |
| 2048 | 52 | cytoplasm | DNA primase (dnaG) |
| 2049 | 71 | cytoplasm | ribosomal protein S21 (rpS21) |
| 2050 | 342 | inner 1 | O-sialoglycoprotein endopeptidase (gcp) |
| 2051 | 206 | cytoplasm | thymidine kinase (tdk) |
| 2052 | 406 | inner 10 | tyrosine-specific transport protein (tyrP) or tryptophan transporter mtr |
| 2053 | 86 | cytoplasm | ferredoxin, 4Fe—4S bacterial type (fdx-2) |
| 2058 | 263 | cytoplasm | phosphoglycerate kinase (pgk) |
| 2059 | 81 | cytoplasm | phosphoglycerate kinase (pgk) |
| 2061 | 207 | cytoplasm | amino acid ABC transporter, ATP-binding protein |
| 2062 | 79 | inner 0 | amino acid ABC transporter, ATP-binding protein |
| 2065 | 230 | inner 4 | ribonuclease BN (rbn) |
| 2066 | 53 | cytoplasm | ribonuclease BN (rbn) |
| 2070 | 273 | inner 1 | uridine phosphorylase (udp) |
| 2071 | 438 | inner 9 | transport protein |
| 2073 | 568 | inner 1 | 2-succinyl-6-hydroxy-2,4-cyclohexadiene-1-carboxylate |
| 2074 | 185 | cytoplasm | menaquinone-specific isochorismate synthase (menF) or anthranilate synthase component I trpE |
| 2076 | 679 | cytoplasm | excinuclease ABC, subunit B (uvrB) |

TABLE III-continued

Annotations

| NTH | aa | PSORT | Annotation |
|---|---|---|---|
| 2079 | 756 | inner 4 | malate oxidoreductase |
| 2081 | 238 | inner 5 | tyrosine-specific transport protein (tyrP) or tryptophan transporter mtr |
| 2083 | 228 | inner 0 | phosphoribosyl-AMP cyclohydrolase/phosphoribosyl-ATP |
| 2084 | 258 | cytoplasm | hisF cyclase (hisF) |
| 2085 | 249 | cytoplasm | phosphoribosylformimino-5-aminoimidazole carboxamide |
| 2086 | 199 | cytoplasm | amidotransferase (hisH) |
| 2087 | 381 | cytoplasm | imidazoleglycerol-phosphate dehydratase/ |
| 2088 | 367 | cytoplasm | histidinol-phosphate aminotransferase (hisC) |
| 2089 | 427 | inner 1 | histidinol dehydrogenase (hisD) |
| 2090 | 35 | cytoplasm | ATP phosphoribosyltransferase (hisG) |
| 2091 | 199 | inner 1 | biotin operon repressor/biotin acetyl coenzyme A or BirA protein/Bvg accessory factor |
| 2092 | 488 | inner 1 | inosine-5'-monophosphate dehydrogenase (guaB) |
| 2094 | 523 | inner 1 | GMP synthase (guaA) |
| 2095 | 296 | inner 7 | rarD protein |
| 2097 | 168 | inner 0 | transcriptional regulator |
| 2099 | 321 | inner 10 | Na+/H+ antiporter (nhaA) |
| 2100 | 32 | cytoplasm | hemolysin |
| 2101 | 522 | inner 7 | apolipoprotein N-acyltransferase (cutE) |
| 2106 | 193 | cytoplasm | recombination associated protein RdgC rdgC |
| 2108 | 105 | cytoplasm | recombination associated protein RdgC rdgC |
| 2110 | 290 | cytoplasm | integrase/recombinase |
| 2115 | 158 | inner 4 | colicin V production protein (cvpA) |
| 2118 | 441 | inner 2 | acetate kinase (ackA) |
| 2119 | 331 | periplasmic | phosphate acetyltransferase (pta) |
| 2120 | 403 | inner 1 | phosphate acetyltransferase (pta) |
| 2122 | 314 | inner 1 | adenine specific methylase |
| 2123 | 323 | cytoplasm | cys regulon transcriptional activator (cysB) |
| 2124 | 71 | cytoplasm | phosphoribosylaminoimidazole carboxylase, catalytic subunit |
| 2126 | 362 | inner 1 | phosphoribosylaminoimidazole carboxylase, ATPase subunit |
| 2127 | 396 | cytoplasm | aspartate aminotransferase (aspC) |
| 2128 | 220 | inner 1 | spermidine/putrescine ABC transporter, ATP-binding |
| 2134 | 152 | cytoplasm | mercuric resistance operon regulatory protein (merR2) |
| 2138 | 560 | inner 10 | PTS system, fructose-specific IIBC component (fruA) |
| 2139 | 313 | cytoplasm | 1-phosphofructokinase (fruK) or ADP-heptose synthase |
| 2140 | 499 | cytoplasm | PTS system, fructose-specific IIA/FPr component (fruB) |
| 2143 | 92 | cytoplasm | virulence associated protein D (vapD) |
| 2146 | 101 | inner 1 | hypoxanthine phosphoribosyltransferase (hpt) |
| 2147 | 451 | cytoplasm | pmbA protein (pmbA) |
| 2151 | 241 | cytoplasm | ABC transporter, ATP-binding protein |
| 2152 | 164 | cytoplasm | nitrogen regulatory IIA protein (ptsN) |
| 2155 | 202 | cytoplasm | chorismate mutase/prephenate dehydratase (pheA) |
| 2157 | 148 | cytoplasm | ABC transporter, ATP-binding protein |
| 2158 | 192 | cytoplasm | histidinol-phosphatase |
| 2160 | 221 | cytoplasm | 5,10 methylenetetrahydrofolate reductase (metF) |
| 2161 | 89 | cytoplasm | dethiobiotin synthase (bioD-1) |
| 2162 | 313 | inner 5 | TRK system potassium uptake protein (trkH) or bis(5'-nucleosyl)-tetraphosphatase, symmetrical/Trk |
| 2163 | 191 | inner 3 | TRK system potassium uptake protein (trkH) or bis(5'-nucleosyl)-tetraphosphatase, symmetrical/Trk |
| 2166 | 288 | inner 4 | heat shock protein (htpX) |
| 2168 | 130 | cytoplasm | ribonuclease |
| 2169 | 244 | inner 0 | lipoprotein (vacJ) |
| 2172 | 185 | cytoplasm | transcription antitermination protein (nusG) |
| 2173 | 138 | inner 3 | preprotein translocase SecE subunit (secE) |
| 2175 | 411 | cytoplasm | ATP-dependent Clp protease, ATP-binding subunit (clpX) |
| 2176 | 211 | cytoplasm | ATP-dependent Clp protease, proteolytic subunit (clpP) |
| 2177 | 394 | cytoplasm | trigger factor (tig) |
| 2178 | 52 | cytoplasm | trigger factor (tig) |
| 2180 | 89 | cytoplasm | ribosomal protein S20 (rpS20) |
| 2181 | 524 | inner 11 | virulence factor (mviN) |
| 2182 | 312 | cytoplasm | riboflavin kinase/FMN adenylyltransferase (ribF) |
| 2183 | 484 | inner 1 | isoleucyl-tRNA synthetase ileS |
| 2184 | 485 | cytoplasm | isoleucyl-tRNA synthetase ileS |
| 2185 | 102 | cytoplasm | hit-related protein |
| 2186 | 184 | cytoplasm | lipoprotein |
| 2187 | 393 | periplasmic | penicillin-binding protein 5 (dacA) |
| 2189 | 212 | cytoplasm | lipoate biosynthesis protein B (lipB) |
| 2190 | 320 | cytoplasm | lipoate biosynthesis protein A (lipA) |
| 2191 | 335 | inner 1 | citrate lyase ligase (citC) |
| 2192 | 95 | cytoplasm | citrate lyase, gamma chain (citD) |
| 2193 | 291 | inner 0 | citrate lyase, beta chain (citE) |
| 2195 | 500 | inner 1 | citrate lyase, alpha chain (citF) |
| 2196 | 416 | inner 1 | citG protein (citG) |
| 2200 | 256 | inner 1 | heme-hemopexin utilization protein A (hxuA) |

TABLE III-continued

Annotations

| NTH | aa | PSORT | Annotation |
|---|---|---|---|
| 2202 | 458 | cytoplasm | DNA repair protein (radA) |
| 2204 | 166 | inner 1 | leucine responsive regulatory protein (lrp) |
| 2205 | 554 | inner 5 | cell division protein FtsK ftsK-1 |
| 2208 | 169 | cytoplasm | polypeptide deformylase (def) |
| 2209 | 318 | inner 1 | methionyl-tRNA formyltransferase (fmt) |
| 2211 | 450 | cytoplasm | sun protein (sun) or 16S RNA methyltransferase rsmB |
| 2212 | 458 | cytoplasm | TRK system potassium uptake protein (trkA) |
| 2213 | 134 | inner 2 | large conductance mechanosensitive channel (mscL) |
| 2215 | 40 | cytoplasm | RNA polymerase sigma-E factor (rpoE) |
| 2231 | 347 | inner 1 | lipopolysaccharide biosynthesis protein or ADP-heptose-LPS heptosyltransferase II rfaF |
| 2232 | 539 | outer | heme-hemopexin utilization protein C or iron-regulated outer membrane protein FrpB frpB |
| 2233 | 170 | cytoplasm | heme-hemopexin utilization protein C |
| 2234 | 565 | outer | heme-hemopexin utilization protein B (hxuB) |
| 2235 | 758 | outer-hand | heme-hemopexin utilization protein A (hxuA) |
| 2236 | 231 | cytoplasm | DNA ligase ligA-2 |
| 2238 | 327 | cytoplasm | dipeptide ABC transporter, ATP-binding protein (dppF) |
| 2241 | 330 | cytoplasm | dipeptide ABC transporter, ATP-binding protein (dppD) |
| 2242 | 295 | inner 6 | dipeptide ABC transporter, permease protein (dppC) or thiol:disulfide interchange protein DsbD dsbD |
| 2043 | 333 | inner 5 | dipeptide ABC transporter, permease protein (dppB) |
| 2246 | 727 | cytoplasm | DNA helicase II (uvrD) |
| 2249 | 141 | cytoplasm | 6-pyruvoyl tetrahydrobiopterin synthase |
| 2250 | 227 | inner 0 | aluminum resistance protein |
| 2252 | 184 | cytoplasm | branched-chain-amino-acid transaminase (ilvE) |
| 2259 | 898 | inner 1 | exodeoxyribonuclease V, gamma chain (recC) |
| 2260 | 163 | cytoplasm | exodeoxyribonuclease V, gamma chain (recC) |
| 2262 | 372 | inner 1 | riboflavin biosynthesis protein (ribD) |
| 2263 | 357 | inner 1 | protease (degS) |
| 2274 | 192 | inner 0 | molybdopterin-guanine dinucleotide biosynthesis protein |
| 2277 | 216 | periplasmic | periplasmic oxidoreductase (por) or thiol:disulfide interchange protein DsbA dsbA-2 |
| 2280 | 363 | cytoplasm | tRNA (uracil-5-)-methyltransferase (trmA) |
| 2282 | 125 | inner 1 | sigma-E factor regulatory protein |
| 2283 | 33 | cytoplasm | sigma-E factor regulatory protein |
| 2285 | 178 | inner 0 | molybdopterin-guanine dinucleotide biosynthesis protein B |
| 2289 | 652 | cytoplasm | ATP-dependent Clp protease, ATPase subunit (clpB) |
| 2293 | 156 | cytoplasm | DNA polymerase I (polA) |
| 2294 | 785 | cytoplasm | DNA polymerase I (polA) |
| 2299 | 507 | inner 0 | N utilization substance protein A (nusA) |
| 2301 | 855 | cytoplasm | translation initiation factor 2 (infB) |
| 2303 | 466 | cytoplasm | type I restriction enzyme (hsdR) |
| 2304 | 285 | cytoplasm | type I restriction enzyme (hsdR) |
| 2307 | 518 | cytoplasm | anthranilate synthase component I (trpE) |
| 2308 | 195 | cytoplasm | anthranilate synthase component II (trpG) or para-aminobenzoate synthase glutamine |
| 2311 | 84 | cytoplasm | anthanilate phosphoribosyltransferase (trpD) |
| 2313 | 231 | cytoplasm | anthanilate phosphoribosyltransferase (trpD) |
| 2314 | 477 | cytoplasm | indole-3-glycerol phosphate synthase/ |
| 2317 | 239 | cytoplasm | valyl-tRNA synthetase (valS) |
| 2318 | 425 | inner 1 | valyl-tRNA synthetase (valS) |
| 2319 | 35 | cytoplasm | valyl-tRNA synthetase (valS) |
| 2321 | 150 | cytoplasm | valyl-tRNA synthetase (valS) |
| 2322 | 102 | cytoplasm | valyl-tRNA synthetase (valS) |
| 2324 | 42 | inner 1 | transport protein |
| 2325 | 238 | cytoplasm | purine-nucleoside phosphorylase (deoD) or 5-methylthioadenosine |
| 2327 | 142 | inner 0 | ribosomal protein L11 (rpL11) |
| 2328 | 229 | cytoplasm | ribosomal protein L1 (rpL1) |
| 2329 | 1298 | cytoplasm | DNA-directed RNA polymerase, beta chain (rpoB) |
| 2331 | 158 | cytoplasm | iron(III) ABC transporter, periplasmic-binding protein |
| 2333 | 506 | inner 11 | iron(III) ABC transporter, permease protein (hitB) |
| 2335 | 356 | cytoplasm | iron(III) ABC transporter, ATP-binding protein (hitC) |
| 2338 | 377 | cytoplasm | succinyl-diaminopimelate desuccinylase (dapE) |
| 2341 | 631 | cytoplasm | heat shock protein (htpG) |
| 2344 | 106 | periplasmic | organic solvent tolerance protein |
| 2345 | 667 | cytoplasm | organic solvent tolerance protein |
| 2346 | 572 | inner 1 | prolyl-tRNA synthetase (proS) |
| 2347 | 630 | inner 1 | ATP-dependent DNA helicase (recQ) |
| 2348 | 113 | cytoplasm | cyaY protein (cyaY) |
| 2350 | 415 | cytoplasm | diaminopimelate decarboxylase (lysA) |
| 2351 | 208 | cytoplasm | nitrate/nitrite response regulator protein (narP) or transcriptional regulator, LuxR family |
| 2354 | 203 | cytoplasm | pseudouridine synthase RluD (rluD) or ribosomal large subunit pseudouridine synthase D |

TABLE III-continued

Annotations

| NTH | aa | PSORT | Annotation |
|---|---|---|---|
| 2356 | 272 | lipo | lipoprotein or competence lipoprotein ComL comL |
| 2359 | 246 | cytoplasm | pyruvate formate-lyase activating enzyme (act) |
| 2360 | 772 | cytoplasm | formate acetyltransferase (pfl) |
| 2361 | 286 | inner 6 | formate transporter |
| 2365 | 276 | inner 2 | sugar kinase |
| 2368 | 377 | inner 5 | amino acid carrier protein |
| 2371 | 158 | inner 0 | YgbB/YacN family protein |
| 2373 | 146 | cytoplasm | mioC protein (mioC) or sulfite reductase (NADPH) flavoprotein, alpha |
| 2376 | 333 | inner 1 | glpX protein (glpX) |
| 2381 | 551 | inner 6 | ABC transporter, ATP-binding protein |
| 2382 | 360 | inner 2 | ATP-binding transport protein (cydD) |
| 2383 | 228 | cytoplasm | heat shock protein (grpE) |
| 2385 | 520 | cytoplasm | DNA repair protein (recN) |
| 2387 | 38 | cytoplasm | DNA repair protein (recN) |
| 2388 | 981 | inner 1 | glutamate-ammonia-ligase adenylyltransferase (glnE) |
| 2389 | 311 | cytoplasm | tRNA delta(2)-isopentenylpyrophosphate transferase (trpX) |
| 2390 | 390 | cytoplasm | DNA mismatch repair protein (mutL) |
| 2391 | 123 | cytoplasm | thymidylate synthetase (thyA) |
| 2392 | 173 | cytoplasm | cytidine and deoxycytidylate deaminase family |
| 2395 | 545 | cytoplasm | preprotein translocase SecA subunit (secA) |
| 2396 | 363 | cytoplasm | preprotein translocase SecA subunit (secA) |
| 2397 | 163 | cytoplasm | mutator mutT protein (mutT) |
| 2398 | 618 | inner 10 | glutathione-regulated potassium efflux system protein (kefC) |
| 2399 | 254 | cytoplasm | 3-demethylubiquinone-9 3-methyltransferase ubiG |
| 2401 | 245 | cytoplasm | ribosomal protein S2 (rpS2) |
| 2402 | 71 | inner 1 | preprotein translocase SecY subunit (secY) |
| 2403 | 144 | cytoplasm | ribosomal protein L15 (rpL15) |
| 2404 | 59 | cytoplasm | ribosomal protein L30 (rpL30) |
| 2405 | 267 | inner 1 | glucosamine-fructose-6-phosphate aminotransferase (glmS) |
| 2406 | 177 | inner 3 | disulfide bond formation protein B (dsbB) |
| 2407 | 238 | inner 5 | Na+/H+ antiporter (nhaB) |
| 2408 | 292 | inner 5 | Na+/H+ antiporter (nhaB) |
| 2410 | 241 | cytoplasm | fatty acid metabolism regulator protein (fadR) |
| 2411 | 455 | cytoplasm | phosphatidylserine synthase (pssA) or cardiolipin synthetase family protein |
| 2412 | 201 | cytoplasm | rRNA methylase |
| 2413 | 232 | cytoplasm | adenine specific methylase |
| 2415 | 122 | cytoplasm | ATP-dependent RNA helicase SrmB (srmB) |
| 2416 | 287 | cytoplasm | ATP-dependent RNA helicase SrmB (srmB) |
| 2417 | 231 | cytoplasm | protease |
| 2418 | 203 | cytoplasm | ATP phosphoribosyltransferase (hisG) |
| 2421 | 410 | cytoplasm | D-3-phosphoglycerate dehydrogenase (serA) |
| 2422 | 219 | inner 1 | ribose 5-phosphate isomerase A (rpiA) |
| 2423 | 383 | cytoplasm | oxygen-independent coproporphyrinogen III oxidase |
| 2424 | 658 | cytoplasm | ATP-dependent proteinase (lon) |
| 2428 | 298 | cytoplasm | transcriptional regulator, araC family |
| 2429 | 38 | cytoplasm | ABC transporter, ATP-binding protein |
| 2430 | 576 | inner 4 | ABC transporter, ATP-binding protein |
| 2432 | 92 | periplasmic | mercuric ion scavenger protein (merP) |
| 2433 | 120 | inner 3 | mercuric ion transport protein (merT) |
| 2435 | 472 | cytoplasm | anaerobic dimethyl sulfoxide reductase, chain A (dmsA) |
| 2436 | 352 | cytoplasm | anaerobic dimethyl sulfoxide reductase, chain A (dmsA) |
| 2437 | 205 | cytoplasm | anaerobic dimethyl sulfoxide reductase, chain B (dmsB) |
| 2438 | 279 | inner 7 | anaerobic dimethyl sulfoxide reductase, chain C (dmsC) |
| 2440 | 166 | cytoplasm | ferredoxin-type protein (napF) or NADH dehydrogenase I, I subunit nuoI |
| 2443 | 133 | cytoplasm | 2-isopropylmalate synthase (leuA) |
| 2445 | 358 | cytoplasm | 3-isopropylmalate dehydrogenase (beta-IPM dehydrogenase) |
| 2446 | 469 | cytoplasm | 3-isopropylmalate dehydratase, alpha subunit (leuC) |
| 2447 | 200 | inner 0 | 3-isopropylmalate dehydratase small subunit (leuD) |
| 2448 | 1794 | outer-hand | immunoglobin A1 protease (iga1) or IgA-specific serine endopeptidase iga |
| 2449 | 378 | cytoplasm | DNA/ATP binding protein (recF) |
| 2450 | 366 | cytoplasm | DNA polymerase III, beta subunit (dnaN) |
| 2452 | 454 | cytoplasm | chromosomal replication initiator protein (dnaA) |
| 2453 | 118 | cytoplasm | transferrin-binding protein 1 precursor (tbp1) |
| 2454 | 231 | cytoplasm | transferrin-binding protein 1 precursor (tbp1) |
| 2457 | 199 | inner 1 | baseplate assembly protein V |
| 2462 | 861 | cytoplasm | tail fibre protein |
| 2476 | 69 | cytoplasm | aspartokinase I/homoserine dehydrogenase I (thrA) |
| 2477 | 307 | cytoplasm | aspartokinase I/homoserine dehydrogenase I (thrA) |
| 2478 | 314 | inner 1 | homoserine kinase (thrB) |
| 2479 | 425 | cytoplasm | threonine synthase (thrC) |
| 2480 | 238 | cytoplasm | integrase/recombinase (xerC) |
| 2491 | 176 | cytoplasm | ferredoxin-type 4Fe—4S protein (napF) |
| 2492 | 93 | cytoplasm | napD protein (napD) |
| 2493 | 832 | outer-hand | Formate dehydrogenase major subunit |
| 2494 | 279 | cytoplasm | ferredoxin-type protein (napG) |

TABLE III-continued

Annotations

| NTH | aa | PSORT | Annotation |
|---|---|---|---|
| 2495 | 287 | inner 4 | ferredoxin-type 4Fe—4S protein (napH) |
| 2496 | 150 | periplasmic | periplasmic nitrate reductase (napB) |
| 2497 | 200 | inner 1 | cytochrome C-type protein (napC) |
| 2498 | 214 | inner 0 | adenylate kinase (adk) |
| 2499 | 412 | inner 10 | permease or AmpG-related protein |
| 2501 | 241 | inner 0 | UDP-glucose 4-epimerase (galE) |
| 2502 | 82 | cytoplasm | UDP-glucose 4-epimerase (galE) |
| 2504 | 244 | cytoplasm | iron(III) ABC transporter, ATP-binding protein fbpC |
| 2505 | 176 | inner 4 | ABC transporter, permease protein |
| 2508 | 241 | periplasmic | FkbP-type peptidyl-prolyl cis-trans isomerase (fkpA) or macrophage infectivity potentiator |
| 2509 | 73 | cytoplasm | slyX protein (slyX) |
| 2511 | 33 | cytoplasm | peroxiredoxin 2 family protein/glutaredoxin |
| 2512 | 48 | cytoplasm | peroxiredoxin 2 family protein/glutaredoxin |
| 2513 | 117 | cytoplasm | peroxiredoxin 2 family protein/glutaredoxin |
| 2514 | 301 | cytoplasm | hydrogen peroxide-inducible genes activator (oxyR) or transcriptional regulator, LysR family |
| 2517 | 158 | cytoplasm | transcription elongation factor (greB) |
| 2518 | 770 | cytoplasm | transcription accessory protein (tex) |
| 2519 | 736 | cytoplasm | DNA gyrase, subunit B (gyrB) |
| 2520 | 59 | cytoplasm | DNA gyrase, subunit B (gyrB) |
| 2521 | 234 | cytoplasm | ribulose-phosphate 3-epimerase (dod) |
| 2522 | 224 | cytoplasm | phosphoglycolate phosphatase (gph) |
| 2530 | 132 | cytoplasm | transposase |
| 2531 | 369 | inner 8 | multidrug resistance protein B (emrB) or fatty acid efflux system protein farB |
| 2532 | 256 | inner 1 | cell division protein (ftsN) |
| 2533 | 1032 | inner 12 | acriflavine resistance protein (acrB) or multiple transferable resistance system protein MtrD |
| 2534 | 419 | inner 1 | lipoprotein or membrane fusion protein mtrC |
| 2535 | 196 | cytoplasm | transcriptional repressor (Bm3R1) or trancscriptional regulator MtrR mtrR |
| 2538 | 418 | cytoplasm | ATP-dependent RNA helicase (rhlB) |
| 2541 | 210 | periplasmic | kinase |
| 2542 | 421 | inner 1 | serine hydroxymethyltransferase (serine methylase) (glyA) |
| 2543 | 478 | inner 3 | YhbX/YhjW/YijP/YjdB family protein |
| 2544 | 85 | cytoplasm | phosphoribosylamine-glycine ligase (purD) |
| 2545 | 101 | inner 1 | cell division protein (ftsQ) |
| 2546 | 306 | inner 0 | D-alanine-D-alanine ligase (ddlB) |
| 2548 | 475 | inner 2 | UDP-N-acetylmuramate-alanine ligase (murC) |
| 2550 | 351 | inner 1 | UDP-N-acetylglucosamine-N-acetylmuramyl-(pentapeptide) |
| 2552 | 394 | inner 9 | cell division protein (ftsW) |
| 2553 | 437 | cytoplasm | UDP-N-acetylmuramoylalanine-D-glutamate ligase (murD) |
| 2554 | 360 | inner 10 | phospho-N-acetylmuramoyl-pentapeptide-transferase E (mraY) |
| 2555 | 457 | cytoplasm | UDP-MurNAc-pentapeptide synthetase (murF) |
| 2556 | 488 | inner 1 | UDP-N-acetylmuramyl-tripeptide synthetase (murE) |
| 2557 | 610 | inner 1 | penicillin-binding protein 3 (ftsI) |
| 2558 | 107 | inner 1 | cell division protein (ftsL) |
| 2561 | 208 | cytoplasm | fuculokinase (fucK) |
| 2564 | 68 | cytoplasm | transcriptional regulatory protein (asnC) |
| 2569 | 269 | inner 0 | sulfite synthesis pathway protein (cysQ) or inositol monophosphatase family protein |
| 2570 | 474 | inner 0 | glucose-6-phosphate 1-dehydrogenase (zwf) |
| 2571 | 245 | cytoplasm | oxidoreductase (devB) |
| 2577 | 392 | inner 1 | 6-phosphogluconate dehydrogenase, decarboxylating (gnd) |
| 2578 | 76 | inner 0 | 6-phosphogluconate dehydrogenase, decarboxylating (gnd) |
| 2581 | 275 | cytoplasm | diadenosine-tetraphosphatase (apaH) or bis(5'-nucleosyl)-tetraphosphatase, symmetrical/Trk |
| 2582 | 312 | cytoplasm | lipooligosaccharide biosynthesis protein or lacto-N-neotetraose biosynthesis glycosyl |
| 2583 | 287 | cytoplasm | dimethyladenosine transferase (ksgA) |
| 2584 | 253 | cytoplasm | lipopolysaccharide glycosyl transferase |
| 2585 | 65 | cytoplasm | lipopolysaccharide glycosyl transferase |
| 2586 | 84 | cytoplasm | translation initiation factor 1 (infA) |
| 2587 | 480 | inner 8 | glycerol-3-phosphatase transporter (glpT) |
| 2588 | 364 | lipo | glycerophosphoryl diester phosphodiesterase (glpQ) |
| 2591 | 217 | inner 4 | glycerol uptake facilitator protein (glpF) |
| 2592 | 503 | cytoplasm | glycerol kinase (glpK) |
| 2593 | 155 | inner 1 | xanthine-guanine phosphoribosyltransferase (gptB) |
| 2594 | 45 | cytoplasm | glycerophosphoryl diester phosphodiesterase (glpQ) |
| 2595 | 274 | lipo | lipoprotein E (hel) |
| 2597 | 132 | inner 1 | exopolyphosphatase |
| 2598 | 212 | cytoplasm | exopolyphosphatase |
| 2600 | 133 | inner 1 | peptide chain release factor 3 (prfC) |
| 2606 | 309 | cytoplasm | transcriptional activator (metR) |
| 2610 | 89 | periplasmic | pyrroline-5-carboxylate reductase (proC) |

TABLE III-continued

Annotations

| NTH | aa | PSORT | Annotation |
|---|---|---|---|
| 2612 | 189 | inner 0 | pyrroline-5-carboxylate reductase (proC) |
| 2617 | 297 | cytoplasm | integrase/recombinase (xerD) |
| 2619 | 335 | cytoplasm | Holliday junction DNA helicase (ruvB) |
| 2620 | 204 | cytoplasm | Holliday junction DNA helicase (ruvA) |
| 2621 | 190 | cytoplasm | crossover junction endodeoxyribonuclease (ruvC) |
| 2623 | 156 | cytoplasm | datP pyrophosphohydrolase (ntpA) |
| 2625 | 588 | cytoplasm | aspartyl-tRNA synthetase (aspS) |
| 2629 | 78 | cytoplasm | virulence associated protein B (vapB) |
| 2630 | 134 | cytoplasm | virulence associated protein C |
| 2631 | 135 | cytoplasm | lactoylglutathione lyase (gloA) |
| 2632 | 229 | cytoplasm | ribonuclease T (rnt) |
| 2636 | 188 | cytoplasm | translation elongation factor P (efp) |
| 2640 | 431 | inner 1 | opacity associated protein (oapA) |
| 2641 | 134 | lipo | opacity associated protein (oapB) |
| 2642 | 236 | cytoplasm | DNA repair protein (recO) |
| 2643 | 438 | cytoplasm | tRNA (uracil-5-)-methyltransferase trmA |
| 2644 | 651 | cytoplasm | elongation factor G (fusA) |
| 2646 | 394 | cytoplasm | elongation factor Tu (tufB) |
| 2647 | 75 | inner 2 | chloride channel protein-related protein |
| 2649 | 245 | inner 3 | chloride channel protein-related protein |
| 2654 | 336 | cytoplasm | tryptophanyl-tRNA synthetase (trpS) |
| 2657 | 92 | cytoplasm | adenylosuccinate lyase (purB) |
| 2659 | 364 | cytoplasm | adenylosuccinate lyase (purB) |
| 2660 | 163 | cytoplasm | ribosomal protein L10 (rpL10) |
| 2661 | 126 | inner 0 | ribosomal protein L7/L12 (rpL7/L12) |
| 2663 | 456 | inner 0 | UDP-N-acetylglucosamine pyrophosphorylase (glmU) |
| 2665 | 311 | cytoplasm | lysophospholipase L2 (pldB) |
| 2666 | 371 | cytoplasm | aspartate-semialdehyde dehydrogenase (asd) |
| 2667 | 243 | inner 4 | transport protein |
| 2670 | 136 | cytoplasm | modulator of drug activity B (mdaB) |
| 2671 | 42 | cytoplasm | modulator of drug activity B (mdaB) |
| 2672 | 676 | cytoplasm | ATP-dependent DNA helicase (rep) |
| 2674 | 156 | inner 1 | lipopolysaccharide core biosynthesis protein (kdtB) |
| 2675 | 427 | inner 2 | 3-deoxy-d-manno-octulosonic-acid transferase (kdtA) |
| 2676 | 254 | cytoplasm | lipopolysaccharide biosynthesis protein or beta-1,4-glucosyltransferase lgtF |
| 2678 | 192 | cytoplasm | DNA-3-methyladenine glycosidase I (tagI) |
| 2680 | 268 | inner 1 | shikimate 5-dehydrogenase (aroE) |
| 2682 | 178 | cytoplasm | DNA topoisomerase I topA |
| 2683 | 63 | cytoplasm | ABC transporter, ATP-binding protein |
| 2685 | 115 | cytoplasm | anaerobic ribonucleoside-triphosphate reductase (nrdD) |
| 2686 | 272 | cytoplasm | anaerobic ribonucleoside-triphosphate reductase (nrdD) |
| 2687 | 286 | cytoplasm | acyl-CoA thioesterase II (tesB) |
| 2688 | 469 | cytoplasm | cysteinyl-tRNA synthetase (cysS) |
| 2689 | 169 | cytoplasm | peptidyl-prolyl cis-trans isomerase B (ppiB) |
| 2698 | 107 | cytoplasm | thioredoxin (trxM) |
| 2701 | 335 | inner 1 | D-lactate dehydrogenase, fermentative (ldhA) |
| 2702 | 393 | inner 1 | cystathionine gamma-synthase (metB) |
| 2703 | 175 | inner 1 | ParA family protein |
| 2705 | 451 | periplasmic | replicative DNA helicase (dnaB) |
| 2714 | 140 | cytoplasm | single-stranded DNA binding protein (ssb) |
| 2717 | 686 | cytoplasm | DNA topoisomerase III (topB) |
| 2722 | 156 | cytoplasm | DNA repair protein (radC) |
| 2733 | 150 | cytoplasm | mutT protein mutT |
| 2735 | 170 | inner 3 | transport protein |
| 2736 | 280 | cytoplasm | aspartate ammonia-lyase (aspA) |
| 2738 | 236 | periplasmic | aspartokinase I/homoserine dehydrogenase I (thrA) |
| 2739 | 317 | cytoplasm | transaldolase B (talB) |
| 2740 | 217 | inner 1 | glyceraldehyde-3-phosphate dehydrogenase (gapdH) |
| 2741 | 34 | cytoplasm | inner membrane protein, 60 kDa (yidC) |
| 2742 | 204 | cytoplasm | inner membrane protein, 60 kDa (yidC) |
| 2745 | 229 | cytoplasm | sufI protein (sufI) |
| 2747 | 167 | cytoplasm | heat shock protein (hslU) or ATP-dependent Clp protease, ATP-binding subunit |
| 2748 | 94 | cytoplasm | spermidine/putrescine ABC transporter, periplasmic-binding |
| 2749 | 287 | inner 8 | drug resistance translocase family protein |
| 2750 | 325 | inner 2 | potassium/copper-transporting ATPase or cation transport ATPase, E1-E2 family |
| 2751 | 349 | cytoplasm | 2-oxoglutarate dehydrogenase E1 component (sucA) |
| 2752 | 34 | cytoplasm | 2-oxoglutarate dehydrogenase E1 component (sucA) |
| 2755 | 38 | inner 1 | serine transporter (sdaC) |
| 2756 | 217 | inner 4 | serine transporter (sdaC) |
| 2758 | 75 | lipo | thermonuclease family protein |
| 2761 | 144 | cytoplasm | orfG protein |
| 2762 | 51 | cytoplasm | methionine aminopeptidase (map) |
| 2763 | 343 | cytoplasm | protein-PII uridylyltransferase glnD |

TABLE III-continued

Annotations

| NTH | aa | PSORT | Annotation |
|---|---|---|---|
| 2764 | 107 | inner 4 | transporter |
| 2765 | 282 | inner 5 | protein-export membrane protein (secF) |
| 2766 | 96 | cytoplasm | recA protein (recA) |
| 2768 | 152 | cytoplasm | regulatory protein (recX) |
| 2769 | 111 | lipo | crcB protein |
| 2772 | 163 | cytoplasm | transcriptional regulatory protein (tyrR) or nitrogen assimilation regulatory protein NtrX ntrX |
| 2774 | 209 | inner 1 | glutathione transferase (bphH) or stringent starvation protein A sspA |
| 2780 | 43 | cytoplasm | CTP synthetase (pyrG) |
| 2782 | 138 | cytoplasm | CTP synthetase (pyrG) |
| 2785 | 167 | cytoplasm | transcriptional regulator |
| 2786 | 93 | cytoplasm | guanylate kinase (gmk) |
| 2788 | 88 | cytoplasm | DNA-directed RNA polymerase, omega chain (rpoZ) |
| 2789 | 84 | cytoplasm | guanosine-3',5'-bis(diphosphate) 3'-pyrophosphohydrolase |
| 2790 | 38 | cytoplasm | guanosine-3',5'-bis(diphosphate) 3'-pyrophosphohydrolase |
| 2792 | 90 | cytoplasm | S-adenosylmethionine:2-demethylmenaquinone methyltransferase |
| 2795 | 120 | cytoplasm | rbs repressor (rbsR) |
| 2801 | 113 | cytoplasm | ferredoxin (fdx-1) or ferredoxin, 2Fe—2S type fdx-2 |
| 2807 | 266 | inner 1 | modification methylase (hindIIIM) |
| 2811 | 350 | cytoplasm | asparaginyl-tRNA synthetase (asnS) or aspartyl-tRNA synthetase aspS |
| 2812 | 31 | cytoplasm | riboflavin synthase, beta chain (ribH) |
| 2813 | 228 | inner 3 | PqiA family protein |
| 2814 | 282 | inner 1 | pqiB protein pqiB |
| 2815 | 112 | cytoplasm | asparaginyl-tRNA synthetase (asnS) or aspartyl-tRNA synthetase aspS |
| 2817 | 128 | cytoplasm | carbonic anhydrase |
| 2818 | 122 | cytoplasm | transcriptional regulatory protein (tyrR) |
| 2825 | 215 | cytoplasm | pqiB protein pqiB |
| 2827 | 194 | cytoplasm | phosphoheptose isomerase gmhA |
| 2831 | 233 | cytoplasm | 28 kDa outer membrane protein (hlpA) |
| 2832 | 33 | cytoplasm | glycerol-3-phosphate regulon repressor (glpR) | aa = length of polypeptide
PSORT = cellular location of polypeptide, according to PSORT algorithm

REFERENCES (THE CONTENTS OF WHICH ARE HEREBY INCORPORATED BY REFERENCE)

[1] Fleischmann et al. (1995) *Science* 269:496-512.
[2] Li et al. (2003) *Mol Microbiol* 47:1101-1111.
[3] GenBank accession NC_000907.
[4] Geysen et al. (1984) *PNAS USA* 81:3998-4002.
[5] Carter (1994) *Methods Mol Biol* 36:207-23.
[6] Jameson, B A et al. 1988, *CABIOS* 4(1):181-186.
[7] Raddrizzani & Hammer (2000) *Brief Bioinform* 1(2):179-89.
[8] De Lalla et al. (1999) *J. Immunol.* 163:1725-29.
[9] Brusic et al. (1998) *Bioinformatics* 14(2):121-30
[10] Meister et al. (1995) *Vaccine* 13(6):581-91.
[11] Roberts et al. (1996) *AIDS Res Hum Retroviruses* 12(7): 593-610.
[12] Maksyutov & Zagrebelnaya (1993) *Comput Appl Biosci* 9(3):291-7.
[13] Feller & de la Cruz (1991) *Nature* 349(6311):720-1.
[14] Hopp (1993) *Peptide Research* 6:183-190.
[15] Welling et al. (1985) *FEBS Lett.* 188:215-218.
[16] Davenport et al. (1995) *Immunogenetics* 42:392-297.
[17] Bodanszky (1993) *Principles of Peptide Synthesis* (ISBN: 0387564314).
[18] Fields et al. (1997) *Meth Enzymol* 289: *Solid-Phase Peptide Synthesis*. ISBN: 0121821900.
[19] Chan & White (2000) *Fmoc Solid Phase Peptide Synthesis*. ISBN: 0199637245.
[20] Kullmann (1987) *Enzymatic Peptide Synthesis*. ISBN: 0849368413.
[21] Ibba (1996) *Biotechnol Genet Eng Rev* 13:197-216.
[22] Breedveld (2000) *Lancet* 355(9205):735-740.
[23] Gorman & Clark (1990) *Semin. Immunol.* 2:457-466.
[24] Sambrook et al. (1989) *Molecular Cloning: A Laboratory Manual.*
[25] *Short protocols in molecular biology* (4th ed, 1999) Ausubel et al. eds. ISBN 0-471-32938-X.
[26] U.S. Pat. No. 5,707,829
[27] *Current Protocols in Molecular Biology* (F. M. Ausubel et al. eds., 1987) Supplement 30.
[28] EP-B-0509612.
[29] EP-B-0505012.
[30] Yadav et al. (2003) *Lett Appl Microbiol* 37(3):190-5.
[31] Singhi et al. (2002) *Ann Trop Paediatr* 22(4):347-53.
[32] Tang et al. (1997) *Clin. Chem.* 43:2021-2038.
[33] *Vaccine Design* . . . (1995) eds. Powell & Newman. ISBN: 030644867X. Plenum.
[34] WO00/23105.
[35] WO90/14837.
[36] U.S. Pat. No. 5,057,540.
[37] WO96/33739.
[38] EP-A-0109942.
[39] WO96/11711.
[40] WO00/07621.
[41] Barr et al. (1998) *Advanced Drug Delivery Reviews* 32:247-271.
[42] Sjolanderet et al. (1998) *Advanced Drug Delivery Reviews* 32:321-338.
[43] Niikura et al (2002) *Virology* 293:273-280.
[44] Lenz et al. (2001) *J Immunol* 166:5346-5355.
[45] Pinto et al. (2003) *J Infect Dis* 188:327-338.

[46] Gerber et al. (2001) *Virol* 75:4752-4760.
[47] WO03/024480
[48] WO03/024481
[49] Gluck et al. (2002) *Vaccine* 20:B10-B16.
[50] EP-A-0689454.
[51] Johnson et al. (1999) *Bioorg Med Chem Lett* 9:2273-2278.
[52] Evans et al. (2003) *Expert Rev Vaccines* 2:219-229.
[53] Meraldi et al. (2003) *Vaccine* 21:2485-2491.
[54] Pajak et al. (2003) *Vaccine* 21:836-842.
[55] Kandimalla et al. (2003) *Nucleic Acids Research* 31:2393-2400.
[56] WO02/26757.
[57] WO99/62923.
[58] Krieg (2003) *Nature Medicine* 9:831-835.
[59] McCluskie et al. (2002) *FEMS Immunology and Medical Microbiology* 32:179-185.
[60] WO98/40100.
[61] U.S. Pat. No. 6,207,646.
[62] U.S. Pat. No. 6,239,116.
[63] U.S. Pat. No. 6,429,199.
[64] Kandimalla et al. (2003) *Biochemical Society Transactions* 31 (part 3):654-658.
[65] Blackwell et al. (2003) *J Immunol* 170:4061-4068.
[66] Krieg (2002) *Trends Immunol* 23:64-65.
[67] WO01/95935.
[68] Kandimalla et al. (2003) *BBRC* 306:948-953.
[69] Bhagat et al. (2003) *BBRC* 300:853-861.
[70] WO03/035836.
[71] WO95/17211.
[72] WO98/42375.
[73] Beignon et al. (2002) *Infect Immun* 70:3012-3019.
[74] Pizza et al. (2001) *Vaccine* 19:2534-2541.
[75] Pizza et al. (2000) *Int J Med Microbiol* 290:455-461.
[76] Scharton-Kersten et al. (2000) *Infect Immun* 68:5306-5313.
[77] Ryan et al. (1999) *Infect Immun* 67:6270-6280.
[78] Partidos et al. (1999) *Immunol Lett* 67:209-216.
[79] Peppoloni et al. (2003) *Expert Rev Vaccines* 2:285-293.
[80] Pine et al. (2002) *J Control Release* 85:263-270.
[81] Domenighini et al. (1995) *Mol Microbiol* 15:1165-1167.
[82] WO99/40936.
[83] WO99/44636.
[84] Singh et al] (2001) *J Cont Release* 70:267-276.
[85] WO99/27960.
[86] U.S. Pat. No. 6,090,406
[87] U.S. Pat. No. 5,916,588
[88] EP-A-0626169.
[89] WO99/52549.
[90] WO01/21207.
[91] WO01/21152.
[92] Andrianov et al. (1998) *Biomaterials* 19:109-115.
[93] Payne et al. (1998) *Adv Drug Delivery Review* 31:185-196.
[94] Stanley (2002) *Clin Exp Dermatol* 27:571-577.
[95] Jones (2003) *Curr Opin Investig Drugs* 4:214-218.
[96] WO99/11241.
[97] WO94/00153.
[98] WO98/57659.
[99] European patent applications 0835318, 0735898 and 0761231.
[100] WO03/009869.
[101] Almeida & Alpar (1996) *J. Drug Targeting* 3:455-467.
[102] Agarwal & Mishra (1999) *Indian J Exp Biol* 37:6-16.
[103] Costantino et al. (1992) *Vaccine* 10:691-698.
[104] Costantino et al. (1999) *Vaccine* 17:1251-1263.
[105] WO03/007985.
[106] Watson (2000) *Pediatr Infect Dis J* 19:331-332.
[107] Rubin (2000) *Pediatr Clin North Am* 47:269-285, v.
[108] Jedrzejas (2001) *Microbiol Mol Biol Rev* 65:187-207.
[109] Bell (2000) *Pediatr Infect Dis J* 19:1187-1188.
[110] Iwarson (1995) *APMIS* 103:321-326.
[111] Gerlich et al. (1990) *Vaccine* 8 Suppl:S63-68 & 79-80.
[112] *Vaccines* (1988) eds. Plotkin & Mortimer. ISBN 0-7216-1946-0.
[113] Del Guidice et al. (1998) *Molecular Aspects of Medicine* 19:1-70.
[114] Gustafsson et al. (1996) *N. Engl. J. Med.* 334:349-355.
[115] Rappuoli et al. (1991) *TIBTECH* 9:232-238.
[116] Sutter et al. (2000) *Pediatr Clin North Am* 47:287-308.
[117] Zimmerman & Spann (1999) *Am Fam Physician* 59:113-118, 125-126.
[118] McMichael (2000) *Vaccine* 19 Suppl 1:S101-107.
[119] Schuchat (1999) *Lancet* 353(9146):51-6.
[120] WO02/34771.
[121] Dale (1999) *Infect Dis Clin North Am* 13:227-43, viii.
[122] Ferretti et al. (2001) *PNAS USA* 98: 4658-4663.
[123] Kuroda et al. (2001) *Lancet* 357(9264):1225-1240; see also pages 1218-1219.
[124] EP-A-0372501
[125] EP-A-0378881
[126] EP-A-0427347
[127] WO93/17712
[128] WO94/03208
[129] WO98/58668
[130] EP-A-0471177
[131] WO00/56360
[132] WO91/01146
[133] WO00/61761
[134] WO01/72337
[135] *Research Disclosure*, 453077 (January 2002)
[136] Needleman & Wunsch (1970) *J. Mol. Biol.* 48, 443-453.
[137] Rice et al. (2000) *Trends Genet.* 16:276-277.
[138] Gennaro (2000) *Remington: The Science and Practice of Pharmacy.* 20th edition, ISBN: 0683306472.
[139] *Methods In Enzymology* (S. Colowick and N. Kaplan, eds., Academic Press, Inc.)
[140] *Handbook of Experimental Immunology*, Vols. I-IV (D. M. Weir and C. C. Blackwell, eds., 1986, Blackwell Scientific Publications)
[141] Sambrook, et al., *Molecular Cloning: A Laboratory Manual* (2nd Edition, 1989).
[142] *Handbook of Surface and Colloidal Chemistry* (Birdi, K. S. ed., CRC Press, 1997)
[143] *Short Protocols in Molecular Biology*, 4th ed. (Ausubel et al. eds., 1999, John Wiley & Sons)
[144] *Molecular Biology Techniques: An Intensive Laboratory Course*, (Ream et al., eds., 1998, Academic Press)
[145] *PCR (Introduction to Biotechniques Series)*, 2nd ed. (Newton & Graham eds., 1997, Springer Verlag)
[146] Mason et al. (2003) *Infect Immun* 71:3454-3462.
[147] Erdile et al. (1993) *Infect Immun* 61:81-90.

SEQUENCE LISTING (5095 sequences)

SEQ ID NO: 1 - DNA, 174 bp, Haemophilus influenzae
  Name: NTH0001
atgcacacagtatcctctgcggggttaggcattaaaacctctcctacacaaaacttaagcctagatgcttttgttgctcgtcgctttgcaaatgccaatagtgacaatttgaatggcaacaaaaaacgcacaagctcacctacaaccttctggggtagattaacattcagtttc

SEQ ID NO: 2 - protein, 58 aa, Haemophilus influenzae
  Name: NTH0001
MHTVSSAGLGIKTSPTQNLSLDAFVARRFANANSDNLNGNKKRTSSPTTFWGRLTFSF

SEQ ID NO: 3 - DNA, 312 bp, Haemophilus influenzae
  n 55, 152, 208, 220, 251, 279: n is any nucleotide
  Name: NTH0002
ttgtggaatcaaacaacaaccaaacttccccgcaaatgcttcaacaatcacccanacctagcctattgcgcttggacaacatatcgaaaaaaagatatgagtttgcttgtcgtgaataatggggattctggaaaaatggatgctaatttggnaggcgttcacgatattgaatttgacgcacccgctcagctagcatatctaccccganaattactcattnattttgccactcgtctcgctaatgcaattancacacttcttttccgacccccgaatggncaaattctggaagaaggggcggttaaagatgaa

SEQ ID NO: 4 - protein, 104 aa, Haemophilus influenzae
  Xaa 19, 51, 70, 74, 84: Xaa is any amino acid
  Name: NTH0002
LWNQTTTKLPRKCFNNHPXLAYCAWTTYRKKDMSLLVVNNGDSGKMDANLXGVHDIEFDAPAQLAYLPRXLLIXFATRLANAIXTLLFRPPNGQILEEGAVKDE

SEQ ID NO: 5 - DNA, 822 bp, Haemophilus influenzae
  Name: NTH0003
atgcagttttccaaaatgcacggattaggtaacgattttgttgtggttgatggagtcactcaaaatgtgttttttactccagaaacgatccgacgtttagccaatcgccattgtggaattgggtttgatcaacttttaattgttgaagctccttacgatcctgaactcgactttcattatagaatttttaatgctgatggaagcgaagtttcgcaatgcggaaatggtgctcgttgttttgctcggtttgtgacattaaaagggctaactaacaaaaaagacatctcggttagcacacaaaagggtaatatggttttgacggtaaaagatgataatcaaattcgtgtgaatatgggcgaaccaatttgggaaccagcaaaaattccatttaccgcaaataaatttgagaaaaattatattctgcgtacagatattcaaaccgtactatgtggtgcagtttcaatggggaatcctcattgtgttgtacaagtagatgatattcaaacagcaaatgttgaacagcttggtcctttgttagaaagccacgaacgttttcctgagcgtgtcaatgctggttttatgcaaatcatcaacaaagaacatattaagcttagagtttatgaacgtggtgctggcgaaactcaagcctgtggaagtggtgcttgtgcagctgttgcagttggaattatgcaaggcttattaaacaacaatgtccaagtagatttaccgggcggttcgctcatgatcgaatggaatggtgttggtcatccactttatatgacaggcgaggcgacccatatttatgatgggtttataactctt

SEQ ID NO: 6 - protein, 274 aa, Haemophilus influenzae
  Name: NTH0003
MQFSKMHGLGNDFVVVDGVTQNVFFTPETIRRLANRHCGIGFDQLLIVEAPYDPELDFHYRIFNADGSEVSQCGNGARCFARFVTLKGLTNKKDISVSTQKGNMVLTVKDDNQIRVNMGEPIWEPAKIPFTANKFEKNYILRTDIQTVLCGAVSMGNPHCVVQVDDIQTANVEQLGPLLESHERFPERVNAGFMQIINKEHIKLRVYERGAGETQACGSGACAAVAVGIMQGLLNNNVQVDLPGGSLMIEWNGVGHPLYMTGEATHIYDGFITL

SEQ ID NO: 7 - DNA, 114 bp, Haemophilus influenzae
  n 64: n is any nucleotide
  Name: NTH0004
ttgcttaaactagagtgctttattgcccatgattttgctgctctttataatgcaaaaatcttgnatttatacaaaggatggaaaaatgcagttttccaaaatgcacggattagg

SEQ ID NO: 8 - protein, 38 aa, Haemophilus influenzae
  Xaa 22: Xaa is any amino acid
  Name: NTH0004
LLKLECFIAHDFAALYNAKILXLYKGWKNAVFQNARIR

SEQ ID NO: 9 - DNA, 102 bp, Haemophilus influenzae
  n 54, 61, 75, 93, 94, 95, 96, 97: n is any nucleotide
  Name: NTH0005
gtgcgggtaaaaataccggtaaattttttaccgcacttttattcatttcttggntaccagnattacatcccaagncgttatttgccgaatatnnnnnttaat

SEQ ID NO: 10 - protein, 34 aa, Haemophilus influenzae
  Xaa 21, 25, 31, 32, 33: Xaa is any amino acid
  Name: NTH0005
VRVKIPVNFLPHFYSFLGYQXYIPXRYLPNXXXN

SEQ ID NO: 11 - DNA, 315 bp, Haemophilus influenzae
  Name: NTH0006
gtgctaggggaaggacgctatattgtgttagcccgtgaaatgactaaaacttgggaaacgattacagggaatacgattaaaaatttacgcgaatggcttttagaagatcccaatcgtacaaaaggcgagatggttttgattgtggaaggcaaaccaaagtctgacaataacgatgaaatttcgccgcaagcggtaaaggcacttgagttaattgcagaagaattgccacttaaaaaagcagcagctatagttgctgagttgtatggttataagaagaatgctttgtatcaatttggattagcgcatttggaaaaa

SEQ ID NO: 12 - protein, 105 aa, Haemophilus influenzae
  Name: NTH0006
VLGEGRYIVLAREMTKTWETITGNTIKNLREWLLEDPNRTKGEMVLIVEGKPKSDNNDEISPQAVKALELIAEELPLKKAAAIVAELYGYKKNALYQFGLAHLEK

SEQ ID NO: 13 - DNA, 183 bp, Haemophilus influenzae
  Name: NTH0007
atgttaaaccaagtttcaaatacattactgacaccaagtaatctttcaactcaaacattactcaatatttttgacattatgtcgcatcgcaatattgattatgccgatctgtattttcaacttagccaagatgaaagttgggtattagaagacggcattataaaagaagggcggttttcatat

SEQ ID NO: 14 - protein, 61 aa, Haemophilus influenzae
  Name: NTH0007
MLNQVSNTLLTPSNLSTQTLLNIFDIMSHRNIDYADLYFQLSQDESWVLEDGIIKEGRFSY

SEQ ID NO: 15 - DNA, 165 bp, Haemophilus influenzae
  n 160, 161, 162, 163, 164: n is any nucleotide
  Name: NTH0009
atgtgcggaagcggtaaagggaatgcgcaagtcaaacaggggaatttgatttcgctatccgcttttaaatgtggaaatcctattgctcgttatgcggcgattaatcctttggaaagtttgactaaagagaaaaaaattgagctattacatttgggttggnnnnnt

SEQ ID NO: 16 - protein, 55 aa, Haemophilus influenzae
  Xaa 54, 55: Xaa is any amino acid
  Name: NTH0009
MCGSGKGNAQVKQGNLISLSAFKCGNPIARYAAINPLESLTKEKKIELLHLGWXX

SEQ ID NO: 17 - DNA, 474 bp, Haemophilus influenzae
  Name: NTH0010
atgacacccgcaattgatttacttaaaaaacaaaaaattccttttatcttgcacacttatgatcatgatccgaataatcaacattttggtgatgaggcagccgaaaaattaggcattgatcctaaccgctcttttaaaaccttacttgtggcggaaaatggcgatcagaaaaaactcgcttgttttgtgcttgcaacggccaatatgctgaatttaaagaaagcagcaaaatctatcggtgtgaaaaaagtggaaatggcggataaagatgcagcacaaaaaagtacaggttatcttgtaggaggaattagcccgctaggtcaaaagaaacgcgtgaaaaccgtgataaattcaaccgcacttgagtttgaaacgatttatgtttcaggcggaaaacgtgggctaagcgtagaaattgcgccacaagatttagcaaaagtattaggtgcagaatttactgatattgttgatgaa

SEQ ID NO: 18 - protein, 158 aa, Haemophilus influenzae
  Name: NTH0010
MTPAIDLLKKQKIPFILHTYDHDPNNQHFGDEAAEKLGIDPNRSFKTLLVAENGDQKKLACFVLATANMLNLKKAAKSIGVKKVEMADKDAAQKSTGYLVGGISPLGQKKRVKTVINSTALEFETIYVSGGKRGLSVEIAPQDLAKVLGAEFTDIVDE

SEQ ID NO: 19 - DNA, 279 bp, Haemophilus influenzae
  Name: NTH0011
atggacgcaaccttaaatattgcgatagcagcagaatttgaattaagtgaaaaaattgtagagcgtttagaacaaagtacgcttgaaattagcaaagtttctattgttgaaataataccttttgaagaagaacaaaatattcgttttcgcaataaaggcgttgaacaacttgcgccaaatgaagtagagtgggctgattttaattatgtcttttttgcaggaaaacttgagcaaggtgcccatattgcgcaagcagcagaagcagggctgtattggcat

SEQ ID NO: 20 - protein, 93 aa, Haemophilus influenzae
  Name: NTH0011
MDATLNIAIAAEFELSEKIVERLEQSTLEISKVSIVEIIPFEEEQNIRFRNKGVEQLAPNEVEWADFNYVFFAGKLEQGAHIAQAAEAGLYWH

SEQ ID NO: 21 - DNA, 372 bp, Haemophilus influenzae
  n 105: n is any nucleotide
  Name: NTH0012
ttgttttgtggaaatcgggggcaggggttaaaacaggggggttccttaaggtccgggcaagctaccagtgttcggtgtggggtgtcaagtaggggtgtttcattncccgttgaaccaccaccaggcccttccgaaagcgccctccaacgccctaacatatcaatgccaatacagccctgcttctgctgcttgcgcaatatgggcaccttgctcaagttttcctgcaaaaaagacataattaaaatcagcccactctacttcatttggcgcaagttgttcaacgcctttattgcgaaaacgaatattttgttcttcttcaaaaggtattatttcaacaatagaaactttgctaatttcaagcgtactttgttc

SEQ ID NO: 22 - protein, 124 aa, Haemophilus influenzae
  Xaa 35: Xaa is any amino acid
  Name: NTH0012
LFCGNRGQGLKQGGSLRSGQATSVRCGVSSRGVSXPVEPPPGPSESALQRPNISMPIQPCFCCLRNMGTLLKFSCKKDIIKISPLYFIWRKLFNAFIAKTNILFFFKRYYFNNRNFANFKRTLF

SEQ ID NO: 23 - DNA, 822 bp, Haemophilus influenzae
  n 809, 810, 811, 812, 813: n is any nucleotide
  Name: NTH0013
gtgacgattcaagaaagtgtaaaaggcgataagagtaaatacttacagctcgcacaagttaatgctaaagcggctttaaatgtacaacttaaacaatcttcacgaatgtcagagcgttatcaagcgttgtgtgatctgttaaatctccctgaaattaagcgtatggagtgtttcgatataagccacacgatgggaaatcaaacggtagcatcttgtgttgtctttaatcaagaaggcccactgaaatctgattatcgtcgttttaatattgaaggcattactggtggggatgattatgcagcaatggaacaagcgttgcagaaacgttatgagcgtgatttagaagaagataaaattcctgatattatttttattgatggtggaaaagggcaattaaatcgtgcgctgaacgtgttccaacatcttcaagtaaaatgggataaaaatagaccgcacttaattggcgtggcaaaaggtgtggatcgtcgagctgggcaggaagtactgatcatcagcaaacaagaccgcgaaattcatttgcctgatgatagtttggcattgcatttgattcaacacatccgtgatgaaagtcataatcacgcaataagcggacaccgtaaaaaacgtcaaaaagcctttacacaaagtggtttagaaactattgaaggtgtgggcgctaaacgtcgtcaggctttactgaaatatcttggcggtttacaaggtgtgaaaaaggcgaccttagatgaaatagcctctgtaccgggaatttcccttaaacttgctgaaacgatttttgaaacgctcaaaannnnnttaattaat

SEQ ID NO: 24 - protein, 274 aa, Haemophilus influenzae
  Xaa 270, 271: Xaa is any amino acid
  Name: NTH0013
VTIQESVKGDKSKYLQLAQVNAKAALNVQLKQSSRMSERYQALCDLLNLPEIKRMECFDISHTMGNQTVASCVVFNQEGPLKSDYRRFNIEGITGGDDYAAMEQALQKRYERDLEEDKIPDIIFIDGGKGQLNRALNVFQHLQVKWDKNRPHLIGVAKGVDRRAGQEVLIISKQDREIHLPDDSLALHLIQHIRDESHNHAISGHRKKRQKAFTQSGLETIEGVGAKRRQALLKYLGGLQGVKKATLDEIASVPGISLKLAETIFETLKXXLIN

SEQ ID NO: 25 - DNA, 192 bp, Haemophilus influenzae
  Name: NTH0014
atggatattatgtccatcgcttaccaacacggtttagcctgtgtacaagtgatgtttattcgtcaaggaaaagtgctaggcaatcgcagttatttcccaaaaagtccctgccaatacggatttatcggaacttaccgaaacttttgtggggcaattttatttacaaggtcatcaagggcgaagtatcccaaa

SEQ ID NO: 26 - protein, 64 aa, Haemophilus influenzae
  Name: NTH0014
MDIMSIAYQHGLACVQVMFIRQGKVLGNRSYFPKSPCQYGFIGTYRNFCGAILFTRSSRAKYPK

SEQ ID NO: 27 - DNA, 960 bp, Haemophilus influenzae
  n 37, 955, 956, 957, 958, 959: n is any nucleotide
  Name: NTH0015
atgatcgcttatattttcttagctttattcacgatgncggcagtgatttttattgtaaactcccattatcgttggacttatttctttgctattacgctttttacttttttatttggcggcatgcttatggtttccagccaatggcaacgtgctttaaatttttcatcagtgctttttgtagtgctgatgttatttcatcgtttaaaaattcattattacaaacagcctttgttaatttcagatttctttcttgtggtggattggcgaaattgggaaaccttaattcattataaaggtgcgttgtttggcgttattgggctactggcgttattaggttatgcgatttttggttttaatgatgtcgagtctttaggggtattgggtaacagcattggtgctttattgtttatcgttagctttagcttgatgtggcattattctaaaaatccaagtgcggtgcaagtttggttagattctttgcctgatgatggtcgtgatgtgtttttaaatttaccaatgtcttgtcgcggtatttttttcaaagtgccaaattttgatggcaatagccaaaattttattgaaaaaatgaccgcactttcatctgatacaaacaacctatctgaaacaaaacccgatattgttgtaacattaatggaatccacgctgaaccctcatcaatttgcttttagtcagcaatctattccaccactttccatgtttgagtctcaaagtgatacagtatttgcttcgccgttgcgtgtacatacttttgctggtgcaacgtggaaatcagaatttgcttttttagccggtgtaccttcaaccgattttggtgcgttagcaagtggcgttttttattctgttgtaccgcacttgcaatcaggtttagtgaaaaatctaaaagccaagatattttttgggttgctttgtcgccctttacaagaggaattacatnnnnnt

SEQ ID NO: 28 - protein, 320 aa, Haemophilus influenzae
  Xaa 13, 319, 320: Xaa is any amino acid
  Name: NTH0015
MIAYIFLALFTMXAVIFIVNSHYRWTYFFAITLFTFLFGGMLMVSSQWQRALNFSSVLFVVLMLFHRLKIHYYKQPLLISDFFLVVDWRNWETLIHYKGALFGVIGLLALLGYAIFGFNDVESLGVLGNSIGALLFIVSFSLMWHYSKNPSAVQVWLDSLPDDGRDVFLNLPMSCRGIFFKVPNFDGNSQNFIEKMTALSSDTNNLSETKPDIVVTLMESTLNPHQFAFSQQSIPPLSMFESQSDTVFASPLRVHTFAGATWKSEFAFLAGVPSTDFGALASGVFYSVVPHLQSGLVKNLKAKIFFGLLCRPLQEELHXX

SEQ ID NO: 29 - DNA, 90 bp, Haemophilus influenzae
  Name: NTH0016
ttgagttttccttataaggtgggtaaatattgcctttattctaagaaaaatagcggattcttaaaagaaaggagtaaaaatatttttatt

SEQ ID NO: 30 - protein, 30 aa, Haemophilus influenzae
  Name: NTH0016
LSFPYKVGKYCLYSKKNSGFLKERSKNIFI

SEQ ID NO: 31 - DNA, 483 bp, Haemophilus influenzae
  n 470, 471, 472, 473, 474: n is any nucleotide
  Name: NTH0017
atgattaatagacgtcattttattcaaattggagcaactagcatcctagcgttaagtgcaaaccgttttgcgatggcaaaaggaaagagcgatgttgatttacgcattgtggcaacaacagatgttcatagcttcttgaccgattttgactattataaagatgcaccaaccgataaattcggttttactcgtgcagcaagccttattcgtcaagcacgtgctgaagtgaaaaatagtgtattagtagataacggtgacctaattcaaggtaatccaattgcagactatcaagctgcacaaggctataaagagggtaaatctaaccctgcggtcgattgtttaaatgcgatgaattatgaagtgggtacattaggtaaccacgaatttaactatggtctcaattatcttgcagatgccatcaaacaagctaaattccaaattgtgggtaccgagtcgatattcgataccannnnnttaattaat

SEQ ID NO: 32 - protein, 161 aa, Haemophilus influenzae
  Xaa 157, 158: Xaa is any amino acid
  Name: NTH0017
MINRRHFIQIGATSILALSANRFAMAKGKSDVDLRIVATTDVHSFLTDFDYYKDAPTDKFGFTRAASLIRQARAEVKNSVLVDNGDLIQGNPIADYQAAQGYKEGKSNPAVDCLNAMNYEVGTLGNHEFNYGLNYLADAIKQAKFQIVGTESIFDTXXLIN

SEQ ID NO: 33 - DNA, 390 bp, Haemophilus influenzae
  Name: NTH0018
gtggatacgacaggtttcgtattgcttaccgatgatggacaatggtcacatcgcatcacttcgccaaaacatcattgtgaaaaaacctatttggtaacattagctgatcccgtagaagaaaattatgcagcggcttgttcggaaggtattttattacgcagagaaaaagagcccactaaaccagcaaaattagaaattttagatgattacaatgtgaatctgaccatttctgaaggtcgttatcatcaagtaaaacgtatgtttgccgcacttgggaataaagtcgttggattacatcgctggaaaattggtgatgtagtgttggatgaatccttagaagaaggcgaataccgcccattaactcaaagtgaaattgaaaagttagtaaaa

SEQ ID NO: 34 - protein, 130 aa, Haemophilus influenzae
  Name: NTH0018
VDTTGFVLLTDDGQWSHRITSPKHHCEKTYLVTLADPVEENYAAACSEGILLRREKEPTKPAKLEILDDYNVNLTISEGRYHQVKRMFAALGNKVVGLHRWKIGDVVLDESLEEGEYRPLTQSEIEKLVK

SEQ ID NO: 35 - DNA, 294 bp, Haemophilus influenzae
  n 285, 286, 287, 288, 289: n is any nucleotide
  Name: NTH0019
atgaatcaacaaaaatcgactttcatctttattcttaccctcggtattctctctatgctaccgccctttggcgtggatatgtatttgccgtcttttttagaaattgcgaaagatctcggcgtgagtccagaacaagtacaacacacgctcacctcttttgcttatggcatggcgtttggtcagcttttttgggggccttttggtgatagtttcggacgaaaaccgatcattttactcggtgttattgtgggtgcattaacagctttagtgcttaccgaaataaannnnnttaat

SEQ ID NO: 36 - protein, 98 aa, Haemophilus influenzae
  Xaa 95, 96, 97: Xaa is any amino acid
  Name: NTH0019
MNQQKSTFIFILTLGILSMLPPFGVDMYLPSFLEIAKDLGVSPEQVQHTLTSFAYGMAFGQLFWGPFGDSFGRKPIILLGVIVGALTALVLTEIXXXN

SEQ ID NO: 37 - DNA, 543 bp, Haemophilus influenzae
  Name: NTH0020
gtgtctagcacagccaccaacgcgcttggtttgggtttagcaacaatgcttgtactcacttgcacaaatacggtcatttcccttttccgtcaatatattcctaaggaaatccgtattccaatctacgtgatgatcattgcaaccacagtaacagcggttcaacttttaatgaatgcttacacttatacgctttatcaatcactggggatttttattccattaattgtgaccaactgtattattatcggtcgcgcagaagcattcgcctcaaaaaacagcttactccattccatctgggatgggttttcaatgggattaggaatggcacttagtctaaccattctcggcgcattacgtgaaattattggacaaggcacgatttttgagggcatagaaaatctattcggcgaacaagcaaaatttttaacgcaccatatttaccatacagacagtagctttttacttttcattctgccaccaggcgcatttataggcttaggcttgctcctcgccataaaaaatcgaattgataatgtaaaaaaa

SEQ ID NO: 38 - protein, 181 aa, Haemophilus influenzae
  Name: NTH0020
VSSTATNALGLGLATMLVLTCTNTVISLFRQYIPKEIRIPIYVMIIATTVTAVQLLMNAYTYTLYQSLGIFIPLIVTNCIIIGRAEAFASKNSLLHSIWDGFSMGLGMALSLTILGALREIIGQGTIFEGIENLFGEQAKFLTHHIYHTDSSFLLFILPPGAFIGLGLLLAIKNRIDNVKK

SEQ ID NO: 39 - DNA, 225 bp, Haemophilus influenzae
  Name: NTH0021
gtggacaaagcccgagaagttggacaaccgcagggttatttttccaaattccttgagcaaaaatttctttccagatggatttttgttgattttcaaccgcactttctattttttcttcttcaaggcgggatttttttcagtccaacccgtcatattatttcccttgtgttgaaagctgccgcaccatgctttgttttttatcttgattatgctccccgctcacct

SEQ ID NO: 40 - protein, 75 aa, Haemophilus influenzae
  Name: NTH0021
VDKAREVGQPQGYFSKFLEQKFLSRWIFVDFQPHFLFFLLQGGIFFSPTRHIISLVLKAAAPCFVFYLDYAPRSP

SEQ ID NO: 41 - DNA, 108 bp, Haemophilus influenzae
  n 103, 104, 105, 106, 107: n is any nucleotide
  Name: NTH0022
ttgtgcgtgcaaattttgataagctttcgtaaagattatgatttcgtaaaattaaataaagatcgcgttgctgggcgttgggcttttacgcataacaagcagnnnnnt

SEQ ID NO: 42 - protein, 36 aa, Haemophilus influenzae
  Xaa 35, 36: Xaa is any amino acid
  Name: NTH0022
LCVQILISFRKDYDFVKLNKDRVAGRWAFTHNKQXX

SEQ ID NO: 43 - DNA, 330 bp, Haemophilus influenzae
  Name: NTH0023
ttgctattaagtagcattgcttctgctgaagagctttctgcgaagcagtctttagataaaatgacacaagcattggataatctcaattatgaaattgcctttgtgcaaactactccagcaaatatggattcatttcgttatcgacatatcaaacaagataacaaaacctacgcacaattagttactttagatggtcgccagaaagaaattattcaacgtgataatttagtcagttattttcagccaaatgctcaagcatttacgcttaatagtggcaatatagttgatgcgatgcctgcggttgtgcgtgcaaattttgataagctttcg

SEQ ID NO: 44 - protein, 110 aa, Haemophilus influenzae
  Name: NTH0023
LLLSSIASAEELSAKQSLDKMTQALDNLNYEIAFVQTTPANMDSFRYRHIKQDNKTYAQLVTLDGRQKEIIQRDNLVSYFQPNAQAFTLNSGNIVDAMPAVVRANFDKLS

SEQ ID NO: 45 - DNA, 93 bp, Haemophilus influenzae
  Name: NTH0024
ttgttatttagtgtggtgaatttttatcctttagatttctatgaaaaaaatcgcattaaaatttaccgcactttctctttctttgctattaag

SEQ ID NO: 46 - protein, 31 aa, Haemophilus influenzae
  Name: NTH0024
LLFSVVNFYPLDFYEKNRIKIYRTFSFFAIK

SEQ ID NO: 47 - DNA, 585 bp, Haemophilus influenzae
  Name: NTH0025
ttggagtttactatgcaaaaagagcagctttcagcctatatggatggcgaacaagtcaaaactgacttgacagatgctttattaagagacgaagaattacaagcgtcttggcattcatttcataccgttcgttcagtaatgcgtaaagaaagtgcggtctttttagggggggattttaccgctaaaatggcagatttgattgagttagaagacgtgaagaaagtcgatgtcattgcggtgtctcaacctgaaccagaagatgcacataattctgcatttatgcaaaaattaaaggcattttttgcgccaatgacgcaagttgctgttgctgctggtgtatgtttagtggcagtacttggtgttcaatctttcaatagtaaaaacgaagcgtctaatttacctgaggctccagtattgcaaaccttgccatttaataatgcggttcaagaggttagctataatgcgccaagtaaagatacattgacttcagatcagcttgagaaaaaaagtcgtcgtattggtgcaatgttgcaaaactatgaattgcaacgtcgtatgcactctgatgctagcagtcaagtaaga

SEQ ID NO: 48 - protein, 195 aa, Haemophilus influenzae
  Name: NTH0025
LEFTMQKEQLSAYMDGEQVKTDLTDALLRDEELQASWHSFHTVRSVMRKESAVFLGGDFTAKMADLIELEDVKKVDVIAVSQPEPEDAHNSAFMQKLKAFFAPMTQVAVAAGVCLVAVLGVQSFNSKNEASNLPEAPVLQTLPFNNAVQEVSYNAPSKDTLTSDQLEKKSRRIGAMLQNYELQRRMHSDASSQVR

SEQ ID NO: 49 - DNA, 471 bp, Haemophilus influenzae
  n 13, 35: n is any nucleotide
  Name: NTH0026
gtggcggggcttntgactcgctatgtatcacgtancgatattcctgatgtggtgcaagaatcctttataaaagcttatcgctcaattgaatcttttcgtggcgaaagtgctttctatacatggctttatcgaattgccgttaatacggcaaaaaattatttaacggctcaaggtcgccgtccaccaaatgaagatattttggcagaagatgctgaaaattatgatgtgggtacgcacttgcgggatgtggatacacccgaaaatgaaatgttgtctagtgagttagaaagaattgtttttgatactattcataacttaccagaagatttaaaaaccgcgattacgttacgagagctagaaggtttaagttacgaagagattgcagaaattatggattgtcctgttggtacggttcgttcccgaatcttccgagcaagggaaatgatcgaaaataaaattcaacctctaatg

SEQ ID NO: 50 - protein, 157 aa, Haemophilus influenzae
  Xaa 5, 12: Xaa is any amino acid
  Name: NTH0026
VAGLXTRYVSRXDIPDVVQESFIKAYRSIESFRGESAFYTWLYRIAVNTAKNYLTAQGRRPPNEDILAEDAENYDVGTHLRDVDTPENEMLSSELERIVFDTIHNLPEDLKTAITLRELEGLSYEEIAEIMDCPVGTVRSRIFRAREMIENKIQPLM

SEQ ID NO: 51 - DNA, 300 bp, Haemophilus influenzae
  Name: NTH0027
ttgccctatttgggcgggcccgattatcagagtttgaaagtaattgagacgtggaaccaaatttatattaatttaaaatcaaataatataatggcaaagggaattaatattgatgatcgcggtgcgtggcagatccagcttgataatgatattgtgctaaaattaggtcgtggcgattggaaatcaaaacttgagcgatttgtcacaatttatccgcaaattgatgtgccagaaaacaaaaaaatagattatatagatttaagatatacggcaggtgcagctgtaggtatggttgataga

SEQ ID NO: 52 - protein, 100 aa, Haemophilus influenzae
  Name: NTH0027
LPYLGGPDYQSLKVIETWNQIYINLKSNNIMAKGINIDDRGAWQIQLDNDIVLKLGRGDWKSKLERFVTIYPQIDVPENKKIDYIDLRYTAGAAVGMVDR

SEQ ID NO: 53 - DNA, 111 bp, Haemophilus influenzae
  Name: NTH0028
gtggtcgctgtagttggcgaagtatttcctgatggtgtagtgaatgtgcttggtgtaggcagttgtccttcaaagggattgatcgtggcagcatcactgatcttgatgccg

SEQ ID NO: 54 - protein, 37 aa, Haemophilus influenzae
  Name: NTH0028
VVAVVGEVFPDGVVNVLGVGSCPSKGLIVAASLILMP

SEQ ID NO: 55 - DNA, 102 bp, Haemophilus influenzae
  n 93, 94, 95, 96, 97: n is any nucleotide
  Name: NTH0029
ttgtccttcaaagggattgatcgtggcagcatcactgatcttgatgccgtagtgggttcgattcaacgtgctattgaagcggcagaatctatnnnnnttaat

SEQ ID NO: 56 - protein, 34 aa, Haemophilus influenzae
  Xaa 31, 32, 33: Xaa is any amino acid
  Name: NTH0029
LSFKGIDRGSITDLDAVVGSIQRAIEAAESXXXN

SEQ ID NO: 57 - DNA, 804 bp, Haemophilus influenzae
  Name: NTH0030
gtgaagaacacttttacccaaaatcttattgagcaacttggcattattgaagtgcaaggcccaattttgagccaagtgggtaacggaatgcaagataacttatcaggcattgaaaaagccgtacaggttaatgtgaaatgtattccaaatgccatatttgaagttgtgcattctcttgcgaaatggaaacgccatacattagctcgtttcaactttaaagaagacgaaggcttgtttgttcatatgaaagcattgcgtcccgatgaagattctcttgatccaacgcactctgtttatgtagatcaatgggactgggaaaaagtgattcctgaaggtcgtcgtaattttgcatacttaaaagaaacggtaaattctatttatcgtgctattcgtttaacagaattagccgtagaagcacgttttgatattccttccattcttccaaaacagattacctttgtgcatagcgaagatttagtaaaacgctatccagatttaagcagtaaagagcgtgaaaacgcaatttgtaaagaatacggtgcagtattcttaatcgggattggcggcaaactttcagatggcaaacctcatgatggtcgtgcacctgactatgatgactggacaacagaatctgaaaatggctacaaaggcttaaatggcgacattttggtatggaacgaccaattaggcaaagcctttgaactatcctcaatgggtatccgcgtagatgaaagtgcattacgtttacaagttggcttaacaggcgatgaaaaccgtttaaaatggattggcaccaagatttat

SEQ ID NO: 58 - protein, 268 aa, Haemophilus influenzae
  Name: NTH0030
VKNTFTQNLIEQLGIIEVQGPILSQVGNGMQDNLSGIEKAVQVNVKCIPNAIFEVVHSLAKWKRHTLARFNFKEDEGLFVHMKALRPDEDSLDPTHSVYVDQWDWEKVIPEGRRNFAYLKETVNSIYRAIRLTELAVEARFDIPSILPKQITFVHSEDLVKRYPDLSSKERENAICKEYGAVFLIGIGGKLSDGKPHDGRAPDYDDWTTESENGYKGLNGDILVWNDQLGKAFELSSMGIRVDESALRLQVGLTGDENRLKWIGTKIY

SEQ ID NO: 59 - DNA, 759 bp, Haemophilus influenzae
  Name: NTH0032
atggatttcgagaaaaaatttaccgcactttttaaatcgatagcaccacaatatcgacgctcagaagtgttttacgactttattacaatctttgccctggaattctatctcattatatatggtgcacaagcagatgaatcgttgagacaacgttatcagacagctggcgagcattataatgaagatgaaaaacaagctctcagtcgccttttcaacattattgttgaggctttggagcataaaacctatgatttcctaggatcagtgttcatgtcgttggatttaggtgatcaatataaagctcaatatttcacacctagtcacattgcacacttaatggcagccgtaactctatcagattgtcatagtttaattaaaaaacgtggctttttgacattgcaagagccaacttgtgggtcaggcgtaatgattattgaggcttataattatttgcgtgaagaggactttaaccctcagcaacaaatgtgggctcaagcaagagatttggattttactgcagcattaatgtgttatatacaaatgacactcttgcatataccgggagaagtcattattggtaacacccttaaagatgaggtgaattaccatttatacacacctgctcacataatgggaaattggaacaaaaaattggagagtgcagattcctatactgaagcagaatatcaagttattgaacctgaaccagtagaagaacccccgcttgacattgattgggaaaatgagccaatgttttac

SEQ ID NO: 60 - protein, 253 aa, Haemophilus influenzae
  Name: NTH0032
MDFEKKFTALFKSIAPQYRRSEVFYDFITIFALEFYLIIYGAQADESLRQRYQTAGEHYNEDEKQALSRLFNIIVEALEHKTYDFLGSVFMSLDLGDQYKAQYFTPSHIAHLMAAVTLSDCHSLIKKRGFLTLQEPTCGSGVMIIEAYNYLREEDFNPQQQMWAQARDLDFTAALMCYIQMTLLHIPGEVIIGNTLKDEVNYHLYTPAHIMGNWNKKLESADSYTEAEYQVIEPEPVEEPPLDIDWENEPMFY

SEQ ID NO: 61 - DNA, 174 bp, Haemophilus influenzae
  Name: NTH0033
gtgaatgtttgcaataattttcacaagaatgcagcgtatattgaacattggattaacgcattaaaagccgataaaaaagctattttccgagcatcttctcaagcacgtgaagcaacacaattcttgttaaatgctctcgaattaacatcgaatgaagaagcaaaattagcggct

SEQ ID NO: 62 - protein, 58 aa, Haemophilus influenzae
  Name: NTH0033
VNVCNNFHKNAAYIEHWINALKADKKAIFRASSQAREATQFLLNALELTSNEEAKLAA

SEQ ID NO: 63 - DNA, 267 bp, Haemophilus influenzae
  Name: NTH0034
atgacattctcagttgacagttatcttgaatatttcctgactctacttggttggttgcttaataacggagtttttgcgttatttgttggaacagggttatggcttcttccgcttatcggaatgatctttaaaatttggcgtgacgtagctaaacaaggggatgatgaaggtgagaaaggggatttattaatccgctggctcacaatcgaactcctcccagcaatgcttatcgttgttttgacattagcccctctttgcccggttcca

SEQ ID NO: 64 - protein, 89 aa, Haemophilus influenzae
  Name: NTH0034
MTFSVDSYLEYFLTLLGWLLNNGVFALFVGTGLWLLPLIGMIFKIWRDVAKQGDDEGEKGDLLIRWLTIELLPAMLIVVLTLAPLCPVP

SEQ ID NO: 65 - DNA, 321 bp, Haemophilus influenzae
  Name: NTH0035
atgtctcaaggtaaaaagccacaatcaagaggatggcttaaaaatgtactccgttttattgctatccttttatttttatttttagcccttactgcaattggcatctttgcaactcaatatcttcagaatgttgatattcgtgcttggtttattaaaacgcagtggatatggtttgcagtacgattattactatatggtgcgattatgttgatggtctattccatttctcgtcgccaaccatcttctatgccggcaaaagcaaaatggttaattgcgatgattttaatttttgctgaagcgattacacagattactttagct

SEQ ID NO: 66 - protein, 107 aa, Haemophilus influenzae
  Name: NTH0035
MSQGKKPQSRGWLKNVLRFIAILLFLFLALTAIGIFATQYLQNVDIRAWFIKTQWIWFAVRLLLYGAIMLMVYSISRRQPSSMPAKAKWLIAMILIFAEAITQITLA

SEQ ID NO: 67 - DNA, 126 bp, Haemophilus influenzae
  Name: NTH0036
gtggaattaaccgatcacgttgatgcatattggttaattcaatatttgctttggaaattagctgcaatttgggaatcccctgctgacttatccccagtttttggggataagactgtgggtaatgaa

SEQ ID NO: 68 - protein, 42 aa, Haemophilus influenzae
  Name: NTH0036
VELTDHVDAYWLIQYLLWKLAAIWESPADLSPVFGDKTVGNE

SEQ ID NO: 69 - DNA, 321 bp, Haemophilus influenzae
  Name: NTH0037
atgacgaacttaactcaatcgcagcctaatcctaatatgacttttcatcgtatttttgacattgggcctcgcatccaatcacttgcttttacctctgatgaggtgaaagcctacgtgctgcatttcattgcaaaaattaagacaaaaattggttcaaactgccaattaagcgcatttcctcagcgtgtatttactcaatcaagttggaaagtacacgctaaaggagataaaggtgaagtgcatttattatttaatatctccgggcgtttccaattacctgtgtttcttccgaaaactggccagctagacttaatgtggaat

SEQ ID NO: 70 - protein, 107 aa, Haemophilus influenzae
  Name: NTH0037
MTNLTQSQPNPNMTFHRIFDIGPRIQSLAFTSDEVKAYVLHFIAKIKTKIGSNCQLSAFPQRVFTQSSWKVHAKGDKGEVHLLFNISGRFQLPVFLPKTGQLDLMWN

SEQ ID NO: 71 - DNA, 351 bp, Haemophilus influenzae
  Name: NTH0038
atggttgaatggtgggaattacttaacctttctaatgatgaagtcgaacaggtaaaccgtttccgtcgtttatccgaagctcagaaaatgatgttgttatctgcgaaaaaagcagataagaaatatactgaaggtgtggtgctcgcaaccaatatggaagccttattccgtgttgttccacctagtctttacttagcactagggatgactgaaaaacacgagaaagcacaacgtaaacaattaatgatggaacataactgtactgagttagatgcggcattgatggttgctaaagacttagacaaaaaacgggggattgcagtcaatgacgaacttaactcaatcgcagcc

SEQ ID NO: 72 - protein, 117 aa, Haemophilus influenzae
  Name: NTH0038
MVEWWELLNLSNDEVEQVNRFRRLSEAQKMMLLSAKKADKKYTEGVVLATNMEALFRVVPPSLYLALGMTEKHEKAQRKQLMMEHNCTELDAALMVAKDLDKKRGIAVNDELNSIAA

SEQ ID NO: 73 - DNA, 933 bp, Haemophilus influenzae
  n 924, 925, 926, 927, 928: n is any nucleotide
  Name: NTH0039
atgaatattctaattattggcccatcttgggttggcgatatgatgatgtcgcacagtttgtaccagcaactgaaaattcaatatccaaactgcaatattgatgtgatggcaccgaattggtgtaagcctttgcttgcgcgtatgccagaagtgcgtaaggcgattgaaatgccattagggcacggagcctttgaattgggaacgcgttatcgtttaggtaaggcattgcgcaatcaatatgatatggcgatcgtattaccaaactccttgaagtcagcttttattcccgcttttgcaaaaattgcggtgcgtcgtggctggaaaggggaaagccgttatttcttgcttaacgatttacgcaataataaacgtgattatcctatgatggtgcaacgttatgtcgcgttagcttttgagcaaaatgcggtaccgaaagcggctgatattcctgttctaaaaccttatttaaccgttgatcccactcaacaagctgaaaccttaaaaaactttaaaaaacaaaccgcacttttaggcgagcgtccaattattggtttttgtcctggtgcggaatttggcccggcaaaacgttggccacattatcattatgcaaaattagcagaaatgttaattacccaaggctatgctgtggcgctatttggttcagctaaagatgaaccagtgggagaagaaattcgtcaagcactgccagaagcgttgcgtgagttttgtgtcaatttagcaggaaaaaccaacttaaatgaagcagtggatttaattgcaaattgtacggcggtcgtgaccaatgacagtggtttaatgcatattgcggcagcagtaaatcgtccattgattgcactttatggaccaactagcccacaatatacgccgccgcttcagaaaagcaacgattattcgtttaattgnnnnnttaat

SEQ ID NO: 74 - protein, 311 aa, Haemophilus influenzae
  Xaa 308, 309, 310: Xaa is any amino acid
  Name: NTH0039
MNILIIGPSWVGDMMMSHSLYQQLKIQYPNCNIDVMAPNWCKPLLARMPEVRKAIEMPLGHGAFELGTRYRLGKALRNQYDMAIVLPNSLKSAFIPAFAKIAVRRGWKGESRYFLLNDLRNNKRDYPMMVQRYVALAFEQNAVPKAADIPVLKPYLTVDPTQQAETLKNFKKQTALLGERPIIGFCPGAEFGPAKRWPHYHYAKLAEMLITQGYAVALFGSAKDEPVGEEIRQALPEALREFCVNLAGKTNLNEAVDLIANCTAVVTNDSGLMHIAAAVNRPLIALYGPTSPQYTPPLQKSNDYSFNXXXN

SEQ ID NO: 75 - DNA, 120 bp, Haemophilus influenzae
  Name: NTH0040
ttggttattaatgaagcatatcacttattttttattcatttaaacaacttatatggctttctcaacagccaaatttttcctaatcctattttttcttttatgcgttcatttattgttaat

SEQ ID NO: 76 - protein, 40 aa, Haemophilus influenzae
  Name: NTH0040
LVINEAYHLFFIHLNNLYGFLNSQIFPNPIFSFMRSFIVN

SEQ ID NO: 77 - DNA, 363 bp, Haemophilus influenzae
  Name: NTH0041
atgccccatctctcagtcgccaaatttggcggaacatctgttgctaactacaatgcgatgacagcttgtgcaaaaattgtcattgccgatcccaatacacgcgtagttgtgctttctgcatcagctggtgtaacaaatttattagtggctttagtaaatggtgtaaaagcgacagaacgtgaaaaattaattggcaatgatctgcatatcacttcaggtgtggcaaaacgtatttttgatactgttcaatcttataatgtgcgaatgattagttatggggcaagtaccaacaatgtttgtatgttagtacaaagtgaacattctgatgaaattgtacgctcgttacacaaatccttatttgaa

SEQ ID NO: 78 - protein, 121 aa, Haemophilus influenzae
  Name: NTH0041
MPHLSVAKFGGTSVANYNAMTACAKIVIADPNTRVVVLSASAGVTNLLVALVNGVKATEREKLIGNDLHITSGVAKRIFDTVQSYNVRMISYGASTNNVCMLVQSEHSDEIVRSLHKSLFE

SEQ ID NO: 79 - DNA, 582 bp, Haemophilus influenzae
  Name: NTH0043
gtgcaattacttgctgtattaattggtacgatgttatttactgcttttgttgtaaatcctattttagtttattggaaaatccgtcgtaatccttacccattagtgtggacttgtgtacgcgaaagtggggtaactgcattcttcactcgtagttctgcagcaaatattccagtgaacattgaattagcaaaacgcttaaatcttgatgaagaaacttattctgtttctattccattgggtgcgaacattaatatggcgggtgcggcgattactattactatcttaactttagccgcagttcatacactaggcttagaagtttccttcgttagtgcgcttttattaagtattgttgcagcactttgtgcttgtggtgcatctggcgtagcgggcggttcattattattaatcccattagcatgtagcttatttggtatttctgatgatgtagcagcacaaatgatcggtgttggttttattatcggtattttacaagactcaaccgaaacagcattaaactcatcaactgacgtattatttactgcggcagtatgtatggaagaagaacgtaaaaacgcagca

SEQ ID NO: 80 - protein, 194 aa, Haemophilus influenzae
  Name: NTH0043
VQLLAVLIGTMLFTAFVVNPILVYWKIRRNPYPLVWTCVRESGVTAFFTRSSAANIPVNIELAKRLNLDEETYSVSIPLGANINMAGAAITITILTLAAVHTLGLEVSFVSALLLSIVAALCACGASGVAGGSLLLIPLACSLFGISDDVAAQMIGVGFIIGILQDSTETALNSSTDVLFTAAVCMEEERKNAA

SEQ ID NO: 81 - DNA, 237 bp, Haemophilus influenzae
  n 12: n is any nucleotide
  Name: NTH0044
ttgaagctaccntatgagcatgaaaaattaattaccagtaaaatcaatgaattagtaggtaaaacctttgaagaaaaagactactctgcatttaatttcttacaatggtatgtggaagaacaacatgaagaagaaaaattatttagtagtattttagataaattaaattttcttggagaagatggcaaaggcttgttcctaattgataaggatttaggtaatctctctactaaagcc

SEQ ID NO: 82 - protein, 79 aa, Haemophilus influenzae
  Name: NTH0044
LKLPYEHEKLITSKINELVGKTFEEKDYSAFNFLQWYVEEQHEEEKLFSSILDKLNFLGEDGKGLFLIDKDLGNLSTKA

SEQ ID NO: 83 - DNA, 186 bp, Haemophilus influenzae
  Name: NTH0045
ttgttgaagttactaccgcaacggttttattattttggttggttggttggttggttggttggttggttggttggttggttggttggttggttggttggttggttcatcagtataaatccttttcatttttataataccttgattaactcaaaatatgcaatagaaaatattttggaaaatttggaa

SEQ ID NO: 84 - protein, 62 aa, Haemophilus influenzae
  Name: NTH0045
LLKLLPQRFYYFGWLVGWLVGWLVGWLVGWLVGWFISINPFHFYNTLINSKYAIENILENLE

SEQ ID NO: 85 - DNA, 621 bp, Haemophilus influenzae
  n 564, 601: n is any nucleotide
  Name: NTH0046
ttggctattaaaagcgtacaaaatcaaacttatccatgtaagcattatgtatttgttgatggcaatattttctgggataaagccaaatctatattggaacaatttcctgatgtaattcctatttatttgccaatgaatacaggaaaaaatggaatacttaacggtgcaattaacgcagtagcagcttttcttgttgaagaagacattatttgttatttagatgatgacaatcagctacgagaagatcacgtggaaagcttagtaaacgtgattgagcaaggtgctgattttgcttattccttgcgatctttttacgattcaaatcatcaatttatttgcaatgatgattttgactctctcggaaattggaatacaaaaagcgatattttcgtagatgttaaaatagaagatattcagaaacaaatacattttacttttaatgaagttaatggacatattgatactaattgttacgccgtacctcgtgagattgcacaaaaaacttcatatagttggaacacaccattaattggtgatcgcagctttttatctgccttaaaaagnttggggttaataggtcaaacttcaggaaatataccgntaaatacagagctgattcat

SEQ ID NO: 86 - protein, 207 aa, Haemophilus influenzae
  Xaa 188, 201: Xaa is any amino acid
  Name: NTH0046
LAIKSVQNQTYPCKHYVFVDGNIFWDKAKSILEQFPDVIPIYLPMNTGKNGILNGAINAVAAFLVEEDIICYLDDDNQLREDHVESLVNVIEQGADFAYSLRSFYDSNHQFICNDDFDSLGNWNTKSDIFVDVKIEDIQKQIHFTFNEVNGHIDTNCYAVPREIAQKTSYSWNTPLIGDRSFLSALKXLGLIGQTSGNIPXNTELIH

SEQ ID NO: 87 - DNA, 657 bp, Haemophilus influenzae
  Name: NTH0047
atgtctgaaatgactcctcgcgaaatagtttctgaattagatcaacatattattggtcaagccgatgcaaaacgtgctgtggcgattgcgttgcgtaaccgttggcgtcgtatgcagcttcaagaacctctgcgtcacgaagtaaccccaaaaaatatcctgatgattggcccaactggtgtgggtaaaactgaaattgcgcgccgtttagcaaaattagctaatgcgccatttatcaaagtggaagcaacgaaatttaccgaagtgggttacgtggggaaagaggtggattccattattcgtgatttaacggatagtgcgatgaaacttgttcgccaacaagaaattgcgaagaacagagcaagagctgaagacgcggctgaagagcgtattttggatgctttacttcctccagcaaaaaatcagtggggcgaagttgaaaaccatgatagtcacagcagtactcgccaagcgttccgtaaaaaattacgtgaaggtcaattagatgataaagaaatcgaaattgatgtgtctgctggcgtgtctatgggggttgaaattatggctcctccaggcatggaagaaatgacaaatcaactgcaatcattgttccaaaatttgggttcagacaaaaacgaaaaaacgcaaaatgaaaat

SEQ ID NO: 88 - protein, 219 aa, Haemophilus influenzae
  Name: NTH0047
MSEMTPREIVSELDQHIIGQADAKRAVAIALRNRWRRMQLQEPLRHEVTPKNILMIGPTGVGKTEIARRLAKLANAPFIKVEATKFTEVGYVGKEVDSIIRDLTDSAMKLVRQQEIAKNRARAEDAAEERILDALLPPAKNQWGEVENHDSHSSTRQAFRKKLREGQLDDKEIEIDVSAGVSMGVEIMAPPGMEEMTNQLQSLFQNLGSDKNEKTQNEN

SEQ ID NO: 89 - DNA, 165 bp, Haemophilus influenzae
  Name: NTH0048
atggggaatatggtatgtataaataacattgtagcggtaagttcagtgttaaatatttcaaaccaagaaggcacaattattaagaaaaccattatacctatgatcatttacggtatcattgccgcacttggcgcgctattcttagtacctttattttataatcta

SEQ ID NO: 90 - protein, 55 aa, Haemophilus influenzae
  Name: NTH0048
MGNMVCINNIVAVSSVLNISNQEGTIIKKTIIPMIIYGIIAALGALFLVPLFYNL

SEQ ID NO: 91 - DNA, 270 bp, Haemophilus influenzae
  n 264: n is any nucleotide
  Name: NTH0049
atgaagaaagctataaaattaaatttaattacacttggcctaattaatacaatcggtatgacgattacacaagctcaagccgaagaaacattaggacaaattgatgtagtggaaaaagttatatcaaacgataaaaaacctttcactgaagccaaagccaaaagtacacgtgaaaatgtctttaaggaaacacaaaccattgaccaagtgattcggagcattcctggggcatttactcaacaagataaaggctcgggtggtcgnttctgg

SEQ ID NO: 92 - protein, 90 aa, Haemophilus influenzae
  Name: NTH0049
MKKAIKLNLITLGLINTIGMTITQAQAEETLGQIDVVEKVISNDKKPFTEAKAKSTRENVFKETQTIDQVIRSIPGAFTQQDKGSGGRFW

SEQ ID NO: 93 - DNA, 90 bp, Haemophilus influenzae
  n 85, 86, 87, 88, 89: n is any nucleotide
  Name: NTH0050
ttgagcttgagtgttttggcaatcactttggctgaattttcgcgtacaacttacgcattgaaacgccttttctctgtgcagagannnnnt

SEQ ID NO: 94 - protein, 30 aa, Haemophilus influenzae
  Xaa 29, 30: Xaa is any amino acid
  Name: NTH0050
LSLSVLAITLAEFSRTTYALKRLFSVQRXX

SEQ ID NO: 95 - DNA, 387 bp, Haemophilus influenzae
  Name: NTH0051
gtgattgccaaaacactcaagctcaaaccaaacgaattggacgccctttgccaacgctaccaatgccaagccgacgagctggcagactttggctattacgccaccggcaaagcaggcgaatatatcctatatgaaacgagcagcgacttgcgcgacagcgaatccataccgctcaaacaaaatatccacgactatttcaaagccgaagtgcaagcgcacatcagcgaagcatggctgaatatggaaagcgtaaaaatcggctatgaaatcagcttcaacaaatacttctaccgccacaaaccattacgcagccttgcagaagttgcccaagatattttggcgttagaaaaacaggctgacggcttgattagtgaaattctagaggct

SEQ ID NO: 96 - protein, 129 aa, Haemophilus influenzae
  Name: NTH0051
VIAKTLKLKPNELDALCQRYQCQADELADFGYYATGKAGEYILYETSSDLRDSESIPLKQNIHDYFKAEVQAHISEAWLNMESVKIGYEISFNKYFYRHKPLRSLAEVAQDILALEKQADGLISEILEA

SEQ ID NO: 97 - DNA, 108 bp, Haemophilus influenzae
  Name: NTH0052
atgccgttaattttagaaagcggttctgtcattattattccttgcttatttcatgccaaatcttgcttaaaaggtaaaattcattatttttcaatgtgttatatattt

SEQ ID NO: 98 - protein, 36 aa, Haemophilus influenzae
  Name: NTH0052
MPLILESGSVIIIPCLFHAKSCLKGKIHYFSMCYIF

SEQ ID NO: 99 - DNA, 507 bp, Haemophilus influenzae
  Name: NTH0053
atgcagccggaaaaccaatattttgagcgcaaaggactaggagaaaaagacatcaagccaactaaaatagctgaagaattagttggaatgctcaatgctgatggcggagttttggcttttggtgtggcagataatggcgaaatccaagacttgaatagccttggcgataaattagatgattatcggaaattggttttcgattttattgcaccgccttgtcggattggactggaagaaattctggttgatggaaaattagttttcttattccacgtagagcaagatttagagcgtatttattgtcgcaaagacaatgaaaatgtgttcttacgtgtagcagatagtaatcgaggccctctcaccagagaacaaatcaaaaatcttgaatatgataaaaatatccgtctatttgaagatgaaatagttcctgattttaatgaagaagatttagatcaagaattattagagctatataaaaagaaagttaattttacctccgatatatct

SEQ ID NO: 100 - protein, 169 aa, Haemophilus influenzae
  Name: NTH0053
MQPENQYFERKGLGEKDIKPTKIAEELVGMLNADGGVLAFGVADNGEIQDLNSLGDKLDDYRKLVFDFIAPPCRIGLEEILVDGKLVFLFHVEQDLERIYCRKDNENVFLRVADSNRGPLTREQIKNLEYDKNIRLFEDEIVPDFNEEDLDQELLELYKKKVNFTSDIS

SEQ ID NO: 101 - DNA, 276 bp, Haemophilus influenzae
  Name: NTH0055
atgacaacgattgtaagcgtacgtcgcaatgggcaagtcgtcgtaggcggtgatggacaagtttctttaggcaataccgtaatgaaaggtaatgctcgtaaagtacgccgtttatataatggtaaggtacttgctggttttgcgggtggaacggcagatgcatttacactttttgaattatttgaacgtaaacttgaaatgcatcaagggcatttgctaaaaagtgcggtggaattagcgaaagattggcgtacagatcgcgcacttcgcaagtta

SEQ ID NO: 102 - protein, 92 aa, Haemophilus influenzae
  Name: NTH0055
MTTIVSVRRNGQVVVGGDGQVSLGNTVMKGNARKVRRLYNGKVLAGFAGGTADAFTLFELFERKLEMHQGHLLKSAVELAKDWRTDRALRKL

SEQ ID NO: 103 - DNA, 705 bp, Haemophilus influenzae
  n 637: n is any nucleotide
  Name: NTH0057
atgaaaaacggcataaaattatctgtcatcgcacttttaactgcagctgcagttccagcgatggcaggcaaaacagaaccttatactcaatctggcactaatgctcgtgaaatgttacaagagcaagcaattcattggattagtgttgatcaaatcaaacaaagtttagaaggtaaagcaccaattaatgtaagctttgatattgatgataccgtgcttttcagtagcccttgcttttaccacggacaacaaaaattctcaccaggtaaacacgattatttgaaaaaccaagatttctggaatgaagtaaatgcaggttgcgataaatattctattcctaaacaaattgccatagatttaattaatatgcaccaagcacgtggcgaccaagtttactttttcactggccgtactgctggcaaagtggatggtgtaaccccaattttagaaaaaacgttcaatattaagaatatgcacccagttgaatttatgggcagccgtgaacgtacaacaaaatataacaaaacgcctgcaatcatttcacataaagtgagtattcactatggcgacagcgatgatgatgtactagcagctaaagaagcaggtgttcgtggtattcgtttaatgcgtgccgcanactctacttatcaaccaatgccaactttaggcggctatggcgaagaagtgttaatcaattcaagctat

SEQ ID NO: 104 - protein, 235 aa, Haemophilus influenzae
  Xaa 213: Xaa is any amino acid
  Name: NTH0057
MKNGIKLSVIALLTAAAVPAMAGKTEPYTQSGTNAREMLQEQAIHWISVDQIKQSLEGKAPINVSFDIDDTVLFSSPCFYHGQQKFSPGKHDYLKNQDFWNEVNAGCDKYSIPKQIAIDLINMHQARGDQVYFFTGRTAGKVDGVTPILEKTFNIKNMHPVEFMGSRERTTKYNKTPAIISHKVSIHYGDSDDDVLAAKEAGVRGIRLMRAAXSTYQPMPTLGGYGEEVLINSSY

SEQ ID NO: 105 - DNA, 618 bp, Haemophilus influenzae
  Name: NTH0058
atggcagctgcaattggggctaaattacccgtttctactgcagttggttctatggtaattgatatcggtggtggtacgacagaagtggctgtaatttccttaaatggtatcgtatattcttcttccgtgcgtatcggtggtgaccgtttcgacgaggcgattatttcttatgttcgccgcacttttggctcggttatcggagaacctaccgccgaacgcatcaaacaagaaattggttctgcttatattcaagaaggtgacgaaattaaagaaatggaagtacacggacataatttagccgaaggtgcgccacgttcatttactttaacatcacgtgatgtcctagaagccattcaacaaccattaaacggtattgtagcagcggttcgaaccgcacttgaagaatgccaaccagaacacgcagcagacattttcgaacgtggtatggtattaactggtggcggtgctttattacgtaatattgatattttactttctaaagaatctggtgtccctgttatcatcgcagaagatccattaacctgtgttgctcgtggtggtggcgaagcattagaaatgatcgatatgcacggcggcgatatttttagtgatgaaatt

SEQ ID NO: 106 - protein, 206 aa, Haemophilus influenzae
  Name: NTH0058
MAAAIGAKLPVSTAVGSMVIDIGGGTTEVAVISLNGIVYSSSVRIGGDRFDEAIISYVRRTFGSVIGEPTAERIKQEIGSAYIQEGDEIKEMEVHGHNLAEGAPRSFTLTSRDVLEAIQQPLNGIVAAVRTALEECQPEHAADIFERGMVLTGGGALLRNIDILLSKESGVPVIIAEDPLTCVARGGGEALEMIDMHGGDIFSDEI

SEQ ID NO: 107 - DNA, 162 bp, Haemophilus influenzae
  Name: NTH0059
atgaaacccattttcggcaaagcccctcccctaggtattcgtctgcttatcgctatctttgcatctattgccttaattttagctgatggacgtaatagctcaataacgaaagcacgtagtgcaatggaaacagcaatagggcggtttatattatcttgcaaa

SEQ ID NO: 108 - protein, 54 aa, Haemophilus influenzae
  Name: NTH0059
MKPIFGKAPPLGIRLLIAIFASIALILADGRNSSITKARSAMETAIGRFILSCK

SEQ ID NO: 109 - DNA, 312 bp, Haemophilus influenzae
  Name: NTH0060
atgccttcttccaagctaaaagtggcaattgccaacgtattagctgctgaaggttatatcgaaagcgtaaaagttttagaaggtgctaaacctgaattggaaattactttaaaatatttccaaggcaaaccagttgtagaaagcatccaacgtgtaagtcgtcctggtcttcgtatttacaaacgtaaagatgaattaccaaaagttatgggcggtttaggtgttgcagttatttctacatctaaaggtgttatgactgaccgtgctgctcgtcaagcaggtttaggcggtgagatcatctgttatgtagct

SEQ ID NO: 110 - protein, 104 aa, Haemophilus influenzae
  Name: NTH0060
MPSSKLKVAIANVLAAEGYIESVKVLEGAKPELEITLKYFQGKPVVESIQRVSRPGLRIYKRKDELPKVMGGLGVAVISTSKGVMTDRAARQAGLGGEIICYVA

SEQ ID NO: 111 - DNA, 939 bp, Haemophilus influenzae
  Name: NTH0061
atgtctcgtgttgcaaaggcacctgttaatattcctgccggcgttgaagttaaactcgacggtcagctattaacagtaaaaggtaaaaatggcgagttatctcgcaaaattcatgaatcagttgaagtaaaacaagataacggacaatttacgttcactccacgtgaaggttttgttgaagcaaatgctcaatcgggtactgcacgtgcattagttaatgcaatggttatcggtgttactgaaggtttcactaaaaaattagtattggtgggtgtaggttacagagctcaacttaaaggtaacgcaattgcattaagtttaggctattctcacccagtagagcacactttgccggtaggtattactgcagaatgtccatctcaaaccgaaatcgtgttgaaaggtgcagacaaacagttgatcggtcaagttgcagcagatattcgtgcttatcgccgtcctgagccttatgaaggtataggggtacgttattcttatgatgtgttacatttcacaaatgcttcgaagaaacactctaccttatccttttccgataacgtaactttcttctgcttccctgtccgttctttctccgtctcttattttcttttcattggtttatttcgcgcatttttctctgtttcagttgtgttactttcaccccctcctcagtcgatttttctctctcgcaggctttttcctcctctcctctttttgttttttattttttgcgactgtcgttcacttctttgcttttgcttttttcattctcgcctctcctctcattccttcctttcatctcctactcttagtcttttcctccctccccgccccccttcctcccctcggctattagtcggctcctctcattttttttctcttccttcatcttttctcccttccccttcctctcttgcttctttcttcgtcttacctcct

SEQ ID NO: 112 - protein, 313 aa, Haemophilus influenzae
  Name: NTH0061
MSRVAKAPVNIPAGVEVKLDGQLLTVKGKNGELSRKIHESVEVKQDNGQFTFTPREGFVEANAQSGTARALVNAMVIGVTEGFTKKLVLVGVGYRAQLKGNAIALSLGYSHPVEHTLPVGITAECPSQTEIVLKGADKQLIGQVAADIRAYRRPEPYEGIGVRYSYDVLHFTNASKKHSTLSFSDNVTFFCFPVRSFSVSYFLFIGLFRAFFSVSVVLLSPPPQSIFLSRRLFPPLLFLFFIFCDCRSLLCFCFFHSRLSSHSFLSSPTLSLFLPPRPPSSPRLLVGSSHFFSLPSSFLPSPSSLASFFVLPP

SEQ ID NO: 113 - DNA, 162 bp, Haemophilus influenzae
  n 157, 158, 159, 160, 161: n is any nucleotide
  Name: NTH0062
gtgcttgataaaaataaatttatccaaattaatcttgtaccttgccatttttgctattcttttttatcctatgcctcaattttggaggctattatgaaatttaaaaatatactcgttgtacttaatcctagtaatgaaaaacagtacggcctagctnnnnnt

SEQ ID NO: 114 - protein, 54 aa, Haemophilus influenzae
  Xaa 53, 54: Xaa is any amino acid
  Name: NTH0062
VLDKNKFIQINLVPCHFCYSFLSYASILEAIMKFKNILVVLNPSNEKQYGLAXX

SEQ ID NO: 115 - DNA, 771 bp, Haemophilus influenzae
  n 157: n is any nucleotide
  Name: NTH0063
atgaaaaatttcgttgcaggagctcaatcagggcgcaaaattcaatcaggcggttgtgcgattcattgtcaggattgcagtattagtcagctttgtattccttttaccttaaatgaacaagaattagatcagcttgataatatcatagagagaaaanaaccgattcaaaagtctcaagtattgtttaaagcaggagattctctcaattcaatttatgctattcgttctggcacaataaaaagctatacgattagtgaatctggcgaagaacaaattacttcatttcatttgcccggtgacctagttggttttgatgccattactcaaatgcaacaccctagttttgcacaagctctagaaacggctatggtatgtgaaattccttttgatattttagatgatttggcaggaaaaatgccaaaactacgccagcaaattttacgtttgatgagcagtgaaattaaaagtgatcaagagatgattttattgctatctaaaatgaatgcagaagaacgtttggctgcttttattcataatctttctaaacgctattctgctcgaggtttttcagcaagagaatttcgtttaacaatggcacgtggcgatattggtaattatgtaggtttaacagtagaaaccatcagccgcttattaggccgctttcaaaaactcggcgtgattagcgtgcaaggcaaatatattacaatcaatgatttaaatggtttaattgaattaactggtacgaataaaacaaaaattacattagttaaa

SEQ ID NO: 116 - protein, 257 aa, Haemophilus influenzae
  Xaa 53: Xaa is any amino acid
  Name: NTH0063
MKNFVAGAQSGRKIQSGGCAIHCQDCSISQLCIPFTLNEQELDQLDNIIERKXPIQKSQVLFKAGDSLNSIYAIRSGTIKSYTISESGEEQITSFHLPGDLVGFDAITQMQHPSFAQALETAMVCEIPFDILDDLAGKMPKLRQQILRLMSSEIKSDQEMILLLSKMNAEERLAAFIHNLSKRYSARGFSAREFRLTMARGDIGNYVGLTVETISRLLGRFQKLGVISVQGKYITINDLNGLIELTGTNKTKITLVK

SEQ ID NO: 117 - DNA, 126 bp, Haemophilus influenzae
  n 20, 43, 50: n is any nucleotide
  Name: NTH0064
atggcagctgaaaattacanaaaaacgttagctcaatttaatnatggtgngcattttattatggcatttgttgggcgaatttttagaaacagaaattctgcttattttaaacaagggatattccaa

SEQ ID NO: 118 - protein, 42 aa, Haemophilus influenzae
  Xaa 7, 15, 17: Xaa is any amino acid
  Name: NTH0064
MAAENYXKTLAQFNXGXHFIMAFVGRIFRNRNSAYFKQGIFQ

SEQ ID NO: 119 - DNA, 798 bp, Haemophilus influenzae
  Name: NTH0065
gtgttgctcaaccgtgttcgcttggaaggaaagaaaacaaaagcggatattgtgctaggtttagataacttttttttggaacaagctgaaaaaacaggtatttttgcaccaaataacgtggatttaactcagcttgatttaccaacaaaatggacaaataagaccttcttacctttcgatttcggtaattatgcttttgtgtacgataaaaccaaattacaaaatccgccgaaaagtttgaaagaattagttgaacgccaagatcttcgtgtgatttatcaagatcctcgcaccagcagtgtgggacgtggtttattggtttggatgaatgtaatttatcctgaagataaaattcaatctgcttggaaaaatttagataagcatacggtaacagtgggtaaaggctggtcagatacttacggtgcattcttaaaaggcgaagcggatttagtattaagttacagcacatcgccactttatcatcaactttttgagaaaaaagataattatgcggcgacagattttgcggaagggcatattactcaagtggaattagcggcgcgagttgccaaccatccaaatcaatgtgcggatgattttatggcatttttaatttcgcctacagcacaaaaacatattgtgacagccaatattatgttgccagttattcaaggcgaaattgaaccgcactttgatgcgctgaaagttcaacaaaaaactcaaacgccaattaatccaacagtgaatgctgagcagttaaaaaattggatcagcacttggcaaactacattaacaaaa

SEQ ID NO: 120 - protein, 266 aa, Haemophilus influenzae
  Name: NTH0065
VLLNRVRLEGKKTKADIVLGLDNFFLEQAEKTGIFAPNNVDLTQLDLPTKWTNKTFLPFDFGNYAFVYDKTKLQNPPKSLKELVERQDLRVIYQDPRTSSVGRGLLVWMNVIYPEDKIQSAWKNLDKHTVTVGKGWSDTYGAFLKGEADLVLSYSTSPLYHQLFEKKDNYAATDFAEGHITQVELAARVANHPNQCADDFMAFLISPTAQKHIVTANIMLPVIQGEIEPHFDALKVQQKTQTPINPTVNAEQLKNWISTWQTTLTK

SEQ ID NO: 121 - DNA, 258 bp, Haemophilus influenzae
  Name: NTH0067
ttgatgttgtcgttatttcatcatccacaacttcgccctcgtcattatgcgggcggggttgttgtcattagtttcattattcttttttatggcagtgccttaagttcgatctttacattgggcgatgaattgcaatggcgagcttggttcactgatgattacctacagcatctgattcttttcagttttgggcaagctttactttctaccgctttatctatcttctttggtttactcctcgctcgggcattattttat

SEQ ID NO: 122 - protein, 86 aa, Haemophilus influenzae
  Name: NTH0067
LMLSLFHHPQLRPRHYAGGVVVISFIILFYGSALSSIFTLGDELQWRAWFTDDYLQHLILFSFGQALLSTALSIFFGLLLARALFY

SEQ ID NO: 123 - DNA, 156 bp, Haemophilus influenzae
  Name: NTH0068
gtgttaattaacaaaagtggggcaacaggacaagacgtagttaaacttgcccatcacgttcgccaaactgttgcagaaaaattcggtgtatatttgcaacctgaagtaagatttatcagtgcaactggcgaagtaaatagcgagcaaattatcacg

SEQ ID NO: 124 - protein, 52 aa, Haemophilus influenzae
  Name: NTH0068
VLINKSGATGQDVVKLAHHVRQTVAEKFGVYLQPEVRFISATGEVNSEQIIT

SEQ ID NO: 125 - DNA, 447 bp, Haemophilus influenzae
  Name: NTH0069
atggataaagaaacacaaatgatgttagttcctcaaggcagtatcgaaggttatattcgtgcagcaaatgaatatccgatgctgaccgcagaggaagaaaaggaattggcagaacgtttgtattatcacgaggatttagatgcagcgaaaaaactcattttgtcgcatcttcgtttcgtgatccatgttgcacgtggctattctggctatggtttgccacaagctgacttaatccaagagggcaatatcggtttaatgaaagcggtcaaacgttttaaccctgaagttggtgtacgcttggtgtcattcgccgtgcattggattaaagctgagatccacgaatatgctcttcgtaactggcgtatcgtaaaagtcgcaaccacgaaagctcaccgtaaattatttttcaacctacgtaaaactacacaacgttttaggttggttcaa

SEQ ID NO: 126 - protein, 149 aa, Haemophilus influenzae
  Name: NTH0069
MDKETQMMLVPQGSIEGYIRAANEYPMLTAEEEKELAERLYYHEDLDAAKKLILSHLRFVIHVARGYSGYGLPQADLIQEGNIGLMKAVKRFNPEVGVRLVSFAVHWIKAEIHEYALRNWRIVKVATTKAHRKLFFNLRKTTQRFRLVQ

SEQ ID NO: 127 - DNA, 381 bp, Haemophilus influenzae
  Name: NTH0070
atggtcgcaaatgaattgggtgtttccaaagaagatgtgatcgaaatggagtctcgaatgagcggtgcggatgtcggttttgatttacctactgatgatgcagaaacagagacctattctccagccctttatttggaagataaaagttctaatttcgcagcagagcttgaaaatgaaaactttgaaagccaagcaaccgagcaattaggtgcagcgttacaaagtctagatgcacgtagtcaggatattatcaaagctcgttggttagatgataacaaagccacattgcacgatttggcagcaaaatataatgtctctgcggaacgtattcgtcaattagaaactaatgcactgaaaaaattaaaaagtgcggtgaatttt

SEQ ID NO: 128 - protein, 127 aa, Haemophilus influenzae
  Name: NTH0070
MVANELGVSKEDVIEMESRMSGADVGFDLPTDDAETETYSPALYLEDKSSNFAAELENENFESQATEQLGAALQSLDARSQDIIKARWLDDNKATLHDLAAKYNVSAERIRQLETNALKKLKSAVNF

SEQ ID NO: 129 - DNA, 192 bp, Haemophilus influenzae
  Name: NTH0071
atgagattcaaaaaatcttgcaaaaatatgctaatggtcgaaaatgaatatgacagcggtttttaccatgtggcacgaattaaacagtggttacgttatttgaataaggaatatgacgaggcgaaccaagtgtttgataagattaagacctgccaaactgctgaagatttgaaattacggttaaatgagaaa

SEQ ID NO: 130 - protein, 64 aa, Haemophilus influenzae
  Name: NTH0071
MRFKKSCKNMLMVENEYDSGFYHVARIKQWLRYLNKEYDEANQVFDKIKTCQTAEDLKLRLNEK

SEQ ID NO: 131 - DNA, 603 bp, Haemophilus influenzae
  Name: NTH0072
gtgacttcctcattaatgggattgggtgcttatccaagtacggataaacaattcttaggtatgttgggtatgcatggtactttagaagcgaatacggcaatgcacgaaagtgatcttattttggggattggcgttcgttttgatgatcgtacgacaaataatttagaaaaatattgcccaaatgcaaaagtgattcatattgatattgatccaacctcaatttctaaaaatgtgccagtagcgattccaattgtcggaaatgcgaaaaatgtattggaagaatttttgggtttattgaatgaagagggattaaaatctcaaacggatcttgaaagttggtggcaagaaatcaaccaatggaaagcaaaaaaatgtttggaatttgaccgcacttctggcgtgattaaaccgcaacaagtcgtggaagcggtatatcgcctcacgaaaggacaagcttatgtggcttctgatgtaggtcagcaccaaatgtttgctgcgttacattatccattcgatgaaccgcgtcattggattaattctggtggtgcaggcacaatgggtttttggttttcctgcggcacttggtgtgaaattagctcatcc

SEQ ID NO: 132 - protein, 201 aa, Haemophilus influenzae
  Name: NTH0072
VTSSLMGLGAYPSTDKQFLGMLGMHGTLEANTAMHESDLILGIGVRFDDRTTNNLEKYCPNAKVIHIDIDPTSISKNVPVAIPIVGNAKNVLEEFLGLLNEEGLKSQTDLESWWQEINQWKAKKCLEFDRTSGVIKPQQVVEAVYRLTKGQAYVASDVGQHQMFAALHYPFDEPRHWINSGGAGTMGFWFSCGTWCEISSS

SEQ ID NO: 133 - DNA, 426 bp, Haemophilus influenzae
  Name: NTH0073
gtgaaattagctcatcctgaaggaactgttgtttgcgttactggcgatggtagtattcaaatgaatattcaagagctttctaccgcaacgcagtatggtattcctgttgtcattatttgtttgaataatcatttcttgggaatggtaaaacaatggcaagatttgatttattctggtcgccattcgcaaacctatatgaattccttgcctgattttgcgaaattggcagaatcttacggtcacgtaggaataaaaattgctacccccgatgaacttgaaagcaaattgcaagaagcattcagtattaaaaataaattagtctttgtagatattaatgtagatgaatctgaacacgtttatccaatgcaaattcgtggtggagcaatgaatgaaatgattttaagtaaacctcaagaggagacaaac

SEQ ID NO: 134 - protein, 142 aa, Haemophilus influenzae
  Name: NTH0073
VKLAHPEGTVVCVTGDGSIQMNIQELSTATQYGIPVVIICLNNHFLGMVKQWQDLIYSGRHSQTYMNSLPDFAKLAESYGHVGIKIATPDELESKLQEAFSIKNKLVFVDINVDESEHVYPMQIRGGAMNEMILSKPQEETN

SEQ ID NO: 135 - DNA, 498 bp, Haemophilus influenzae
  n 441, 460, 461, 493: n is any nucleotide
  Name: NTH0075
atgcgtagaattttatctgttttactcgaaaatgagtctggtgctttatcgcgtgttgttggtttattctcacaacgtgcctttaatattgaaagtttgacggttgcaccaacggatgatccaacgctttctcgaatgaccattgaagctgtgggcgatgctcaggcattggagcaaatcgaaaaacaacttcataaattagtggatgtgtttaaagtggttaatttaagtgagcaggaacatatagaacgagaaattgttttagcgaaagtaagagcagtggggtcatctcgcgatgaaattaaacgattagcagatattttccgcggtcaaattgtagatgtcacaccaaagtcttacacaattcaattaagcggtacaaatgataaagttgatgcgtttatttctgcattgaaagaagaaactacattgttagaaatntgttcgttctggattgatnntagtgtgtctcgtgggagaaaagaatattctnttaag

SEQ ID NO: 136 - protein, 166 aa, Haemophilus influenzae
  Xaa 147, 154, 165: Xaa is any amino acid
  Name: NTH0075
MRRILSVLLENESGALSRVVGLFSQRAFNIESLTVAPTDDPTLSRMTIEAVGDAQALEQIEKQLHKLVDVFKVVNLSEQEHIEREIVLAKVRAVGSSRDEIKRLADIFRGQIVDVTPKSYTIQLSGTNDKVDAFISALKEETTLLEXCSFWIDXSVSRGRKEYSXK

SEQ ID NO: 137 - DNA, 837 bp, Haemophilus influenzae
  Name: NTH0076
atgggatttattgggaaaattataggcgtatttttaggttggaaagttggtggattttttggtgcgattgctggtctcattttaggctctattgcagataaaaaattgtatgagcttggctcggtaagttctagtttctttaaaaagaaaacaacacgtcaagacttgtttatgcaaaccacctttgcggtgttaggacatttaagtaaatcgaaagggcgtgtaacagaagaagatattcaattagctaatcaattaatgattcagcttaaactggatgatgctgggcgtaaattagcgcaagatgcgtttcgtcgtggtaaagaatctgatttcccgattcgtcaagttatccgtgaatttcgcattggttgtgggcaacgtgctgatttattgcgaatgttcttacaagtgcaagttcaagcggcttttgccgattcagaacttcacgaaaatgagaaagaagtgctttatgtgatcgctgaagaacttgggctttctcgtatgcaatttgaacaaatgattgcgatggaaatggctgctcgagcttttactcaaggcggtttttatcagcaatatcaacaaggtgcatatcaaggtggctaccaatatcaacaacaaaatagtggtggttaccaacatgcttctggcccaactttaaatgatgcctataaagtattgggtgtgactgagtccgacgagcaaagcacggttaagcgtgcttatcgtcgtttaatgaatgaacatcatccagataaacttgtggcgaaaggtttaccgccagaaatgatggaaatggcaaaagaaaaactcaacagattcaagccgcttacgatt

SEQ ID NO: 138 - protein, 279 aa, Haemophilus influenzae
  Name: NTH0076
MGFIGKIIGVFLGWKVGGFFGAIAGLILGSIADKKLYELGSVSSSFFKKKTTRQDLFMQTTFAVLGHLSKSKGRVTEEDIQLANQLMIQLKLDDAGRKLAQDAFRRGKESDFPIRQVIREFRIGCGQRADLLRMFLQVQVQAAFADSELHENEKEVLYVIAEELGLSRMQFEQMIAMEMAARAFTQGGFYQQYQQGAYQGGYQYQQQNSGGYQHASGPTLNDAYKVLGVTESDEQSTVKRAYRRLMNEHHPDKLVAKGLPPEMMEMAKEKLNRFKPLTI

SEQ ID NO: 139 - DNA, 357 bp, Haemophilus influenzae
  Name: NTH0078
gtgtgttttaatcgcaaagaagtgaaagatcacggagagggcggcaatttaattggtagcccattgcaaggaaaaattttgcttgtggatgacgtgattacggctggcactgcaattcgtgaatctatggaattaatcagtgcaaataaggcagagcttgcggcggtattgatcgctctaaaccgtaaggaacgaggaaaaggcgagctttctgcaattcaagaagtagaacgtgattatcaatgccaagtgctatcaatcattgatttagatgatttgatgcaatttatcgaacaagatcctcgatacagtagccatttgccagaaatgcgtgcttatcgtgccgaatttggcgta

SEQ ID NO: 140 - protein, 119 aa, Haemophilus influenzae
  Name: NTH0078
VCFNRKEVKDHGEGGNLIGSPLQGKILLVDDVITAGTAIRESMELISANKAELAAVLIALNRKERGKGELSAIQEVERDYQCQVLSIIDLDDLMQFIEQDPRYSSHLPEMRAYRAEFGV

SEQ ID NO: 141 - DNA, 108 bp, Haemophilus influenzae
  Name: NTH0079
gtggttttgggccctgctaacaagggcatcccaattggcacttcagtttcggtggcgttatttaatcgttatggtattgataaaccgtgtgttttaatcgcaaagaag

SEQ ID NO: 142 - protein, 36 aa, Haemophilus influenzae
  Name: NTH0079
VVLGPANKGIPIGTSVSVALFNRYGIDKPCVLIAKK

SEQ ID NO: 143 - DNA, 378 bp, Haemophilus influenzae
  n 369, 370, 371, 372, 373: n is any nucleotide
  Name: NTH0080
ttgtggaaaaatggttcgggaaaaagtactttacgttcttttaaccaagatgctgtgcaaattgtgattgattctgatcatattgcaatgcagattaatcctcaaaatccaagacttgctgatattgatgcaggcagaaaagcgatagggctatttcgttttgctattaagctacatattgatttttctatggaatcaacgctttcgggcaattcaattattcagagaataaagaacgctaaagaaaatggtttctatgtacatttaaattatattggtattaatcgcattgaaataaatcttgcacggattaaggcaagagtaaaaagtggtggtcattttattgctgaagatattgtaaaatatcgnnnnnttaat

SEQ ID NO: 144 - protein, 126 aa, Haemophilus influenzae
  Xaa 124, 125: Xaa is any amino acid
  Name: NTH0080
LWKNGSGKSTLRSFNQDAVQIVIDSDHIAMQINPQNPRLADIDAGRKAIGLFRFAIKLHIDFSMESTLSGNSIIQRIKNAKENGFYVHLNYIGINRIEINLARIKARVKSGGHFIAEDIVKYRXXN

SEQ ID NO: 145 - DNA, 171 bp, Haemophilus influenzae
  Name: NTH0081
ttgatgactgaacgtgagaaaattattcaacaacagaaacaacttaaagcgttattttcagtttggatgaaagagaaaatgaatcacgaggtggttatctttcaaaaaactgatggcaagatagtcgagcattatctggatggttcggaaaaaattgtgggttatgcaaaa

SEQ ID NO: 146 - protein, 57 aa, Haemophilus influenzae
  Name: NTH0081
LMTEREKIIQQQKQLKALFSVWMKEKMNHEVVIFQKTDGKIVEHYLDGSEKIVGYAK

SEQ ID NO: 147 - DNA, 432 bp, Haemophilus influenzae
  Name: NTH0082
atggcaaaaactgcacaattttatattcttacggaaaattgtactttaactgtcgaagaaatagcctgtaatcttgctgcttcaatatggcgttcagggaaaaaagtactaattagttgcgaaagtgagagccaagcattagaaattgatgaacttttgtggcaacgagatcccaatgaatttgttccgcataatttatcaggtgaggcaacacaatatcccacaccgattgagatttcgtggcttggaaaacgaaatttacaacaccgcgatttgttaatcaatttgcaacaagaaatcccagattttagccatagttttacccaaattattgattttgtgccgaaagatgatgcgttaaaaacacaagctcgagaacgttataaacaattacgtctgcaaggttggaatctttctactgaaaacgtgggt

SEQ ID NO: 148 - protein, 144 aa, Haemophilus influenzae
  Name: NTH0082
MAKTAQFYILTENCTLTVEEIACNLAASIWRSGKKVLISCESESQALEIDELLWQRDPNEFVPHNLSGEATQYPTPIEISWLGKRNLQHRDLLINLQQEIPDFSHSFTQIIDFVPKDDALKTQARERYKQLRLQGWNLSTENVG

SEQ ID NO: 149 - DNA, 255 bp, Haemophilus influenzae
  Name: NTH0083
atgggaggtgaccaacaacttggtggattaatcgcagaaaagaaaatcgacatgatgatcttcttttgggatccaatgaatgctgcaccacatgatcctgatgtgaaagcccttatgcgtattgcaacagtgtggaatatccctgttgcgattaatcaaagctctgcagattttcttttaacttcagttttatttgaacaagatgtggaaattgacgtaccagattatgaagggtatttaaaagagcggttagct

SEQ ID NO: 150 - protein, 85 aa, Haemophilus influenzae
  Name: NTH0083
MGGDQQLGGLIAEKKIDMMIFFWDPMNAAPHDPDVKALMRIATVWNIPVAINQSSADFLLTSVLFEQDVEIDVPDYEGYLKERLA

SEQ ID NO: 151 - DNA, 444 bp, Haemophilus influenzae
  Name: NTH0084
gtgcaaaagtttcaccaagcaggcctgatcattgcgaataatcagcctcaaattaattgtacccctctgtctatttctgatgaaaaaggcaaagtggcattggatctaaatattgctttagtgccaaatcctaaatttgatttaatgcgcagtggcttatacaaacaattcaaagatttttcaatcaattttgatgtgaacaaagaaactgcgatttcattgttatctaaatttgtaccagaaaaccaaaagcaagatttcgttcgccgattgaatgaattagttaccgaaggtgaagtgaatgacattatcgtaaacacggacaaaaccgtaacattaacgcttgctctagaaaataacgacttgaaactaaacggcaagccaatcccagaagaacagttgaaagtggtactctttatacttgtaatggggggatttgggaga

SEQ ID NO: 152 - protein, 148 aa, Haemophilus influenzae
  Name: NTH0084
VQKFHQAGLIIANNQPQINCTPLSISDEKGKVALDLNIALVPNPKFDLMRSGLYKQFKDFSINFDVNKETAISLLSKFVPENQKQDFVRRLNELVTEGEVNDIIVNTDKTVTLTLALENNDLKLNGKPIPEEQLKVVLFILVMGGFGR

SEQ ID NO: 153 - DNA, 1020 bp, Haemophilus influenzae
  n 1015, 1016, 1017, 1018, 1019: n is any nucleotide
  Name: NTH0085
atgattgctgaattaggaaattatgtgctggctttaagtttagctgtatcgcttatgttggcgattttccctttgtggggggcggaaaagggcaatgtacaattaatggcattagctcgcccaatgacttatggtttatttgcaagcctaagcattgcttttgctgcgctattttatttattcgcagtcaatgattttagcgtgcaatatattgtaaataattctaatactactttacccatttattatcgtttatctgcggtatggggttcccatgaaggctctttgttactgtggatttggttactggcggtttggtcatttgccgttgctttattgagtaaacatttaccccaagaagcggttgctcgcgtgcttggtattatggggattattagcgtcggttttgtattgttcgtcttgtttacctcaaatcctttcacgcgtactttccctgatttcccagtagatggaaaagaacttaatccaatgttgcaagatgtaggcttgattttccaccctccattactttatatgggctatgtgggtttttcggtggcatttgcgtttgcgatagcatccttaatgactggaaaattagattcagcttgggcgcgttggtcacgtccttggacgcttgctgcttgggtgtttttaactttaggtatcgtactaggttcttggtgggcttattatgagcttggctgggggggctggtggttctgggatccagtagaaaactcatcgtttatgccgtggcttgctggtactgcattgattcactctctttctgtgacagaaaaacgaggttctttcaaagcttggacggtattacttgcgattttagccttttcactttgtctgctcggcaccttcttagttcgttctggtatcttagtttcagttcacgcatttgcatcggatccaactcgtggtttgtatattttggcttacctcgttgtggtaattggcggttcgcttgcactctatgcgtataaaggcagtcaaatcgttnnnnnt

SEQ ID NO: 154 - protein, 340 aa, Haemophilus influenzae
  Xaa 339, 340: Xaa is any amino acid
  Name: NTH0085
MIAELGNYVLALSLAVSLMLAIFPLWGAEKGNVQLMALARPMTYGLFASLSIAFAALFYLFAVNDFSVQYIVNNSNTTLPIYYRLSAVWGSHEGSLLLWIWLLAVWSFAVALLSKHLPQEAVARVLGIMGIISVGFVLFVLFTSNPFTRTFPDFPVDGKELNPMLQDVGLIFHPPLLYMGYVGFSVAFAFAIASLMTGKLDSAWARWSRPWTLAAWVFLTLGIVLGSWWAYYELGWGGWWFWDPVENSSFMPWLAGTALIHSLSVTEKRGSFKAWTVLLAILAFSLCLLGTFLVRSGILVSVHAFASDPTRGLYILAYLVVVIGGSLALYAYKGSQIVXX

SEQ ID NO: 155 - DNA, 135 bp, Haemophilus influenzae
  n 10, 63: n is any nucleotide
  Name: NTH0086
ttgctaaacncgatgaaattatgtgccgcagaattaggcgaaaaaatgcaaaaagtacataanccaatggggattaaggcagcagatttaaaaggcgaaagtgagcgtgatcgtcaagaaaaagaaggcgcaaaa

SEQ ID NO: 156 - protein, 45 aa, Haemophilus influenzae
  Xaa 4, 21: Xaa is any amino acid
  Name: NTH0086
LLNXMKLCAAELGEKMQKVHXPMGIKAADLKGESERDRQEKEGAK

SEQ ID NO: 157 - DNA, 936 bp, Haemophilus influenzae
  Name: NTH0087
atgtgggcggtgttagggggaacggcggtaacaaaaaaaacgggtattatctggggcacaaacccaaaaaaaagcgtttgttaccgaaagtatagttacccattagaagcgaaaattcgtgcgaaagtcgcacgccagggtccaaaaaccagaattattaaaggaaagcgcgtggcaaaaacaattcaagcaattcgtggtatgaacgattgcgccccaacagaatctccattatggcaatggattgaagcacaagtacgcaatgtattaaatagttatggctattcggaagtgcgtatgccaattgtagaaagtacgccattgtttgcgcgtgcaatcggcgaagtaactgatgttgtctcaaaagaaatgtacaccttttgggataacgatgaacaattaaccttacgccctgaaggcacagcaggttgtgtgcgagcagccattgaacacggttggatctataataatgaacaacgcttatggtatatcgggccaatgttccgtcacgaacgtccacaaaaagggcgttaccgtcaattccatcaagtaggtgttgaggtattcggtattgcgaatccagaaatcgatgccgaattaatcatgcttacctatcgtttatggaaagcgttaggtatcgatcaacatgttacacttcaacttaactcaattggttctttagaagctcgagcaaattatcgttcagctttagttggattcttagaaaaccatcaagatttaatgagcgatgaagaaaaagagcgtttagtaagaaatccgcttcgtattttggatacaaaaaatccagaattacaaaaagtattagataacgcgcctaaattacttgattatttagatgatgaaagccgtgcgcattttgaacaattatgttcattattagatgctgttggtattcaatataaaatggggattccc

SEQ ID NO: 158 - protein, 312 aa, Haemophilus influenzae
  Name: NTH0087
MWAVLGGTAVTKKTGIIWGTNPKKSVCYRKYSYPLEAKIRAKVARQGPKTRIIKGKRVAKTIQAIRGMNDCAPTESPLWQWIEAQVRNVLNSYGYSEVRMPIVESTPLFARAIGEVTDVVSKEMYTFWDNDEQLTLRPEGTAGCVRAAIEHGWIYNNEQRLWYIGPMFRHERPQKGRYRQFHQVGVEVFGIANPEIDAELIMLTYRLWKALGIDQHVTLQLNSIGSLEARANYRSALVGFLENHQDLMSDEEKERLVRNPLRILDTKNPELQKVLDNAPKLLDYLDDESRAHFEQLCSLLDAVGIQYKMGIP

SEQ ID NO: 159 - DNA, 642 bp, Haemophilus influenzae
  n 637, 638, 639, 640, 641: n is any nucleotide
  Name: NTH0088
atgtctgaacttggcttaaatgccacggcaaaatacaaaaaatctgctcgtaccgtcggtgatgtacttggtaaattccatccacatggtgacagcgcttgttatgaagctatggtgttaatggcacaacccttctcttatcgttatccgcttgtagatggtcaaggtaactggggggcaccagatgatccaaaatccttcgctgccatgcgttatacggaatctcgcctatctaaaatctctgaaatcttgttgagtgaactcggacaaggaacagtagattatcaaccaaactttgatggaaccttggctgaaccacaatatttacctgctcgtttacctcatattttattgaacggcacaacaggtattgcggtggggatggccacagatattccaccacacaatattaacgaaattgctgatgcggcagtaatgttgctagataatcctaaagcgagattagatgatgtacttgaaattgttcaaggcccagattttccaacagaagcggaaattatttcgccaaaatcagaaattcgtaaaatttatgagcaaggtcgtggctcaataaaaatgcgtgcaacttggaaacaagaagacggtgaaattattatttctgcgcttccacatcatnnnnnt

SEQ ID NO: 160 - protein, 214 aa, Haemophilus influenzae
  Xaa 213, 214: Xaa is any amino acid
  Name: NTH0088
MSELGLNATAKYKKSARTVGDVLGKFHPHGDSACYEAMVLMAQPFSYRYPLVDGQGNWGAPDDPKSFAAMRYTESRLSKISEILLSELGQGTVDYQPNFDGTLAEPQYLPARLPHILLNGTTGIAVGMATDIPPHNINEIADAAVMLLDNPKARLDDVLEIVQGPDFPTEAEIISPKSEIRKIYEQGRGSIKMRATWKQEDGEIIISALPHHXX

SEQ ID NO: 161 - DNA, 408 bp, Haemophilus influenzae
  n 399, 400, 401, 402, 403: n is any nucleotide
  Name: NTH0089
gtgcttctattcattgacttcttgtctgcgcgcttcggagtcttgctgggacggtgtgtgctcttgcggggcgcgctgccctctcggggctctggggcgctccttttggtccttcttttggtttgttgttcctttttatctgtttcagtttctgttgtgtcttgtcgcgcgcgcttctctctttgtggttctgaatcattgttattggttcattatctttgcgttcgttcttttcgtttgttgtttgattcgattcttgcctgttttgggtctgtgttccgccgcgccgttggccttcccttctctcccgcgggtcgcgccggcgctcccaggggacctctcttcgtatttactgctctggtcttttattcactccacgtagtctcgcattcctcttgnnnnnttaat

SEQ ID NO: 162 - protein, 136 aa, Haemophilus influenzae
  Xaa 133, 134, 135: Xaa is any amino acid
  Name: NTH0089
VLLFIDFLSARFGVLLGRCVLLRGALPSRGSGALLLVLLLVCCSFLSVSVSVVSCRARFSLCGSESLLLVHYLCVRSFRLLFDSILACFGSVFRRAVGLPFSPAGRAGAPRGPLFVFTALVFYSLHVVSHSSXXXN

SEQ ID NO: 163 - DNA, 969 bp, Haemophilus influenzae
  Name: NTH0090
gtggataaaacggaaaataattttaccgatccgacgcacgcaaaatttttatttaccgagaagattttgcagggcgatacggtaattcctattcgcaaagtggagacatttagcccacattcagacggcattgaaattaaatttaccagcattcaaaagctgtataacgatattcgcacccggcgggaaaatcaaaccacattggcggatttgcacaaattgaaccttgtgatgctgggtgatgaagcgcaccatttaaacgcgcaaaccaaaggcaaaaaacaaggcgaattagatttagaaaaggaaatgaacgaccgcaccagcaatgccgaaattgaacgtaaaggctgggagcatatggttttggaattgttactcaataaaaatggcaatcatagccaaaatgtgctgttggaatttaccgccacgctgcctgaaaatgctgacgtgcaacaaaagtacgctgataaaatcatcacaaaatttggcttaaaagaatttttgcaaaaaggttataccaaagaaatcaatttggtatccagtacgctgggtaagaaagagcgagtgttacacgctttattgtttgcttggtatcgacatcgaattgcgttgaaatatggcattgccaatttcaagcctgtgatgttgtttagaagtaagacgattgatgaatcaaaagcggattatctggcatttttaaattgggcagaaaatgtgcaggcggttgatttttcgtttttaactacattttcaacaagcttgaacgatagcgatagcgataacgccaacgaacaaggcaaaacccgcactgaacaagccctaaaatttatgcaggaaaaaggcgttgagtttgcacatttggcagattgggtaaaacaaaatatcaaaaaccaatgtgattattaccaactccgagagcaacaaaaccaaaccgaaaaaccgacagcgaaaccgaaaattgctaaa

SEQ ID NO: 164 - protein, 323 aa, Haemophilus influenzae
  Name: NTH0090
VDKTENNFTDPTHAKFLFTEKILQGDTVIPIRKVETFSPHSDGIEIKFTSIQKLYNDIRTRRENQTTLADLHKLNLVMLGDEAHHLNAQTKGKKQGELDLEKEMNDRTSNAEIERKGWEHMVLELLLNKNGNHSQNVLLEFTATLPENADVQQKYADKIITKFGLKEFLQKGYTKEINLVSSTLGKKERVLHALLFAWYRHRIALKYGIANFKPVMLFRSKTIDESKADYLAFLNWAENVQAVDFSFLTTFSTSLNDSDSDNANEQGKTRTEQALKFMQEKGVEFAHLADWVKQNIKNQCDYYQLREQQNQTEKPTAKPKIAK

SEQ ID NO: 165 - DNA, 636 bp, Haemophilus influenzae
  Name: NTH0091
atgtcatacacaactcaacaaattattgaaaaacttcgtgaactcaaaattgtgcctgtaattgcgttggataatgcagacgatattttgccgctagcagatacgttggctaaaaatggtttacctgtggcagagattacttttcgctctgaagcagcggcagatgcgatccgtttgttgcgtgcaaatagacctgactttttaattgctgccggtacagttttaactgcggaacaagtagttttagctaaaagtagtggggcggattttgtggtaacaccaggatttaatccaaaaattgtgaaattatgtcaagatttaaattttccaataacaccaggggtgaataatcctatggcaattgaaattgcattagaaatgggaatttcggcggtaaaatttttccctgcagaggcttcaggcggagtgaaaatgattaaagcattgctcggtccttatgctcaattacagataatgccgactggtggtatagggcttcataacataagggattatcttgctattcctaatattgttgcttgtggaggctcttggtttgtggagaaaaaattgattcaatccaaaaattgggatgaaattggacgattagtcagagaagtgattgagattattaaa

SEQ ID NO: 166 - protein, 212 aa, Haemophilus influenzae
  Name: NTH0091
MSYTTQQIIEKLRELKIVPVIALDNADDILPLADTLAKNGLPVAEITFRSEAAADAIRLLRANRPDFLIAAGTVLTAEQVVLAKSSGADFVVTPGFNPKIVKLCQDLNFPITPGVNNPMAIEIALEMGISAVKFFPAEASGGVKMIKALLGPYAQLQIMPTGGIGLHNIRDYLAIPNIVACGGSWFVEKKLIQSKNWDEIGRLVREVIEIIK

SEQ ID NO: 167 - DNA, 738 bp, Haemophilus influenzae
  n 1: n is any nucleotide
  Name: NTH0092
ntggtttcgaattcggactcggtaccctgctcaggttgtaaatctgctgatcatggtatggaaattgtccgtttttcagctattccagatgaatcagtattgaatagtattttacaaaaacgtttgcaaaatcaaccgctcttggaagaagaagttgctcaatttagtactgcaattttagtctggttggcttcggaatattgtaaacgtcactgggtaatgcaaatgcatattggtgcaatacgtaacaataatagtcgaatgtttgctttactcggtgcagatagtggctttgattccattggtgatcgaacttatgcatatcccctctctcgtttgttagatgcaatggataaggaaaatcaactgcctaaaactattttatattgcttaaatcctcgagataatgaaatgatcgctagtatgatcggaaactttcaaggcgatggtattgcagggaaaatacagtttggttctggatggtggtttaacgatcaaaaagacggaatggaacgtcagttacaacagctttctcaattagggttactcagtcaatttgttggaatgctaactgattcacgtagttttttatcttacactcgccatgagtatttccgccgtattttgtgtgaaatgattggtggatgggttgaaaaaggtgaagctccaaatgacatttcattactgggtaaaatgattgaagatatttgtttcaacaatgcaaaaaattattttaaa

SEQ ID NO: 168 - protein, 246 aa, Haemophilus influenzae
  Xaa 1: Xaa is any amino acid
  Name: NTH0092
XVSNSDSVPCSGCKSADHGMEIVRFSAIPDESVLNSILQKRLQNQPLLEEEVAQFSTAILVWLASEYCKRHWVMQMHIGAIRNNNSRMFALLGADSGFDSIGDRTYAYPLSRLLDAMDKENQLPKTILYCLNPRDNEMIASMIGNFQGDGIAGKIQFGSGWWFNDQKDGMERQLQQLSQLGLLSQFVGMLTDSRSFLSYTRHEYFRRILCEMIGGWVEKGEAPNDISLLGKMIEDICFNNAKNYFK

SEQ ID NO: 169 - DNA, 1014 bp, Haemophilus influenzae
  Name: NTH0094
atgaaaaaaacaaccgcactttttttacttatcttttcactaattgcttgtcaatcattggaactatcgcccaataatgatttaccttttgatccaaatattcagcacggtaaactatcaaacggtttgcaatactttgtattaaaaaatactgaacccaaagaacgcgtttatattcgattagtaattaatgcaggctcaatgcacgaagatgatgatcaaaaaggcattgcccatttagttgaacatatggcatttaatggctcaaagaaatatccagaaaatcaaattattaatgcgttagaaaaacttggaatgaagtttgcacgagatattaatgcttttaccgattttgaaaatacagtctatactttaaatttagatagcaataatcagcaaaaattagaattggcttttgatgttatcaatgaatggatgaataatattacttttttgcctaaagatgtggatggcgaacgtggtgtagtacaagaagaatggcgaagacgtttaagcccaatgttacgtattggcaataagaaaagtgctattgaaatggcgggttctcgttatgtattacgtgatcctattggagatatggatattattaaaacaatttcagctaaacgcgtcgctgatttttaccacaaatggtatcgaccagataatatgtcagtaattattgtaggcgatattgatacaaaacaagtagtaaaactattaaaacaaaacctatcccaagaaaacccaattactaaaacaacattggaaaaaattgattttaatattcctcttatcaacaaatggcgattagattctatttctgaacaaggcacaacaattccaagtattgaattaagtttttttgaaaatacaattgaaaccaatacattagcgagctataaacaagaattaattcagcaaattaccactcgattacttaacttacgtttacagcaatgggaaaaggaaacagaaaatggcgtagattctgcaaattttatcgtactcatt

SEQ ID NO: 170 - protein, 338 aa, Haemophilus influenzae
  Name: NTH0094
MKKTTALFLLIFSLIACQSLELSPNNDLPFDPNIQHGKLSNGLQYFVLKNTEPKERVYIRLVINAGSMHEDDDQKGIAHLVEHMAFNGSKKYPENQIINALEKLGMKFARDINAFTDFENTVYTLNLDSNNQQKLELAFDVINEWMNNITFLPKDVDGERGVVQEEWRRRLSPMLRIGNKKSAIEMAGSRYVLRDPIGDMDIIKTISAKRVADFYHKWYRPDNMSVIIVGDIDTKQVVKLLKQNLSQENPITKTTLEKIDFNIPLINKWRLDSISEQGTTIPSIELSFFENTIETNTLASYKQELIQQITTRLLNLRLQQWEKETENGVDSANFIVLI

SEQ ID NO: 171 - DNA, 204 bp, Haemophilus influenzae
  n 42: n is any nucleotide
  Name: NTH0095
atggcagacaccacacaatgggatagcagcattcgttggcanccaaccattagaggtaagcatagcgtttatttgcaagtagatattttaaatgtacttaataaaacacgtaaaaataaagtcgctactgctatttctaccagcgatgaatatggtgtctatacgcctgggcgtgaattttggctagaagttggctatcaattc

SEQ ID NO: 172 - protein, 68 aa, Haemophilus influenzae
  Xaa 14: Xaa is any amino acid
  Name: NTH0095
MADTTQWDSSIRWXPTIRGKHSVYLQVDILNVLNKTRKNKVATAISTSDEYGVYTPGREFWLEVGYQF

SEQ ID NO: 173 - DNA, 102 bp, Haemophilus influenzae
  Name: NTH0096
atgaaagccccaattcgttgttatgatttgattaccagcgataacgatgatgccattccacgctatcgtagctatcactatggcagacaccacacaatggga

SEQ ID NO: 174 - protein, 34 aa, Haemophilus influenzae
  Name: NTH0096
MKAPIRCYDLITSDNDDAIPRYRSYHYGRHHTMG

SEQ ID NO: 175 - DNA, 141 bp, Haemophilus influenzae
  n 128, 129, 130, 131, 132: n is any nucleotide
  Name: NTH0097
gtgatagctacgatagcgtggaatggcatcatcgttatcgctggtaatcaaatcataacaacgaattggggctttcataacactttatttgaccaagaatatcgtaattggggatcgcatatcaaaannnnnttaattaat

SEQ ID NO: 176 - protein, 47 aa, Haemophilus influenzae
  Xaa 43, 44: Xaa is any amino acid
  Name: NTH0097
VIATIAWNGIIVIAGNQIITTNWGFHNTLFDQEYRNWGSHIKXXLIN

SEQ ID NO: 177 - DNA, 1074 bp, Haemophilus influenzae
  Name: NTH0098
atgtctgtgcaaaatgtagtgctttttgacacacagcctttaactctgatgcttggcggcaaactttcccatattaatgtcgcgtatcaaacttatggcacactcaatgccgaaaaaaataatgcggtattaatttgccatgctttgactggcgatgctgagccttatttcgatgatggtcgagatggctggtggcagaattttatgggagcaggtttagcattggatacggatcgttatttttttattagctcgaacgtattaggtgggtgtaagggaacaactgggccttcatcaattaatccgcaaacgggtaaaccttatggcagccaatttcctaatattgttgtgcaagatattgttaaagtacaaaaagccttgcttgaacatcttggtattagccatttaaaagccattattggtggatcttttggcggtatgcaagcgaatcaatgggcgattgattatcctgattttatggataatatcgtgaatctttgctcatccatttattttagtgctgaagccataggctttaaccatgttatgcgtcaagcggtaattaatgatcccaattttaacggcggcgattattatgaggggacaccgccagatcaagggttatctattgcgcgtatgctaggtatgctgacttaccgcaccgatttacaactagccaaagcctttgggcgtgctacaaaatcagatggcagcttttggggcgattactttcaagtggaatcctatctttcttaccaaggcaaaaaattcttagaacgttttgatgccaatagttatttgcatttgttacgtgcgttggatatgtatgatccaagtttggggtatgagaatgtcaaagaggcattatcacgtattaaagcacgctatacgttggtttctgtgacaacggatcaactttttaaacccattgatctttataaaagtaaacagcttttagagcaaagtggagtcgatctacatttttatgaattcccatcagattacggacacgatgcgtttttagtggattatgatcagtttgaaaaacgaattcgagatggtttggcaggtaat

SEQ ID NO: 178 - protein, 358 aa, Haemophilus influenzae
  Name: NTH0098
MSVQNVVLFDTQPLTLMLGGKLSHINVAYQTYGTLNAEKNNAVLICHALTGDAEPYFDDGRDGWWQNFMGAGLALDTDRYFFISSNVLGGCKGTTGPSSINPQTGKPYGSQFPNIVVQDIVKVQKALLEHLGISHLKAIIGGSFGGMQANQWAIDYPDFMDNIVNLCSSIYFSAEAIGFNHVMRQAVINDPNFNGGDYYEGTPPDQGLSIARMLGMLTYRTDLQLAKAFGRATKSDGSFWGDYFQVESYLSYQGKKFLERFDANSYLHLLRALDMYDPSLGYENVKEALSRIKARYTLVSVTTDQLFKPIDLYKSKQLLEQSGVDLHFYEFPSDYGHDAFLVDYDQFEKRIRDGLAGN

SEQ ID NO: 179 - DNA, 180 bp, Haemophilus influenzae
  Name: NTH0099
atgttgatcactgatgcaggaacgcttgttcgcacacgcgtaagcgaagtgagcattgtagggcgtaacacgcaaggtgttcgcttaattcgtactgccgatgatgaacacgtagtaagtttagaacgtgtttgtgatgcagatgaagaagattctttggaagaaagcagttctgaagaa

SEQ ID NO: 180 - protein, 60 aa, Haemophilus influenzae
  Name: NTH0099
MLITDAGTLVRTRVSEVSIVGRNTQGVRLIRTADDEHVVSLERVCDADEEDSLEESSSEE

SEQ ID NO: 181 - DNA, 168 bp, Haemophilus influenzae
  n 3: n is any nucleotide
  Name: NTH0100
ttntaccagcaccacaaaacggctacggaaaaccgcacacaattaagtgaatacccaactaaatcacgtaatacaaaaggtgtgatttcgattaaagtgagtgaacgcaatggtaaagtcgttgctgcaactcaagtagaagaaacagacccaaattatgttgatcac

SEQ ID NO: 182 - protein, 56 aa, Haemophilus influenzae
  Xaa 1: Xaa is any amino acid
  Name: NTH0100
XYQHHKTATENRTQLSEYPTKSRNTKGVISIKVSERNGKVVAATQVEETDPNYVDH

SEQ ID NO: 183 - DNA, 138 bp, Haemophilus influenzae
  n 15, 129, 130, 131, 132, 133: n is any nucleotide
  Name: NTH0101
ttgtggtgctggtanaaattcccctttaccttttgcacaacgagagaaccactttatcgatatttagcctatgatgctttagcggtgtatcaaaatatcttcaattctaccgcctttctcgtcagaatnnnnnttaat

SEQ ID NO: 184 - protein, 46 aa, Haemophilus influenzae
  Xaa 5, 43, 44, 45: Xaa is any amino acid
  Name: NTH0101
LWCWXKFPFTFCTTREPLYRYLAYDALAVYQNIFNSTAFLVRXXXN

SEQ ID NO: 185 - DNA, 306 bp, Haemophilus influenzae
  Name: NTH0102
gtgaacttctcggatctttatactggattgattgatgtgaatatgtcttcaatgcaagacaggatttccacggaaacacaaaaagccttattagatttagctgaaagtgtggattatccaatttcagaaaaattgagtggcagcggcgatttaggacaagttttaagtgatgccatcgaacaatatgatgtggatttattagtgacgggacatcatcaggatttttggagtaagttaatgtcttcaacacgtcaagtgatgaatacgattaaaattgatatgttggttgttccgcttagagatgaa

SEQ ID NO: 186 - protein, 102 aa, Haemophilus influenzae
  Name: NTH0102
VNFSDLYTGLIDVNMSSMQDRISTETQKALLDLAESVDYPISEKLSGSGDLGQVLSDAIEQYDVDLLVTGHHQDFWSKLMSSTRQVMNTIKIDMLVVPLRDE

SEQ ID NO: 187 - DNA, 870 bp, Haemophilus influenzae
  n 579: n is any nucleotide
  Name: NTH0103
atgaaaacaacagcagaaataagacaatcattccttgattttttccatagcaaaggtcaccaagtagttgagagtagctcacttgtgccggaaaatgatccgactttgcttttcacgaacgctgggatgaaccaatttaaggatgtattccttggaatggataaacgcccttattctcgagccaccaccgcacaacgttgcgtgcgtgctggtggtaagcataacgacttagaaaatgttggttataccgcgcgtcaccatactttctttgaaatgctcggtaacttcagttttggtgattactttaaacaggatgcgattaattttgcttgggaatatttaacttctccacaatggcttggtttacctaaagaaaaactctgggtaaccgtgtatgaaactgacgacgaagcctataatatttggaataaagatgttggtgttcctgctgaacgcattattcgcattggtgacaataaaggctcaccttacgcatcagacaacttctgggcaatgggcgacacaggtccttgcggtccttgtactgaaattttctacgatcacggcgatcatatttgnggcggacctccaggctcaccagaagaagatggcgaccgttatattgaaatctggaacgttgtgtttatgcagttcaaccgtttagcagatggcacaatggaaaaattaccttgtccgtctgttgataccaggatggggattagagcggtatttcggtgtggtgcaacatgtgaacttccactacgagattggttttttccaaacattaatccccaaaacgggggaaattggagggccacagattcaactacaaatcactccggttatgctggcctatccgcctttggcata

SEQ ID NO: 188 - protein, 290 aa, Haemophilus influenzae
  Xaa 193: Xaa is any amino acid
  Name: NTH0103
MKTTAEIRQSFLDFFHSKGHQVVESSSLVPENDPTLLFTNAGMNQFKDVFLGMDKRPYSRATTAQRCVRAGGKHNDLENVGYTARHHTFFEMLGNFSFGDYFKQDAINFAWEYLTSPQWLGLPKEKLWVTVYETDDEAYNIWNKDVGVPAERIIRIGDNKGSPYASDNFWAMGDTGPCGPCTEIFYDHGDHIXGGPPGSPEEDGDRYIEIWNVVFMQFNRLADGTMEKLPCPSVDTRMGIRAVFRCGATCELPLRDWFFPNINPQNGGNWRATDSTTNHSGYAGLSAFGI

SEQ ID NO: 189 - DNA, 243 bp, Haemophilus influenzae
  n 230, 231, 232, 233, 234: n is any nucleotide
  Name: NTH0104
atggcacaatggaaaaattaccttgtccgtctgttgataccaggatggggattagagcggtatttcggtgtggtgcaacatgtgaacttccactacgagattggttttttccaaacattaatccccaaaacgggggaaattggagggccacagattcaactacaaatcactccggttatgctggcctatccgcctttggcatataacgccgatgggttctcccacaaagnnnnnttaattaat

SEQ ID NO: 190 - protein, 81 aa, Haemophilus influenzae
  Xaa 77, 78: Xaa is any amino acid
  Name: NTH0104
MAQWKNYLVRLLIPGWGLERYFGVVQHVNFHYEIGFFQTLIPKTGEIGGPQIQLQITPVMLAYPPLAYNADGFSHKXXLIN

SEQ ID NO: 191 - DNA, 1671 bp, Haemophilus influenzae
  n 468: n is any nucleotide
  Name: NTH0105
atgatgaaaaaacaaaagtttaatgtaaccattgatgtaaatgaaggtttacagtatgactttcgtagtgcacgcattataggtaatctgggaggtatgtctgccgagcttgaacctttactttcagcattacatttaaatgatactttccgccgtagtgatattgcagatgtagaaaatgcaattaaagcaaaacttggagaacgcggttacggtagcgcaacggtaaattcagtacctgattttgatgatgcaaataaaacattagcgataacccttgttgttgatgctggacgacgtttaactgttcgccaacttcgctttgaaggaaataccgtttctgctgatagcactttacgtcaggaaatgcgccaacaagaaggaacttggtataattcacaattagttgagttaggaaaaattcgcttagatcgtacaggtttcttcgaaacagtcgaaaaccgaatngatcctatcaatggtagcaatgatgaagtggatgtcgtatataaagtcaaagaacgtaacacgggtagtatcaactttggtattggttacggtacagagagtggtattagttatcaagcaagtgttaaacaagataatttcttaggaacaggggctgcagtaagtatagctggtacgaaaaatgattatggtacgagtgtcaatttgggttataccgagccctattttactaaagatggtgtaagtcttggtggaaatgttttctttgaaaactacgataactctaaaagtgatacatcctctaactataagcgtacgacttatggaagtaatgttactttaggtttccctgtaaatgaaaatacctcctattatgtaggattaggccatacctataataaaattagtaactttgctctagaatatacccgtaatttatatattcaatcaatgaaatttaaaggtaatggcattaaaacaaatgactttgatttttcttttggttggaactataacagccttaatagaggctatttcccaactaaaggggttaaagcaagtcttggtggacgagttactattccaggttctgataacaaatactacaaactaagtgcagatgtacagggtttctacccattagacagagatcacctctgggttgtatctgcaaaagcatctgcaggatatgcaaatggttttggaaacaagcgtttaccgttctatcaaacttatacagcgggtggcatcggttcattacgtggttttgcttatggtagtattggacctaacgcaatttatgccgctcaaaatggtaatagtaatagtaatagtaatggtacttttaataagataagttctgatgtgattggtggtaatgcaatcacaactgcgagtgcagaacttattgtaccaacaccgtttgtgagcgataagagccaaaatacggtccgaacttccctatttgttgatgcggcaagtgtttggaatactaagtggaaatcggataagagtgggttagataacaatgtattaaaaagcttacccgattatggcaaatcaagccgtattcgcgcctctacaggtgtcggattccaatggcaatctcctattgggccattggtattctcttatgccaaaccaattaaaaaatatgaaaatgatgatgtcgaacagttccaatttagtattggaggttctttc

SEQ ID NO: 192 - protein, 557 aa, Haemophilus influenzae
  Xaa 156: Xaa is any amino acid
  Name: NTH0105
MMKKQKFNVTIDVNEGLQYDFRSARIIGNLGGMSAELEPLLSALHLNDTFRRSDIADVENAIKAKLGERGYGSATVNSVPDFDDANKTLAITLVVDAGRRLTVRQLRFEGNTVSADSTLRQEMRQQEGTWYNSQLVELGKIRLDRTGFFETVENRXDPINGSNDEVDVVYKVKERNTGSINFGIGYGTESGISYQASVKQDNFLGTGAAVSIAGTKNDYGTSVNLGYTEPYFTKDGVSLGGNVFFENYDNSKSDTSSNYKRTTYGSNVTLGFPVNENTSYYVGLGHTYNKISNFALEYTRNLYIQSMKFKGNGIKTNDFDFSFGWNYNSLNRGYFPTKGVKASLGGRVTIPGSDNKYYKLSADVQGFYPLDRDHLWVVSAKASAGYANGFGNKRLPFYQTYTAGGIGSLRGFAYGSIGPNAIYAAQNGNSNSNSNGTFNKISSDVIGGNAITTASAELIVPTPFVSDKSQNTVRTSLFVDAASVWNTKWKSDKSGLDNNVLKSLPDYGKSSRIRASTGVGFQWQSPIGPLVFSYAKPIKKYENDDVEQFQFSIGGSF

SEQ ID NO: 193 - DNA, 330 bp, Haemophilus influenzae
  Name: NTH0106
atgaaaaacatcgcaaaagtaaccgcacttgctttaggtattgcacttgcttcaggctatgcttccgctgaagaaaaaattgctttcattaatgcaggttatatttttcaacatcacccagatcgccaagcagtagcagataaacttgatgctgaatttaaacctgtagctgagaaattagcagcaagcaaaaaagaagttgatgataaaattgctgctgctcgtaaaaaagtagaagcaaaagttgcggctttagaaaaagatgcacctcgcttacgtcaagctgatattcaaaaaccgccacagggaattaataaattagggtgcggc

SEQ ID NO: 194 - protein, 110 aa, Haemophilus influenzae
  Name: NTH0106
MKNIAKVTALALGIALASGYASAEEKIAFINAGYIFQHHPDRQAVADKLDAEFKPVAEKLAASKKEVDDKIAAARKKVEAKVAALEKDAPRLRQADIQKPPQGINKLGCG

SEQ ID NO: 195 - DNA, 771 bp, Haemophilus influenzae
  Name: NTH0107
atgctatacccagagtaccctgagtacgataattttaacgaatccggcgcactgatcaaagtcgtaggtgtaggcggtggcggtggcaatgccgtaaaccatatggtaatgaatatggtaaaacaagaaatgggcggaacctttgttggcgaaagttcattaacatcagaggaacacggtcgcatagtattttatgccgtcaatactgatgctcaagcattgcgtaaaagtcaagttcaacagaccgtacaaattggtggagaaacaaccaaaggtttaggtgctggggcaaatccgaatattggtcgtaaggcagctgaagatgatcaggatgaaatccgtaaaatgcttgaaggtgccgatatggtctttattgcagcaggtatgggtggcggcacaggtacgggtgcggcacctgttgttgctaaaattgctaaagaactgggtattttgactgttgctgtagtgactaaaccttttgcctttgaaggcaaaaaacgtatgcaatttgcagagcttggtattaaagatttatcccaatatgttgattcaatgattattattccgaatcaacaaatccaaaaagttctccctaaaaatgctaaattaattgatgcttttgctgctgcaaacgacgtattgcgtaattctgtaatgggaatttcagatatgattacctctcctggtttaattaacgtggacttcgctgatgtaagaacggtaatgtcagttcaagggcaagctatgattggttttggttggggatccccc

SEQ ID NO: 196 - protein, 257 aa, Haemophilus influenzae
  Name: NTH0107
MLYPEYPEYDNFNESGALIKVVGVGGGGGNAVNHMVMNMVKQEMGGTFVGESSLTSEEHGRIVFYAVNTDAQALRKSQVQQTVQIGGETTKGLGAGANPNIGRKAAEDDQDEIRKMLEGADMVFIAAGMGGGTGTGAAPVVAKIAKELGILTVAVVTKPFAFEGKKRMQFAELGIKDLSQYVDSMIIIPNQQIQKVLPKNAKLIDAFAAANDVLRNSVMGISDMITSPGLINVDFADVRTVMSVQGQAMIGFGWGSP

SEQ ID NO: 197 - DNA, 1056 bp, Haemophilus influenzae
  Name: NTH0108
ttgtcagattatgagtgtgactttagctatactggagagcatattcaaagcctcaatgaaagtggttttgtgccgatagcagaaagtgaagtaacacaagaggaaatcgattccgcacttcatacagcaagctcaataaaattgccagaaggcttatctttattgcatgttattccacaagaatacgctgttgatcgtcagatgaacattaaaaatccattgggattacaaggcgtgcgtttaaaagcacaagtacatttgatcgcttgtcatcaagattggcaaaataacttaaaaaaagccgttgaacgttgtggattgcaagtggataaagtggttttctctggttttgcagcaacacattctgtgctaactgaggatgaaaaagatctcggcgtgtgtttaattgattttggtgctggcacaatgaacgtgatggtttatacgaatggcgcattacgttttagcaaggtaattccttacgcaggaaatattgtgacaaatgatattgcgcacgcttgtacaatttcgcgagcagaagcagaacggatcaaagtgaactatgctagtgcattttacccagctcgtttgcacggagataaaaaaattgaggtggcaagtattggcggtcgtgcgcctcgttcattaacaaaaagtgatttatctttaattacatcagctcgttatacggagcttttaggcgtggtaaaagatgaattagataagttaaaagctgaattagaagcaaaacatattaaatttgaattaattgcaggtgtggtaataactggtggtggagcgcagattgaagatcttaaagaatgtgcttcaaatgttttccattgtcaggtgcgtattgcgagtccattaaatattactggtttgactgattacgtgaatcgtccacaatattcaacggtggtgggattattgcaatataatcacagtaatagtgatgatgatttaatttcaggaagtgatgattctgaaggaactttctttgaatctatttggcaaggagtaaaaaaaattgtcaataaagtgcggtcagaattt

SEQ ID NO: 198 - protein, 352 aa, Haemophilus influenzae
  Name: NTH0108
LSDYECDFSYTGEHIQSLNESGFVPIAESEVTQEEIDSALHTASSIKLPEGLSLLHVIPQEYAVDRQMNIKNPLGLQGVRLKAQVHLIACHQDWQNNLKKAVERCGLQVDKVVFSGFAATHSVLTEDEKDLGVCLIDFGAGTMNVMVYTNGALRFSKVIPYAGNIVTNDIAHACTISRAEAERIKVNYASAFYPARLHGDKKIEVASIGGRAPRSLTKSDLSLITSARYTELLGVVKDELDKLKAELEAKHIKFELIAGVVITGGGAQIEDLKECASNVFHCQVRIASPLNITGLTDYVNRPQYSTVVGLLQYNHSNSDDDLISGSDDSEGTFFESIWQGVKKIVNKVRSEF

SEQ ID NO: 199 - DNA, 1488 bp, Haemophilus influenzae
  n 169: n is any nucleotide
  Name: NTH0109
atgatgcgaagaaaagcaaaaattaggcaaaaaggaacgtacgccttagtaaacgatggggatgtccttattcacgattggaaagcaattatcagatttgcctgtaaagaaaaagtggtttccgagttaaagtcgcttgctaaaaaagcagatcacatttatctcgcanccgacttggatagagaaggggaagcgattgcatggcatttacgtgaagtgattggtggtaacaatgatcgttttagtcgcgtggtgtttaacgaaatcactaaaaatgccattaaacaggcttttgaaaagcctgaacaattaaatatggatcgagttaatgcccaacaaactcgtcgttttttagatagagtagtgggctttatggtgtcaccattactttggaaaaaagtggcacgcgggctttctgctggtcgagttcaatcggttgcggttaaattattagtcgaacgcgagcgtgaaattaaagcgttccagcctgaagaatattgggaagttgccgtccttacgaataatcaaaataaacaagctatacgcttggatgttacggattataaaggcaagaaatttgatccaaaaaatcaaaaagaagcacaaagtgcggtagattttctgaatgtttcagattacgttgtcacagatttggaaactaagccaacaagttctcgccctcgagcaccatttattacatcaacacttcaacaaacggcaagtactcgcttgggatttggcgttaagaagacaatgatgttagcccaacgtttatatgaagcgggttacattacttatatgcgtacggattcaaccaatttgagtcaagatgcgctgaatatggcgcgtagctatattgaaaatcattttggtgcacaatatttaccagaaaaaccaaatttttattctagtaaagaaaatgcacaagaggcacatgaggctattcgtccatcggatattcgagcattgcctgaatccttagagggaatggaaaaagatgcggtgcgcctttatgatttaatttggcgtcaatttttagcatgtcaaatgccacctgcacaatatgatagtagcacgctgaccgtttccgcaggcgattataccttgaaagcaaaaggcagaattttacgttttgatggttggacaaaagtattgccacagataggtaaaaatcctgaagatcaagaattgccttcagttactgtgtcagaaaaacttgctttaaaagaagtgcaaccaacacaacactttaccaaaccacctgctcgttttactgaagcggctttagtaaaagaattggaaaaacgtggtattggcagaccttccacttatgcggcaattatttccactattcaagaacgtggttatgttcgcactgaaaatcgtcgtttctatgcagaaaagatgggcgaaattgtgactgatcgcctcaatgagtcttttggcgaattaatgaattacgatttcaccgcgaatatggaagatacc

SEQ ID NO: 200 - protein, 496 aa, Haemophilus influenzae
  Xaa 57: Xaa is any amino acid
  Name: NTH0109
MMRRKAKIRQKGTYALVNDGDVLIHDWKAIIRFACKEKVVSELKSLAKKADHIYLAXDLDREGEAIAWHLREVIGGNNDRFSRVVFNEITKNAIKQAFEKPEQLNMDRVNAQQTRRFLDRVVGFMVSPLLWKKVARGLSAGRVQSVAVKLLVEREREIKAFQPEEYWEVAVLTNNQNKQAIRLDVTDYKGKKFDPKNQKEAQSAVDFLNVSDYVVTDLETKPTSSRPRAPFITSTLQQTASTRLGFGVKKTMMLAQRLYEAGYITYMRTDSTNLSQDALNMARSYIENHFGAQYLPEKPNFYSSKENAQEAHEAIRPSDIRALPESLEGMEKDAVRLYDLIWRQFLACQMPPAQYDSSTLTVSAGDYTLKAKGRILRFDGWTKVLPQIGKNPEDQELPSVTVSEKLALKEVQPTQHFTKPPARFTEAALVKELEKRGIGRPSTYAAIISTIQERGYVRTENRRFYAEKMGEIVTDRLNESFGELMNYDFTANMEDT

SEQ ID NO: 201 - DNA, 804 bp, Haemophilus influenzae
  Name: NTH0110
atgcctcccaaacatttaaatatattaggagaaatgaatagaaaaacaaatggtggagtagaaagttatatttataaaaagttttttgaacgctttaatcagatgtcatcagccttagagtatagttattctcgtactccagataattttcatctaagtgaatttcttgctcttttttggttagaacccggtttaaaacgaagtattgataaagtttatgaaatagttgtttatgcgttgttttcatctttaatagaggctttaggcgttaaagtaaaaattgatttagatttatcgaatattgatttgttaaaggagtttgaagattttactcgtcaaattatttctcttgatagtgagaatactagtttggaacttaatgcaaaaattaatagagttggtgtaacaaatgcttcagatcggggtttggatatgtgggctaattttggtatggcaattcaaataaaacatttatcattaactgaagaattagctgaaaacattgtatcttcagtttcatctgaccgaatagttattgtatgtaaagagagtgaagaaaaacttattttgtctttattaaatcaaattggttggcgttctaagattcagagtattatcactgaggcagatctaataaaatggtacgataaagcattgcgcgggaaatctgcatatttagtgggaagcaagatattagaacatatcagaaatgaaataagtttagaatttcctgcaaccgatatagtagatttcaatcacttttttcatgaatgtgaatacaataaagcattagatattgagaaa

SEQ ID NO: 202 - protein, 268 aa, Haemophilus influenzae
  Name: NTH0110
MPPKHLNILGEMNRKTNGGVESYIYKKFFERFNQMSSALEYSYSRTPDNFHLSEFLALFWLEPGLKRSIDKVYEIVVYALFSSLIEALGVKVKIDLDLSNIDLLKEFEDFTRQIISLDSENTSLELNAKINRVGVTNASDRGLDMWANFGMAIQIKHLSLTEELAENIVSSVSSDRIVIVCKESEEKLILSLLNQIGWRSKIQSIITEADLIKWYDKALRGKSAYLVGSKILEHIRNEISLEFPATDIVDFNHFFHECEYNKALDIEK

SEQ ID NO: 203 - DNA, 777 bp, Haemophilus influenzae
  n 772, 773, 774, 775, 776: n is any nucleotide
  Name: NTH0112
atgttaatggatgccttagcccgttctttaaatattcccactgtaaatattggtatgaaagttggcttgagcaaagtcattgacacgcaaaaagcgatgggctgggacaacgtggaaattcctaaagtgcctgcgatgttgctcggttcttatagcatttcgccttatgatgtcacaaaactttatcaaacccttgccaatcaaggtgggagaattgcgcttacaaccgtcgatagtattgcagatcgtcaaggtaacctaatttttcaacacgataaaagtgcaaaacaagtggtgccacaagaagcggcattccaaaccttatttgcaatgcaacaaactgttgaacgtggtacagctcgcagtttgcaaaaggattacgctgatttacatttagcaggcaaaacaggcacaaccaatgaatcacgcgatacgtggtttgtgggaattgacggaaaaaatatcagcaccgtctggcttggtcgcgatgataatggcgaaacaaaactgactggtgcttctggcgcattgcaaatttataaagattatttaaaccgtacaaatattgaaaaattagcaattactccccctacaacagtgaaatgggtggggataaatcaatacggtgactgggattgtgagagttatcgaacaattcctgtttggctaaataatggtcagaatttctgtggcgaaacatcatctccctctctcacgccaacaactgaaacagaaacaccaccacaagaaagccgtgggacgtatggatatnnnnnt

SEQ ID NO: 204 - protein, 259 aa, Haemophilus influenzae
  Xaa 258, 259: Xaa is any amino acid
  Name: NTH0112
MLMDALARSLNIPTVNIGMKVGLSKVIDTQKAMGWDNVEIPKVPAMLLGSYSISPYDVTKLYQTLANQGGRIALTTVDSIADRQGNLIFQHDKSAKQVVPQEAAFQTLFAMQQTVERGTARSLQKDYADLHLAGKTGTTNESRDTWFVGIDGKNISTVWLGRDDNGETKLTGASGALQIYKDYLNRTNIEKLAITPPTTVKWVGINQYGDWDCESYRTIPVWLNNGQNFCGETSSPSLTPTTETETPPQESRGTYGYXX

SEQ ID NO: 205 - DNA, 105 bp, Haemophilus influenzae
  Name: NTH0113
ttggcggtttacaaacgcaattatgcaggctttaatcgtgcattaatggcaaaacgtcagattggttctttagtaaaacctttttattatttgcccgcacctttc

SEQ ID NO: 206 - protein, 35 aa, Haemophilus influenzae
  Name: NTH0113
LAVYKRNYAGFNRALMAKRQIGSLVKPFYYLPAPF

SEQ ID NO: 207 - DNA, 96 bp, Haemophilus influenzae
  Name: NTH0114
atggtttttaaccccccaggtcaagcagaaaatgcaatggtcaaaaccgttttgcaattccaactgaaaatgaaaatcccccccatagaggagcga

SEQ ID NO: 208 - protein, 32 aa, Haemophilus influenzae
  Name: NTH0114
MVFNPPGQAENAMVKTVLQFQLKMKIPPIEER

SEQ ID NO: 209 - DNA, 837 bp, Haemophilus influenzae
  n 819: n is any nucleotide
  Name: NTH0115
ttgaatgaattgaccttatctgaaatggcgattattgctggtttacctaaagcaccttcaacaatgaatccgctttattcgctaaaacgttcagaagaacgtcgcaatgtggtgctaagccgtatgttagatgaaaaatacatcagcaaagaagaatatgatgctgcattgaaagagccgattgtggcgagttatcacggcgcaaaatttgaatttcgtgctgattatgtcactgaaatggtgcgtcaagaaatggtgcgtcgttttggcgaagaaaatgcttacaccagtggttataaagtatttaccactgtactttcaaaagaccaagctgaagcccaaaaagctgtgcgtaataacttgattgattatgatatgcgtcacggttatcgcagtggcgcgccattatggcaaaaaaatgaagccgcttgggacaatgatcgcattgtcggttttctacgcaagctacctgattcagagccatttattcctgcggcagtgattgaaattgcaaaaggcggtgctgatatattgctcgcttctggggaaaaaatgaccttatcaaccaatgcaatgcgttggacaggcagaagcaatcctgtgaaagtcggcgagcaaatttggattcgtcagcgtgctaatggggaatggcaattaggacaaattcccgcagcaaattcagcattagtttctcttaattcagataatggcgcgattgaagcagtggtgggcggatttagttatgaacaaagtaaattcaatcgagccacacagtctttagttcaagtgggttcttctattaaaccatttatttacgcngcagcattagaaaaagct

SEQ ID NO: 210 - protein, 279 aa, Haemophilus influenzae
  Name: NTH0115
LNELTLSEMAIIAGLPKAPSTMNPLYSLKRSEERRNVVLSRMLDEKYISKEEYDAALKEPIVASYHGAKFEFRADYVTEMVRQEMVRRFGEENAYTSGYKVFTTVLSKDQAEAQKAVRNNLIDYDMRHGYRSGAPLWQKNEAAWDNDRIVGFLRKLPDSEPFIPAAVIEIAKGGADILLASGEKMTLSTNAMRWTGRSNPVKVGEQIWIRQRANGEWQLGQIPAANSALVSLNSDNGAIEAVVGGFSYEQSKFNRATQSLVQVGSSIKPFIYAAALEKA

SEQ ID NO: 211 - DNA, 930 bp, Haemophilus influenzae
  n 917, 918, 919, 920, 921: n is any nucleotide
  Name: NTH0116
atgaaaaacgaaattgatattaaaaaactccgtaacatcgccattattgcgcacgtagaccatggtaaaaccactcttgtagataaacttcttcaacaatctggtacttttgaatctgctcgtggtgatgtggatgaacgagttatggactcaaacgatcttgaaaaagaacgtggcattaccattcttgcaaaaaataccgcgattaactggaatgactaccgcattaacatcgtagatactccagggcacgcagacttcggtggcgaagttgaacgtgtactttctatggtggattctgttctattagttgttgatgcgtttgatggcccaatgccacaaacgcgtttcgtgacacaaaaagcattcgctcatggtttaaaacctattgtcgtaattaataaagttgatcgccctggtgcgcgtccagactgggttgtggatcaagtatttgacttatttgtcaatcttggtgcaagcgatgaacaattagacttcccaattatctatgcttcagcgctaaatggtgttgcaggtcttgaacacgaagatttagcggaagatatgacgccattatttgaagccattgtgaaatatgtagaatcgcccaaagtagaacttgatgcgccattccaaatgcaaatttcacaattagactacaacaactatgtaggcgttattggtattggtcgtattaagcgcggttcgattaaaccaaaccaacctgttactatcatcaatagtgaaggaaaaactcgtcaaggtcgtatcggtcaagtacttggacatcttggtttacaacgttatgaaagagacgttgcctatgcttgcgatattgttgctatcactggttcaggagaattaatatttctgataccatttgtgatatcaacgcagttgaagcactgtcatttttnnnnnttaattaat

SEQ ID NO: 212 - protein, 310 aa, Haemophilus influenzae
  Xaa 306, 307: Xaa is any amino acid
  Name: NTH0116
MKNEIDIKKLRNIAIIAHVDHGKTTLVDKLLQQSGTFESARGDVDERVMDSNDLEKERGITILAKNTAINWNDYRINIVDTPGHADFGGEVERVLSMVDSVLLVVDAFDGPMPQTRFVTQKAFAHGLKPIVVINKVDRPGARPDWVVDQVFDLFVNLGASDEQLDFPIIYASALNGVAGLEHEDLAEDMTPLFEAIVKYVESPKVELDAPFQMQISQLDYNNYVGVIGIGRIKRGSIKPNQPVTIINSEGKTRQGRIGQVLGHLGLQRYERDVAYACDIVAITGSGELIFLIPFVISTQLKHCHFXXLIN

SEQ ID NO: 213 - DNA, 729 bp, Haemophilus influenzae
  Name: NTH0117
atggcgggtgcaggcgtaaaagcttatttattaccacgcaaattaccgactccagttttagcctatgctatccaatattttgataccactgcaggtgtaatggtaacagcaagccataacccaccagaagataatggctacaaagtgtatttaggtaaagcaaatggtggcggtcaaatcgtttcaccagcagataaagacatcgcagcattaattgataaagttgcggctggcaatatccaagatttaccacgtagcgataattatgtggtgttaaatgatgaagtggtagatgcgtacattacaaaaactgcatcattagctaaagaacccgcttgcgacattaactatgtttataccgctatgcatggtgttggctatgaagttttaagtaaaacactggcaaaagcaggattaccacaaccccacgtagtcgcagatcaagtttggccagatggcacattcccaacggtgaatttcccaaatccagaagaaaaaggcgcattggatttagcaattaaagtggcaaaagaaaagaacgctgaatttatcattgcgaatgacccagatgcagaccgtttagccgttgctgtgcctgatgcacaaggcaactggaaatcactacacggtaacgtggttgggctgtttcttagggtggtatttggcaaaacaatatcaaggcaaacaaggtacattggcttgctcacttgtttcttccccagctcttgc

SEQ ID NO: 214 - protein, 243 aa, Haemophilus influenzae
  Name: NTH0117
MAGAGVKAYLLPRKLPTPVLAYAIQYFDTTAGVMVTASHNPPEDNGYKVYLGKANGGGQIVSPADKDIAALIDKVAAGNIQDLPRSDNYVVLNDEVVDAYITKTASLAKEPACDINYVYTAMHGVGYEVLSKTLAKAGLPQPHVVADQVWPDGTFPTVNFPNPEEKGALDLAIKVAKEKNAEFIIANDPDADRLAVAVPDAQGNWKSLHGNVVGLFLRVVFGKTISRQTRYIGLLTCFFPSSC

SEQ ID NO: 215 - DNA, 252 bp, Haemophilus influenzae
  Name: NTH0118
ttgctgtgcctgatgcacaaggcaactggaaatcactacacggtaacgtggttgggctgtttcttagggtggtatttggcaaaacaatatcaaggcaaacaaggtacattggcttgctcacttgtttcttccccagctcttgctgaaattgcgaaaaaatacgggttccaatcagaagaaaccttaactgggttcaaatacattggtaaagtatctggcttattggtcggttttgaagaggcatgggctatc

SEQ ID NO: 216 - protein, 84 aa, Haemophilus influenzae
  Name: NTH0118
LLCLMHKATGNHYTVTWLGCFLGWYLAKQYQGKQGTLACSLVSSPALAEIAKKYGFQSEETLTGFKYIGKVSGLLVGFEEAWAI

SEQ ID NO: 217 - DNA, 267 bp, Haemophilus influenzae
  n 258, 259, 260, 261, 262: n is any nucleotide
  Name: NTH0119
atgcagcaaacaaaacgttcgctattgggtttgcttatttctttgatcgcacacggtattattataggatttatcttatggaattggaatgagccaagtgatagtgcaaatagcgcacaaggcgatatatctacaagtatttctatggaactattacagggcatggtgttggaagaacctgctccagagccagaagatgtacaaaaagagccagagcctgagccagaaaatgtcaaaaagagccagaaccagaaaaannnnnttaat

SEQ ID NO: 218 - protein, 89 aa, Haemophilus influenzae
  Xaa 86, 87, 88: Xaa is any amino acid
  Name: NTH0119
MQQTKRSLLGLLISLIAHGIIIGFILWNWNEPSDSANSAQGDISTSISMELLQGMVLEEPAPEPEDVQKEPEPEPENVKKSQNQKXXXN

SEQ ID NO: 219 - DNA, 441 bp, Haemophilus influenzae
  Name: NTH0120
gtgaaaaaattcgatgaaatcaacattatccctttcattgatattatgttggtgctacttactgtggtgcttattactgcatcttttatctctcaaggtaaaattcaagtaaatgtaccaaaagctagtacagcggtcgcatttaaatctgacgagctagctaaattattgacagtgacagcggataaacaactctattttaatgataaacctatttctcaagaagctctagaggcagaaattgctcaatggaataaagatcagaaagtaactttaaaaattgatgccgaagcctctttccaagattttgtgacgattacagatatgctttctaaaaatgaaatcaaaaatgtggcaattgtttctatgaaagataagggaaaaagtgcgggtgaaaattctcaagaatctactccttcccaatctgtaccaactacgccg

SEQ ID NO: 220 - protein, 147 aa, Haemophilus influenzae
  Name: NTH0120
VKKFDEINIIPFIDIMLVLLTVVLITASFISQGKIQVNVPKASTAVAFKSDELAKLLTVTADKQLYFNDKPISQEALEAEIAQWNKDQKVTLKIDAEASFQDFVTITDMLSKNEIKNVAIVSMKDKGKSAGENSQESTPSQSVPTTP

SEQ ID NO: 221 - DNA, 147 bp, Haemophilus influenzae
  Name: NTH0121
atgttgcacttatctttagcattaaaagcaactgcattaggtattctagtggctattccctctatggtgttttataacggtttggggcgtaaagttgaagttaatcgtttaaaatggaaagtattaagcgaacaaaaagataaggaa

SEQ ID NO: 222 - protein, 49 aa, Haemophilus influenzae
  Name: NTH0121
MLHLSLALKATALGILVAIPSMVFYNGLGRKVEVNRLKWKVLSEQKDKE

SEQ ID NO: 223 - DNA, 168 bp, Haemophilus influenzae
  Name: NTH0122
ttgttgcttggagtagatatttccgcatatcaaggcaaacgccaccgtattaatatcagcttgcctgaataccttatcaaacgtattgatagccgtgttgcaagcaatccaatctacaaagaccgcagccactttttagcgattgcctcacaaaaagagctacggcaa

SEQ ID NO: 224 - protein, 56 aa, Haemophilus influenzae
  Name: NTH0122
LLLGVDISAYQGKRHRINISLPEYLIKRIDSRVASNPIYKDRSHFLAIASQKELRQ

SEQ ID NO: 225 - DNA, 507 bp, Haemophilus influenzae
  Name: NTH0123
atggcttgtagtgttgatgatattaaaaaagcacacgggaaacgaactgaagggcggttaaaaattcagatgattaagttacaaggcggtgtgcttgcgccacttgatgaactggaatcagaagaattgaaatcattaaaaaatggcgagcagtatgaaattgaaatcatccgtacacgcaatcccgctttccatcgtaaggtgttcgccttttttaaattctgttttaaccattgggctgcagataaaacagaatgggaacactttgatgagcgcaagcaatttgacacctttcgtaaacatctaacggtattggcgggattttacgaatctacatacaacattaaaggggatttgcggattgaggcgcaatccttgagttatgggaatatggagcaagcagagtttgaaagctgttacaaagcgttaattagtgcagcaatcaagcatatttttaacgatacaaccgatgaaaatacgttaaatcagttgtatgcgttttttggg

SEQ ID NO: 226 - protein, 169 aa, Haemophilus influenzae
  Name: NTH0123
MACSVDDIKKAHGKRTEGRLKIQMIKLQGGVLAPLDELESEELKSLKNGEQYEIEIIRTRNPAFHRKVFAFFKFCFNHWAADKTEWEHFDERKQFDTFRKHLTVLAGFYESTYNIKGDLRIEAQSLSYGNMEQAEFESCYKALISAAIKHIFNDTTDENTLNQLYAFFG

SEQ ID NO: 227 - DNA, 399 bp, Haemophilus influenzae
  Name: NTH0124
atgccgattgagcaaatgttagatgtattgttggatgaagtcgcagaacgttgttcggctccgttaagaatctatgtgaatccaccttattccaacgttacaccatatctacaacgtgcgaaagaattatgtgatgctggttatttagtcgtgatgttactcaacaatgataaatctactcaatggtatcaaaaccatattcaaggcgtggcaaatgaagtgattgatattacaggtggtcgaattgcatttatcaaccctgtaacaggaaaagaaatcaaggggaatagcaaagggcaaatggtcgtagtctttgatccaacaatggaagactttgtcacacgttcaattagccttgattttattaaaaaggttagtgggtatatccgcatggagaaa

SEQ ID NO: 228 - protein, 133 aa, Haemophilus influenzae
  Name: NTH0124
MPIEQMLDVLLDEVAERCSAPLRIYVNPPYSNVTPYLQRAKELCDAGYLVVMLLNNDKSTQWYQNHIQGVANEVIDITGGRIAFINPVTGKEIKGNSKGQMVVVFDPTMEDFVTRSISLDFIKKVSGYIRMEK

SEQ ID NO: 229 - DNA, 150 bp, Haemophilus influenzae
  Name: NTH0125
gtgcttttctccacgctttgttggcgtaatttcgttcaaatagaaaataatgtatcaggttgcaatccttgcgcttgcaattctattttcttttcctcttccgcaccccatttcatgttgcattggcgtaattttggcgtaatcgatgca

SEQ ID NO: 230 - protein, 50 aa, Haemophilus influenzae
  Name: NTH0125
VLFSTLCWRNFVQIENNVSGCNPCACNSIFFSSSAPHFMLHWRNFGVIDA

SEQ ID NO: 231 - DNA, 231 bp, Haemophilus influenzae
  Name: NTH0126
ttgtgttttgatattaagtctagtgtgcttgatgcaacattccgaaaactcaaaaaacttgccgagcgagaatatttgcattttcacgacacacggcgtgaggcattgactagactatctaaaaaagtagatgtgatgacattagccaaaatatctgggcataaagatatttcgattttacaaaatgtctattatgcccctgatatggcggaggtggcggaattactcgat

SEQ ID NO: 232 - protein, 77 aa, Haemophilus influenzae
  Name: NTH0126
LCFDIKSSVLDATFRKLKKLAEREYLHFHDTRREALTRLSKKVDVMTLAKISGHKDISILQNVYYAPDMAEVAELLD

SEQ ID NO: 233 - DNA, 387 bp, Haemophilus influenzae
  Name: NTH0127
atggaaccaattaaactttcgcagaaagccgaagaagaaattgtgaatgcggcaaaaatggcggcgttatctaatttgaccgagaaaagccaaaatttaattacgcttgaggatatcgcaatatattttgggcgacactatcaaaccgttgccaagattatttcaaaactgcctaatttcccaaaacccgttacagtcgatcaacaaaattctcgcccacgctatatcgcaggcgaagttgttcgttggggcggatcaatgctaaacatattagctaatcgagtaattccgccacctccgccatatcaggggcataatagacattttgtaaaatcgaaatatctttatgcccagatattttggctaatgtcatcacatctacttttt

SEQ ID NO: 234 - protein, 129 aa, Haemophilus influenzae
  Name: NTH0127
MEPIKLSQKAEEEIVNAAKMAALSNLTEKSQNLITLEDIAIYFGRHYQTVAKIISKLPNFPKPVTVDQQNSRPRYIAGEVVRWGGSMLNILANRVIPPPPPYQGHNRHFVKSKYLYAQIFWLMSSHLLF

SEQ ID NO: 235 - DNA, 333 bp, Haemophilus influenzae
  n 320, 321, 322, 323, 324: n is any nucleotide
  Name: NTH0128
atgagcgaaaaatatgtggtaacttgggatatgtttcaaatgcatgcccgcagattatcagaacgtttacttccagcttcccaatggaaaggtattattgcggtgagtcgcggtggtttgtttccagcggctgtattggctagagaattgggtcttcgtcatattgaaaccgtttgtatcgcaagttatcacgatcataacaatcaaggtgaactacaagttcttcatgcagcccaagtgccaaatggcggcgaaggatttatcgtggtagatgggggatcccctaagagtcgacctgcagggctagccaagtctggccnnnnnttaattaat

SEQ ID NO: 236 - protein, 111 aa, Haemophilus influenzae
  Xaa 107, 108: Xaa is any amino acid
  Name: NTH0128
MSEKYVVTWDMFQMHARRLSERLLPASQWKGIIAVSRGGLFPAAVLARELGLRHIETVCIASYHDHNNQGELQVLHAAQVPNGGEGFIVVDGGSPKSRPAGLAKSGXXLIN

SEQ ID NO: 237 - DNA, 93 bp, Haemophilus influenzae
  Name: NTH0129
ttgcaccttagtttaaatttatcgagaaataaaaaattgcgtaaggataacccgaaatggcgttttatgctattatttcgtaaatattttcag

SEQ ID NO: 238 - protein, 31 aa, Haemophilus influenzae
  Name: NTH0129
LHLSLNLSRNKKLRKDNPKWRFMLLFRKYFQ

SEQ ID NO: 239 - DNA, 552 bp, Haemophilus influenzae
  Name: NTH0130
atgtctgaaattacaacacttcaaccttcactgttatggaaatggttcgatcaaatttgtgcaatccctcatccttctcattatgaagatacgttagctaactttattgtaaattgggcaaaagaaaagcatttttttgttgaacgcgatgaagtggggaatattctcattcgtaaacccgcgacgaaaggaatggaaaatcacacgcctgttgtgctacaagcccatctagatatggtgccacaggctaatgaaggcaatccacatgattttaccaaagatccaattcaaccttatattgatggagaatgggtgaaagcacgaggtaccacattaggagctgacaatggtatcggtttagcctctactttagcggtgttagaaagcaatgatttagcccatccacctcttgaagtgcttttaacaatgacagaagaaacaggcatggatggcgcaaaaggcttacgtcatagctggttacaatctgaaattttaatcaatacagataccgaagaaattggcgaaatttacattgggttgtgcgggcgggat

SEQ ID NO: 240 - protein, 184 aa, Haemophilus influenzae
  Name: NTH0130
MSEITTLQPSLLWKWFDQICAIPHPSHYEDTLANFIVNWAKEKHFFVERDEVGNILIRKPATKGMENHTPVVLQAHLDMVPQANEGNPHDFTKDPIQPYIDGEWVKARGTTLGADNGIGLASTLAVLESNDLAHPPLEVLLTMTEETGMDGAKGLRHSWLQSEILINTDTEEIGEIYIGLCGRD

SEQ ID NO: 241 - DNA, 105 bp, Haemophilus influenzae
  n 96, 97, 98, 99, 100: n is any nucleotide
  Name: NTH0131
ttgggttgtgcgggcgggattaacgcaaactttgaaattcccgttcaatatgaaaccaatacgtttgagcgcagcgcacaaatcacccttaagggnnnnnttaat

SEQ ID NO: 242 - protein, 35 aa, Haemophilus influenzae
  Xaa 33, 34: Xaa is any amino acid
  Name: NTH0131
LGCAGGINANFEIPVQYETNTFERSAQITLKGXXN

SEQ ID NO: 243 - DNA, 693 bp, Haemophilus influenzae
  Name: NTH0132
ttgattacaggattattggttttagctggcacagcacaagctcatgaagtttgggttcaagcaccgacgaaattaacatctggttctgtattaaaagcagaattagcttatggggattacccttatgtagaaaaaattcctgaagcacgtttaaaaatttttgcaccaatggaaattattcgtcaagatggagaaaaacaaaccttaatccaaaaaggcgaaaactatcaatatcaatcagagaaagcattgtccgatggttcttattgggtaacagcgacttataaacctactttttggtcacaaaatgctgaaggttggaaaatggataatttgaaagaattagaaaatcccacttattgtgaacaaactcaaatgtttggcaaaagtcttgttaccgttggtaaaaaaccattaaatgcagaaatggcaatgacaagagttggtttaccactggaaattgttcctttgcgtgatcctagcaaagcgaaatcaggcgaaccgttccctgttcaaattttctaccaagatcagccattagcaggcgaaactgtcatcgcaaccgctgatactattatcgtgaaagatcttgaagcaagtacaggtcatcgtgaaccaccaggtttttcaggtaaaacagatagtcaaggacgtgtgaatatcattccattaattgatggtattttggaaaat

SEQ ID NO: 244 - protein, 231 aa, Haemophilus influenzae
  Name: NTH0132
LITGLLVLAGTAQAHEVWVQAPTKLTSGSVLKAELAYGDYPYVEKIPEARLKIFAPMEIIRQDGEKQTLIQKGENYQYQSEKALSDGSYWVTATYKPTFWSQNAEGWKMDNLKELENPTYCEQTQMFGKSLVTVGKKPLNAEMAMTRVGLPLEIVPLRDPSKAKSGEPFPVQIFYQDQPLAGETVIATADTIIVKDLEASTGHREPPGFSGKTDSQGRVNIIPLIDGILEN

SEQ ID NO: 245 - DNA, 150 bp, Haemophilus influenzae
  Name: NTH0133
ttgatggtattttggaaaattaaagttattcataaaacaccatttgcagatcaacaaatttgtcagcaatctgcaagctatagcacattaattttaccggttggtaaaggattagctaaactacctccaaaaccagaacaccatcatcac

SEQ ID NO: 246 - protein, 50 aa, Haemophilus influenzae
  Name: NTH0133
LMVFWKIKVIHKTPFADQQICQQSASYSTLILPVGKGLAKLPPKPEHHHH

SEQ ID NO: 247 - DNA, 546 bp, Haemophilus influenzae
  Name: NTH0134
ttgctggtgggggtaagtaccaaagctgatgcttacggcttagttcgagccaaacaagcacagattccgcaagcggtctttcttcgcaaaaattttcccaataacctcgaaatggacgacgccattggcgattatttgcaaagcctagccgtagatttgatcgtccttgctggttatatgaaaattcttaccccaaaatttacccaacgttttgcagggaaaattttaaatatccatccttctcttcttcctaaatacgcaggcttaaacacctaccaacgtgcgattgaagcaggcgacaatgaacacggtacaaccgttcattttgtcaatgaagaagtagatggtggtgcgattgtcttacaggcgaaagtgccaatcttccctgaagatagcatcgaagaagtggaggctaaaacccgtgagcaagaatatcaaatttatccgcttgtgattaaatggtttaccgaagggcgattaagacttaaagataatttggcatatctagatgggaaagctctgccaaaatctggatatgcaaatgaa

SEQ ID NO: 248 - protein, 182 aa, Haemophilus influenzae
  Name: NTH0134
LLVGVSTKADAYGLVRAKQAQIPQAVFLRKNFPNNLEMDDAIGDYLQSLAVDLIVLAGYMKILTPKFTQRFAGKILNIHPSLLPKYAGLNTYQRAIEAGDNEHGTTVHFVNEEVDGGAIVLQAKVPIFPEDSIEEVEAKTREQEYQIYPLVIKWFTEGRLRLKDNLAYLDGKALPKSGYANE

SEQ ID NO: 249 - DNA, 258 bp, Haemophilus influenzae
  n 151, 152, 154, 158, 159, 161, 166, 171, 177, 186, 188, 189, 190, 191, 192, 200, 201, 202, 203, 204, 205, 216,228, 249, 250, 251, 252, 253: n is any nucleotide
  Name: NTH0135
ttgggcggggaaatttgccttaatgggcaggctacaaaaaaagggttgggaaaatttggccctttgcccaaaaaaaagagacggcggaatttttttcacattttctccttcctaaaaaaaaaaaccccccacaggaggggggggggttttnncnaccnntntgccngccgngttttntttttttcncnnnnngttctttnnnnnnccccccccccngcctgtgcgccnccgcgccccccgcccccccgnnnnnttaat

SEQ ID NO: 250 - protein, 86 aa, Haemophilus influenzae
  Xaa 51, 52, 53, 54, 56, 59, 63, 64, 67, 68, 69, 84, 85: Xaa is any amino acid
  Name: NTH0135
LGGEICLNGQATKKGLGKFGPLPKKKRRRNFFHIFSFLKKKTPHRRGGGFXXXXAXRVXFFSXXVLXXXPPPACAPPRPPPPRXXN

SEQ ID NO: 251 - DNA, 114 bp, Haemophilus influenzae
  n 101, 102, 103, 104, 105: n is any nucleotide
  Name: NTH0136
gtggatttttcttatgaagggtctcgcttttttgctggttgggaaggggcattggttgttgttgatgtccgcacaggagtccaaaccccaatctctgcaannnnnttaattaat

SEQ ID NO: 252 - protein, 38 aa, Haemophilus influenzae
  Xaa 34, 35: Xaa is any amino acid
  Name: NTH0136
VDFSYEGSRFFAGWEGALVVVDVRTGVQTPISAXXLIN

SEQ ID NO: 253 - DNA, 174 bp, Haemophilus influenzae
  Name: NTH0137
atgaagaatattcgcaacttttctattattgcccatattgaccacggtaaatcgacactttctgaccgtttgattcaaacttgtggtggactttcggatcgtgaaatggaagcgcaagtgctagattcaatggatcttgagcgtgagcgtgggattaccatcaaagcacaagtg

SEQ ID NO: 254 - protein, 58 aa, Haemophilus influenzae
  Name: NTH0137
MKNIRNFSIIAHIDHGKSTLSDRLIQTCGGLSDREMEAQVLDSMDLERERGITIKAQV

SEQ ID NO: 255 - DNA, 180 bp, Haemophilus influenzae
  Name: NTH0138
ttgcgaatattcttcataaaagatagtttttctcaaaaatcattaaatttaactggcggattgtacctgaaaagtgcggaaatcgctagagatgaaaaggaaaagtgcggtcaaattttcaaacttttagataaaacaaaaccccgaataacttcggggtttcttttttttcattcaaac

SEQ ID NO: 256 - protein, 60 aa, Haemophilus influenzae
  Name: NTH0138
LRIFFIKDSFSQKSLNLTGGLYLKSAEIARDEKEKCGQIFKLLDKTKPRITSGFLFFHSN

SEQ ID NO: 257 - DNA, 381 bp, Haemophilus influenzae
  Name: NTH0139
atgattaaaggtattcaaattactcaagcggcaaatgacaatttgcttaattcattctggttattagacagcgaaaaaaatgaagtgcgttgcttatgtgcaaaaggcgaattcgctgaagaccaagttgttgcagtgagcgaattaggtcaaatcgaataccgtgaattaccagtaaacgtagcaccaactgtaaaagttgaaggtggccaacatttaaacgtgaacgtattacgtcgtgaaactttagaagatgcggtaaataacccagataaatatccacaattaactatccgtgtttctggttacgcagtacgtttcaactctttaacaccagaacaacaacgcgacgttatcactcgtactttcactgaaagccta

SEQ ID NO: 258 - protein, 127 aa, Haemophilus influenzae
  Name: NTH0139
MIKGIQITQAANDNLLNSFWLLDSEKNEVRCLCAKGEFAEDQVVAVSELGQIEYRELPVNVAPTVKVEGGQHLNVNVLRRETLEDAVNNPDKYPQLTIRVSGYAVRFNSLTPEQQRDVITRTFTESL

SEQ ID NO: 259 - DNA, 168 bp, Haemophilus influenzae
  Name: NTH0140
ttgagtaatttgaatacctttaatcataatagcctcctaattggcacgaaaataataataaaactgtacaaattttatcaaatcattttaaaatctcaaattattttagatttatttgataaagagcaggttatttttttaattaatttttataaatttgatctaaat

SEQ ID NO: 260 - protein, 56 aa, Haemophilus influenzae
  Name: NTH0140
LSNLNTFNHNSLLIGTKIIIKLYKFYQIILKSQIILDLFDKEQVIFLINFYKFDLN

SEQ ID NO: 261 - DNA, 234 bp, Haemophilus influenzae
  Name: NTH0141
atgaaaaactggacagacgttatcggaaaagaaaaagaacaaccttactttcaacacgctctacaacaagttcatcttgcaagagcaaacgggaaaacaatttatccaccacaagaagaggtatttaatgcattcaaatataccgcttttgaagatgtaaaagtggtaattttaggtcaagatccttatcacgggtgcaaaccaagcgcacggtttggctttttcagtaaaacc

SEQ ID NO: 262 - protein, 78 aa, Haemophilus influenzae
  Name: NTH0141
MKNWTDVIGKEKEQPYFQHALQQVHLARANGKTIYPPQEEVFNAFKYTAFEDVKVVILGQDPYHGCKPSARFGFFSKT

SEQ ID NO: 263 - DNA, 228 bp, Haemophilus influenzae
  n 223, 224, 225, 226, 227: n is any nucleotide
  Name: NTH0142
atgatgttagaacaaaccacttttaatgcgcctgatggtgcaccttatcagcttataaccctacaaaatgaaaatgggatgcgtgttcaatttctggattggggcgcaacttggctttcttgtaaagtgccagtaaatgacacattacgcgaggttttattgggttgtaaggtagagaatttcccactctaccaaaggggtaccgagtccgaatcgtatacannnnnt

SEQ ID NO: 264 - protein, 76 aa, Haemophilus influenzae
  Xaa 75, 76: Xaa is any amino acid
  Name: NTH0142
MMLEQTTFNAPDGAPYQLITLQNENGMRVQFLDWGATWLSCKVPVNDTLREVLLGCKVENFPLYQRGTESESYTXX

SEQ ID NO: 265 - DNA, 387 bp, Haemophilus influenzae
  Name: NTH0143
ttgaccgcactttctccgttagcagcaaaacgtgctcgtcatgtcgtaacagaaaatcaacgagtacttgatgcggtagaagcattgaagaacaatgatttgacttgtttaggtaaactaatggaagcatctcacgattcaatgcgtgatgattttgaaatcaccgtgccacaaattgattatttagttgaattggctcaacttgttattggcaaaagtggcggtgcacgtatgacgggcggcggttttggtggctgtattgtcgcacttacgccgcatgataaagtcgatgcagttcgtaaaattattgcggataattacgagaaaacgactggtttaaaagaaactttttatgtgtgtaccgcatcacaaggtgtgcgagtgatt

SEQ ID NO: 266 - protein, 129 aa, Haemophilus influenzae
  Name: NTH0143
LTALSPLAAKRARHVVTENQRVLDAVEALKNNDLTCLGKLMEASHDSMRDDFEITVPQIDYLVELAQLVIGKSGGARMTGGGFGGCIVALTPHDKVDAVRKIIADNYEKTTGLKETFYVCTASQGVRVI

SEQ ID NO: 267 - DNA, 591 bp, Haemophilus influenzae
  n 9: n is any nucleotide
  Name: NTH0144
ttgctagcnacgaagcttgacagacttgactgtcgctgcacgtcaactcttataggatcccccggccgtttctggtacaaaacgagagatctggttggatgtttagctagcgctcttgatgaaactgatgaattttctctcaatgttgaaattcctaagagtgaacacaaatgggctaattatgtgcgtggggtggtaaaatttatccaagaacgttacccgcactttcaacaaggtgcaaatttagtgatttctggtaatgtgccgctttcttctggattaagttcttctgcagcgttagaagttgcggtgggtaaattctgccgacaacttggcgatttaccgctctctcacacggatattgcattgaatgggcaaaaggctgaaaaccaatttgacaaagataaatgtggcaatatggatcagttaatttctgcgcttgggcaggaaaatcacttactgatgatcgattgtcgtagtcttgaaactatttcaacaccagtgccacaagatgtcgccgtgattattgtgaattcaaacgtacccgcacgatttagtaacaggcgaatacaatactcgccgtcagcaatg

SEQ ID NO: 268 - protein, 197 aa, Haemophilus influenzae
  Name: NTH0144
LLATKLDRLDCRCTSTLIGSPGRFWYKTRDLVGCLASALDETDEFSLNVEIPKSEHKWANYVRGVVKFIQERYPHFQQGANLVISGNVPLSSGLSSSAALEVAVGKFCRQLGDLPLSHTDIALNGQKAENQFDKDKCGNMDQLISALGQENHLLMIDCRSLETISTPVPQDVAVIIVNSNVPARFSNRRIQYSPSAM

SEQ ID NO: 269 - DNA, 1038 bp, Haemophilus influenzae
  n 1033, 1034, 1035, 1036, 1037: n is any nucleotide
  Name: NTH0145
ttggttcacaacgtggcattacgcgtagaagaaaccccaaacccagatgaattccgtgtatctggtcgtggcgaattacatctttccgtgttaatcgaaaatatgcgtcgtgaaggttatgagcttgccgtttctcgccctaaagtaatctatcgtgatattgatggtaaaaaacaagagccatacgaacaagtaactattgatgtggaagaacaacaccaaggttctgtgatggaagcattgggtatccgtaaaggtgaagttcgtgatatgttgcctgacggtaaaggtcgtgtgcgtttggaatacattatccctagtcgtggattgattggcttccgtggagactttatgacaatgacttctggtacaggcttactttactcaagctttagccactacgatgagatcaaaggtggggatatcggccaacgtaaaaacggcgtattaatttctaatgcgacaggcaaagcacttggctatgcattatttggcttacaagaacgtggtaagttaatgattgatgcaaacgtagaagtttatgaagggcaaattatcggtattcatagccgctcaaatgacttaaccgtaaactgcttgcaaggtaaaaaactaactaatatgcgtgcgtcaggtaaaaatttaccgcactttgtccaaaaagccgtgccgatcaatacaacaaatgtgatttatcaaacggcaaaaggcgtaagtgcaggacaaattataggtattcaatcattttctgatgatcctttggttgaatcttttgatcagactaaatttaatgaaattttgcctagaggggagtttaaactggtcattggtgatcaactggcgcaaaaactgggcgtgaatattggggataaaatccgtttgatgattacggaaaatagccaatatacaccattcggtcgggtgccaatgcagcgtttatttactgttagcgatatttattatggttatggcgaagcatctggttacgaagccttgctaatatacagggtaccgagtcgatattcgataacannnnnt

SEQ ID NO: 270 - protein, 346 aa, Haemophilus influenzae
  Xaa 345, 346: Xaa is any amino acid
  Name: NTH0145
LVHNVALRVEETPNPDEFRVSGRGELHLSVLIENMRREGYELAVSRPKVIYRDIDGKKQEPYEQVTIDVEEQHQGSVMEALGIRKGEVRDMLPDGKGRVRLEYIIPSRGLIGFRGDFMTMTSGTGLLYSSFSHYDEIKGGDIGQRKNGVLISNATGKALGYALFGLQERGKLMIDANVEVYEGQIIGIHSRSNDLTVNCLQGKKLTNMRASGKNLPHFVQKAVPINTTNVIYQTAKGVSAGQIIGIQSFSDDPLVESFDQTKFNEILPRGEFKLVIGDQLAQKLGVNIGDKIRLMITENSQYTPFGRVPMQRLFTVSDIYYGYGEASGYEALLIYRVPSRYSITXX

SEQ ID NO: 271 - DNA, 135 bp, Haemophilus influenzae
  n 126, 127, 128, 129, 130: n is any nucleotide
  Name: NTH0146
ttgccgcttgttttatctaattcatacttcatttttgctccaacgaataaacagttcgaagatttttttgaacaaaaaagcctgttaaaaaatacaggctttgtgatatcatattttcaatgcttnnnnnttaat

SEQ ID NO: 272 - protein, 45 aa, Haemophilus influenzae
  Xaa 42, 43, 44: Xaa is any amino acid
  Name: NTH0146
LPLVLSNSYFIFAPTNKQFEDFFEQKSLLKNTGFVISYFQCXXXN

SEQ ID NO: 273 - DNA, 537 bp, Haemophilus influenzae
  Name: NTH0147
ttggtgtttgaacgtccacaaggcacgttcagtgtagaaacccctgcgtttatgccagtgggtacttatggcacggtaaaaggcatgacaccagaagaagtgcgtgcgacaggtgcagaaattttactgggtaacaccttccatttatggcttcgtccaggtcaagaaattatgcgtaaacacggtgatttgcacgattttatgcaatggcatcgtccgattttgactgacagtggcggtttccaagtattcagtttaggtaaattacgtaaaattaccgaagaaggcgtaaaattccaaaacccaattaacggtgagcgaatcttcctttcgcctgaaaaatccatggaaattcaatatgatttgggttctgatatcgtcatgatttttgatgaatgtacgccttacccagcgactttcgattatgcgaaaaaatctatggaaatgtcacttcgttgggcaaaacgcagccacgatcgctttgatgaattaggcaataaaaatgccctatttggtattatccaagggcggtgtatt

SEQ ID NO: 274 - protein, 179 aa, Haemophilus influenzae
  Name: NTH0147
LVFERPQGTFSVETPAFMPVGTYGTVKGMTPEEVRATGAEILLGNTFHLWLRPGQEIMRKHGDLHDFMQWHRPILTDSGGFQVFSLGKLRKITEEGVKFQNPINGERIFLSPEKSMEIQYDLGSDIVMIFDECTPYPATFDYAKKSMEMSLRWAKRSHDRFDELGNKNALFGIIQGRCI

SEQ ID NO: 275 - DNA, 564 bp, Haemophilus influenzae
  n 26: n is any nucleotide
  Name: NTH0148
ttgattggcttaatgatctattgtgngaaaaaattgactgaaaatgaagaaacgaaaaatatttctcgcgaacaatttgtagcacgttatcaaaccgcttttgaggaagacaaaaaagaggcaaaagaaacaccatcttttggaatttctcattctatatggacaaattttatcgggcaaaaagaaaaacttgcaacctttgcgattagtttttatgactatgaaggtggtgcgcacggtattgaaggtaatcgctatttcacaattgatctaactacacgccatattttgacattaaatgatttatttaatgaaaaagatttaccgaaagtaaaaacgcttttatgggaacaatataataatagcaataaggaatatgaacctattattgaagccgatagttttaatttatcaaacaatatttacttagattcaaaaggtgtacattttatttatgatgtttatgaaatagccccttacgcagcaggagagcaagatttaatgctacattttgggcaactagaagaattatttaaaccagaatttagacagggtaatgatatt

SEQ ID NO: 276 - protein, 188 aa, Haemophilus influenzae
  Xaa 9: Xaa is any amino acid
  Name: NTH0148
LIGLMIYCXKKLTENEETKNISREQFVARYQTAFEEDKKEAKETPSFGISHSIWTNFIGQKEKLATFAISFYDYEGGAHGIEGNRYFTIDLTTRHILTLNDLFNEKDLPKVKTLLWEQYNNSNKEYEPIIEADSFNLSNNIYLDSKGVHFIYDVYEIAPYAAGEQDLMLHFGQLEELFKPEFRQGNDI

SEQ ID NO: 277 - DNA, 174 bp, Haemophilus influenzae
  Name: NTH0149
atggcacttacgaattcctctatcagctttagaacagttgagcaaacaaaatcagaagcttatcaagttattgaacaatatggacttaccccatcacaagtattcaatatgtttttggctcaaattgccaagactcgctctatccctattgatttgaatatcctcccccaaata

SEQ ID NO: 278 - protein, 58 aa, Haemophilus influenzae
  Name: NTH0149
MALTNSSISFRTVEQTKSEAYQVIEQYGLTPSQVFNMFLAQIAKTRSIPIDLNILPQI

SEQ ID NO: 279 - DNA, 717 bp, Haemophilus influenzae
  Name: NTH0150
ttgcaccgattttcaaaaggaaaaaaaatgacaaaacaaaatgaaaaaatcattaattcatccgtaaaaatgctgacaattagtgaagatgaaagtggacaacgaattgataattatttattagcaaaactcaaaggcgtacctaaaagtttaatttatcgcattgtgcgtaaaggcgaagtgcgagtaaacaaaggcagaattaaaccagaatataaactgcaaacaggcgatgttgtacgcattccacctgtgcgtgtcgcagaaaaaaatgatgcgccgatttcaaaaaatctcaataaagttgccgcacttgaaaaccaaattttgtttgaagatgattgcttgattattttaaataaaccctcaggaatcgcggtgcacggcggaagtggtttaaattttggtgtgattgaagccttacgagcattacgcccagaagcacgctttttagaactggttcatcgtttagatcgcgatacatcaggcattttattaattgccaaaaaacgttcagcattacgcaatttgcacgaacaacttcgcgtcaaaaccgttcaaaaagattatttagcgttagtacgtgggcaatggcaatcccatataaaagttattcaagcccctcttttgaaaaatgaattatctagcggagagcgtattgtgcgtgtcagcgagcaaggaaaaccatctgaaactcgctttagcattgaagaacgc

SEQ ID NO: 280 - protein, 239 aa, Haemophilus influenzae
  Name: NTH0150
LHRFSKGKKMTKQNEKIINSSVKMLTISEDESGQRIDNYLLAKLKGVPKSLIYRIVRKGEVRVNKGRIKPEYKLQTGDVVRIPPVRVAEKNDAPISKNLNKVAALENQILFEDDCLIILNKPSGIAVHGGSGLNFGVIEALRALRPEARFLELVHRLDRDTSGILLIAKKRSALRNLHEQLRVKTVQKDYLALVRGQWQSHIKVIQAPLLKNELSSGERIVRVSEQGKPSETRFSIEER

SEQ ID NO: 281 - DNA, 147 bp, Haemophilus influenzae
  Name: NTH0151
ttgcttcattatcgacctcgtgtttctcgcgccagtcaatctcacgactgtatgttgctgggtgcattgataacgttattaagcataaatattcgcttgataaaacaacgcgatattccgcacgcgttgcaagcggctaatttattt

SEQ ID NO: 282 - protein, 49 aa, Haemophilus influenzae
  Name: NTH0151
LLHYRPRVSRASQSHDCMLLGALITLLSINIRLIKQRDIPHALQAANLF

SEQ ID NO: 283 - DNA, 1389 bp, Haemophilus influenzae
  n 618: n is any nucleotide
  Name: NTH0152
atgaccaatgtctgcaagtcctttccgggcgtaaaagccttagataacgcaaacttaacggttcgatcacattctgttcatgccttaatgggtgagaatggcgcgggcaaatctacattactaaaatgtttattcggtatttatgccaaagatgaaggcgaaattcttttcttaggcgaacccgtcaatttcaaaacatctaaagaagcccttgaaaatggtatttcaatggtgcaccaagaactcaatctcgtgcgccaaactagcgtaatggataatttatggcttggacgctatccacttaaaggtccttttgttgatcacgccaaaatgtaccgtgatactaaagcgatttttgatgaattggatattgatgtagatccgaaagaaaaagtcgccaaactttcagtttctcaaatgcagatgatcgaaattgcgaaggcgttctcgtataacgctaaaatcgtaatcatggatgaaccaacatcctcgctttctgaaaaagaagttgagcatctgtttaaaattatcgacaaattaaaacaacgcggttgcggcattatttatatttctcacaaaatggatgaaatcttcaagatctgtgatgaaattactatnttacgcgacggtaaatggatcaacacggtaaacgtgaaagaatccacaatggaacaaattgttggaatgatggtagggcgtgaattaacacagcgtttccctgaaaaaaccaacgtgccaaaagaagttattttgcaggtggaaaatcttaccgctaaaaatcaaccatccattcaagacgtatcttttgaattacgcaaaggtgaaattctcggtattgcaggacttgtgggggctaaacgtaccgatatcgttgaagctatttttggcgtacgtgaattaatcgaaggaacgattaagttacacggaaaaactgtgaaaaatcataccgcacttgaagcgattaataatggctttgcattggttactgaagagcgtcgttcaacggggatttattctaatttaagtattgagtttaattcattgatttcaaatatgaaatcttatctcactccgtggaaattacttagcacgaagaagatgaaaagtgatacccagtgggtaattgattcaatgaatgttaaaacaccatcacacagaactacaattggttctctttctggtggtaaccaacaaaaagtcattattggtcgttggcttttaactcaacctgaaattttgatgctagatgagccgactcgtggtatcgatattggggcaaaatttgaaatttaccaacttattcaagaactcgctaaaaaagataaaggcattattatgatttcatcagaaatgcccgaattactgggtgtgactgatcgcattttagta

SEQ ID NO: 284 - protein, 463 aa, Haemophilus influenzae
  Xaa 206: Xaa is any amino acid
  Name: NTH0152
MTNVCKSFPGVKALDNANLTVRSHSVHALMGENGAGKSTLLKCLFGIYAKDEGEILFLGEPVNFKTSKEALENGISMVHQELNLVRQTSVMDNLWLGRYPLKGPFVDHAKMYRDTKAIFDELDIDVDPKEKVAKLSVSQMQMIEIAKAFSYNAKIVIMDEPTSSLSEKEVEHLFKIIDKLKQRGCGIIYISHKMDEIFKICDEITXLRDGKWINTVNVKESTMEQIVGMMVGRELTQRFPEKTNVPKEVILQVENLTAKNQPSIQDVSFELRKGEILGIAGLVGAKRTDIVEAIFGVRELIEGTIKLHGKTVKNHTALEAINNGFALVTEERRSTGIYSNLSIEFNSLISNMKSYLTPWKLLSTKKMKSDTQWVIDSMNVKTPSHRTTIGSLSGGNQQKVIIGRWLLTQPEILMLDEPTRGIDIGAKFEIYQLIQELAKKDKGIIMISSEMPELLGVTDRILV

SEQ ID NO: 285 - DNA, 741 bp, Haemophilus influenzae
  Name: NTH0153
atgaaatccccctgccacataaacatggattcaattaacattaccggcgggcttgacttttccataacatcccataatcgcaatagtaatgcttttgaaatcaaaaaagacttaactataaatgcaactaattcaaaatttagtcttaaacaaacgaaagatttatttgaaaatcaatacacaggagacgccattaattcaactcgtaatctaactattcttggcggcaatgtcactctgggcggggagaattcaagcagtaacattacaggaaatatcaccatcgctgccgaagcaaatgtcacattacaagcttacgccgacaatagcatcaaaggtcataagaaaaaaactctaactcttggtaatgtgtccacctctggaaacttaagcttaactggctcaaaggtggaggtaaaaggcgatcttgccgttttaaacggtgccacttttaaaggagaaaccaatgacagcctaaacattaccggcacctttaccaacaacggtaccgccgacattaatataaaacgaggggtggtaaacatccaaggtgatattaccaataaaggtggtttaaacattaccactaatgcccaaaaaaatcaaaaaaccattattaacggaaatataaccaacaaaaaaggcaacttaaatattacgaataatggtaatgatactgaaatccaaattggcggcaatatctcacaaaaagaggcaatctcacaatttcttctgacaaag

SEQ ID NO: 286 - protein, 247 aa, Haemophilus influenzae
  Name: NTH0153
MKSPCHINMDSINITGGLDFSITSHNRNSNAFEIKKDLTINATNSKFSLKQTKDLFENQYTGDAINSTRNLTILGGNVTLGGENSSSNITGNITIAAEANVTLQAYADNSIKGHKKKTLTLGNVSTSGNLSLTGSKVEVKGDLAVLNGATFKGETNDSLNITGTFTNNGTADINIKRGVVNIQGDITNKGGLNITTNAQKNQKTIINGNITNKKGNLNITNNGNDTEIQIGGNISQKEAISQFLLTK

SEQ ID NO: 287 - DNA, 720 bp, Haemophilus influenzae
  Name: NTH0154
ttggtagaagacctaaacatttcaggctttaataaagcagaaattacagctaaagatggtagtgatttaactattggtaacaccaatagtgctgatggtactaatgccaaaaaagtaacctttaaccaggttaaagattcaaaaatctctgctaacgatcacaatgtgacactaaatagcaaagtggaaacatctggtaatactgacaacactggagacggcagtggcaataatgccggcttaactattgccgcgaaaaatgtagaagtaaaaaacaacattacttctaacaaaacagtaaatatcaccgcgtcagaaaaacttaccaccaaagcggatgcaaccattaatgcaaccactggcaacgtagaagtgacagccaaaacaggtgatattaaaggtgaagtcaaattcacttccggtaatgtaaatattacagcaaacggcgacacgcttaatgtatgtaatgctccaggcaatgctgttaccatcactgcagataatggcatattaaccacccaagatagctctacgattagcggaactgaaagtgtacccacctcagccatcaggcgatattggcggggcaatttctggtacacggtaagcgttaaagcaaccattgatttatttacccaagcaaattcaaaaattgagtcaaaacacgcgaaggctatgtatcagtgccacatgttaattggcggccaatctttgcaatac

SEQ ID NO: 288 - protein, 240 aa, Haemophilus influenzae
  Name: NTH0154
LVEDLNISGFNKAEITAKDGSDLTIGNTNSADGTNAKKVTFNQVKDSKISANDHNVTLNSKVETSGNTDNTGDGSGNNAGLTIAAKNVEVKNNITSNKTVNITASEKLTTKADATINATTGNVEVTAKTGDIKGEVKFTSGNVNITANGDTLNVCNAPGNAVTITADNGILTTQDSSTISGTESVPTSAIRRYWRGNFWYTVSVKATIDLFTQANSKIESKHAKAMYQCHMLIGGQSLQY

SEQ ID NO: 289 - DNA, 906 bp, Haemophilus influenzae
  n 901, 902, 903, 904, 905: n is any nucleotide
  Name: NTH0155
atggaaattattagtcaatatggttcttggttggtgtggatcacagcagcctttggcttttttatggcgttcggaattggagcaaatgatgtctcaaactcaatgggtacatccgtaggatctggtactgtaacagccaaacaagcaattattattgcgttaatttttgaatctgcaggtgcatatttagctggtggcgaagtaacacaaaccataaaaagtggcgtaatcgacccaatacaatttgttgatacacccgatattttagccttaggtatgctttcaaccttatttgcatcaggtgcttggttatttattgtaaccaaaatgggttggccagtttctggtatacacactattattggtgcaattattggatttgcctgtattacgattggccctagttctgtagattggtcaaatattggcagcatcgttggtagctggtttatcacgcctgtcatctcgggtattttggcttatgcaatctttgcaagtacgcaaaaacttatttttgatactgaacagccattaaaaaatgcacaaaaatatggcccttattatatggggataaccgtgtttgtactttgtatcgtgacgatgaaaaaaggcttaaaacacgtaggcttaaatctttcaaacagtgaaactttaatcatttcacttgccatcagtcttatcggaatgtttttcttccatttctattttaaaagcaaaatcttcactcaatcagcaaacaaaggcacttttggtgccgtagaaaaagtcttcagtattttaatgttattaaccgcttgtgcgatggcatttgcgcacggttctaatgacgtagccaatgcaattggccctctttctgcagtggtctctattgtaaatgaaggcggtaaaattgtttcaggtnnnnnt

SEQ ID NO: 290 - protein, 302 aa, Haemophilus influenzae
  Xaa 301, 302: Xaa is any amino acid
  Name: NTH0155
MEIISQYGSWLVWITAAFGFFMAFGIGANDVSNSMGTSVGSGTVTAKQAIIIALIFESAGAYLAGGEVTQTIKSGVIDPIQFVDTPDILALGMLSTLFASGAWLFIVTKMGWPVSGIHTIIGAIIGFACITIGPSSVDWSNIGSIVGSWFITPVISGILAYAIFASTQKLIFDTEQPLKNAQKYGPYYMGITVFVLCIVTMKKGLKHVGLNLSNSETLIISLAISLIGMFFFHFYFKSKIFTQSANKGTFGAVEKVFSILMLLTACAMAFAHGSNDVANAIGPLSAVVSIVNEGGKIVSGXX

SEQ ID NO: 291 - DNA, 363 bp, Haemophilus influenzae
  n 17, 61: n is any nucleotide
  Name: NTH0156
atgattggtcgtcaatntggtattcctgaagaaatgcaggaagaaatcttacattacgtanaacgtagtttagatgcaattcatcaagcccaccgagtaatcgaagaaatggataagctattagaaacgggttttaaaggtcgtgaactcaaattagtcaatgatatgattcaagaacttgattcaattgaagatgatacagaccaaatgcagatcaaattgcgtaaaatgctttacaccatcgaaagccgttataatccaattgatgtaatgttcttatataaaattattgaatgggttggcgttttggctgaccaagcacaacgagtcggttcgcgcattgaattaatgctggcgcgttca

SEQ ID NO: 292 - protein, 121 aa, Haemophilus influenzae
  Xaa 6, 21: Xaa is any amino acid
  Name: NTH0156
MIGRQXGIPEEMQEEILHYVXRSLDAIHQAHRVIEEMDKLLETGFKGRELKLVNDMIQELDSIEDDTDQMQIKLRKMLYTIESRYNPIDVMFLYKIIEWVGVLADQAQRVGSRIELMLARS

SEQ ID NO: 293 - DNA, 372 bp, Haemophilus influenzae
  Name: NTH0157
atgattgcagctggtggtttaattgctttacttacattcggcgcatttgttcaaaatttacgtaataaagtcactcaaattccattattgttaaaagttcttttatggggcttgccattaccttggattgccattgagtgcggttggttcttagcagaatatggtcgtcagccttgggctatttacgagatcttacctgttggcgtatccgcttctaatttaagtacaggcgatttatggttctccattggtttaatttgtgcgctttatcttgcgttcattattgttgagatgtatttgatgtttaaatatgcgcgtttgggtccaagtgcgttaaaaaccggcaaatactactttgaacaatcagctaaa

SEQ ID NO: 294 - protein, 124 aa, Haemophilus influenzae
  Name: NTH0157
MIAAGGLIALLTFGAFVQNLRNKVTQIPLLLKVLLWGLPLPWIAIECGWFLAEYGRQPWAIYEILPVGVSASNLSTGDLWFSIGLICALYLAFIIVEMYLMFKYARLGPSALKTGKYYFEQSAK

SEQ ID NO: 295 - DNA, 309 bp, Haemophilus influenzae
  Name: NTH0158
ttgtattatttgattggcttctctgtaactgatggatttgatatgggcgtgactgcacttttacctgtaataggtaaaaaagaagtggaacgccgtattatgatcaacactattgctccccattgggatggtaaccaagtttggttattaactgcaggtggtgcaatatttgcagcttggccaattgtatatgcagtatctttctcaggtttttacattgcattagtattaggcttggcagcgctattcttacgtccattgggttttgaatatcgcgcaaaaattgatactccaacttggggcacagtt

SEQ ID NO: 296 - protein, 103 aa, Haemophilus influenzae
  Name: NTH0158
LYYLIGFSVTDGFDMGVTALLPVIGKKEVERRIMINTIAPHWDGNQVWLLTAGGAIFAAWPIVYAVSFSGFYIALVLGLAALFLRPLGFEYRAKIDTPTWGTV

SEQ ID NO: 297 - DNA, 357 bp, Haemophilus influenzae
  Name: NTH0159
atgcagatattttcttctcaatcttcttttcgcaagccttataaaatacttgtgcgttctgacggagagtatgtgaaaggcaagtgggtaaacgacggcgaaatcgagcagacgttaatggcatccattcagccgttaagcagtgctgaaatggatcgcctagtggtatcaatgcaggggcggcgcgtttcaagtgcggtaaaaatttacaccgatcaaaaactaacggtggctggagaaaatgcacacaatgtcgcagtagtgctatttgacggcgagcgatacgaagtgatttcacgagctagttatcacagtggtgtgttgtcacatcatcgctacgtggctatacgggtaaaa

SEQ ID NO: 298 - protein, 119 aa, Haemophilus influenzae
  Name: NTH0159
MQIFSSQSSFRKPYKILVRSDGEYVKGKWVNDGEIEQTLMASIQPLSSAEMDRLVVSMQGRRVSSAVKIYTDQKLTVAGENAHNVAVVLFDGERYEVISRASYHSGVLSHHRYVAIRVK

SEQ ID NO: 299 - DNA, 456 bp, Haemophilus influenzae
  Name: NTH0161
gtgtctagcgtggttaaggtaaaaatcaacaataaagggcttgaaaaagaacttgagttgataaacaaaatcggcaaagcacgcgtaaaagtaggcgttcaagcggatgcaggcattcattctgaatcaggcgaaagcttggtggatatcggtatttggaatgaatatggcacggcacatatcccgtctcgtccttttattcgtcaaacctttgaagacaaccaacaggcattggcgcaatacttagggcgtgtggtcgagaatgtggcgaaaggggatgatttggtgcaagagctttcaaaacttgggcaatggtatcaagacaagcagaaaaagaccctaacgtcttatccttggacaccgaatgcaccatctacgcgtaggcgcaagaaaagtagtaaaccgctcgtagatacctcgcaattagtcaattcaattcgttataaggttgaaatc

SEQ ID NO: 300 - protein, 152 aa, Haemophilus influenzae
  Name: NTH0161
VSSVVKVKINNKGLEKELELINKIGKARVKVGVQADAGIHSESGESLVDIGIWNEYGTAHIPSRPFIRQTFEDNQQALAQYLGRVVENVAKGDDLVQELSKLGQWYQDKQKKTLTSYPWTPNAPSTRRRKKSSKPLVDTSQLVNSIRYKVEI

SEQ ID NO: 301 - DNA, 462 bp, Haemophilus influenzae
  Name: NTH0163
atgaaaaagaaaacactagcattagctatcttaactatttttagtgtggctggatgtacgaatacagatatttttagtggcgatgtgtatagtgcatctcaagcaaaggaagctcgttcaattacttatggtacgattgtttctgtgcgtcctgttaagatccaagctgataatcaaggcgtaattggtacgcttggtggcggtgcgttaggtggtattgcgggtagtgcaattggcggtggtcgtggtcaagttatcgcagcagtagttggtgcgattggtggtgcagtagctggaagcaaaatcgaagagaaagtaagtcaagtaaacggtgctgaacttgtaattaaaaaagatgatggtcaagagatcgttgttgttcaaaaggctgacagcagttttgtagctggtcgccgagttcgtattgttggtggcggctcgaacttaaatgtttctgtgcta

SEQ ID NO: 302 - protein, 154 aa, Haemophilus influenzae
  Name: NTH0163
MKKKTLALAILTIFSVAGCTNTDIFSGDVYSASQAKEARSITYGTIVSVRPVKIQADNQGVIGTLGGGALGGIAGSAIGGGRGQVIAAVVGAIGGAVAGSKIEEKVSQVNGAELVIKKDDGQEIVVVQKADSSFVAGRRVRIVGGGSNLNVSVL

SEQ ID NO: 303 - DNA, 240 bp, Haemophilus influenzae
  Name: NTH0164
ttgttcttcttttcaaaaaagatgaaaatgcttaaaggtcaaatcgtttttagccaaatggaaggcgaaaatcttaaattaactattcgtaaaaatgattgttctggtaaccagcagaaaggagaggaagttattattgtgcataagtatgattcaactcttgctattggggcttgtgtgacggtgtctaataatagccaagtaaagaatatttcatcattttcgccaagaaatccattt

SEQ ID NO: 304 - protein, 80 aa, Haemophilus influenzae
  Name: NTH0164
LFFFSKKMKMLKGQIVFSQMEGENLKLTIRKNDCSGNQQKGEEVIIVHKYDSTLAIGACVTVSNNSQVKNISSFSPRNPF

SEQ ID NO: 305 - DNA, 495 bp, Haemophilus influenzae
  Name: NTH0165
ttgcgtaaagctgcacaacgttatggcattgatgaaagtttgattttgggcattatgcaaacagaatcaagttttaacccatatgcgattagctacgcaaatgctattggattaatgcaagttgtgcctcatacagcaggtcgagatgtatttgcaatgaaaggcaaaggtgggcagccatcaacgcgttatttatatgatcctgcgaataatattgatgctggtgtgtcttatttatggattttacaaaatcaatatttagatggaattacgaatccaacctcaaaacgtttcgccatgatttctgcatataatagtggtgcaggcgcagtgttacgtgtttttgataatgataaggatacggcgatttacaaaatcaatcaaatgtatccagaacaagtttatcgcattctaacgacagttcacccatcatcacaagcacgcaattatttgttgaaagttgataaggcacagaaaaaattccgtgttagacga

SEQ ID NO: 306 - protein, 165 aa, Haemophilus influenzae
  Name: NTH0165
LRKAAQRYGIDESLILGIMQTESSFNPYAISYANAIGLMQVVPHTAGRDVFAMKGKGGQPSTRYLYDPANNIDAGVSYLWILQNQYLDGITNPTSKRFAMISAYNSGAGAVLRVFDNDKDTAIYKINQMYPEQVYRILTTVHPSSQARNYLLKVDKAQKKFRVRR

SEQ ID NO: 307 - DNA, 582 bp, Haemophilus influenzae
  Name: NTH0167
atgaaaaaatatttattattggcattattgccttttttgtatgcttgtagtaattcatcgaatcaaggtattaactatgatgaagcctttgctaaagacacgcaagggttagatattctcacagggcagttctcgcataatattgaccgaatttggggcgtcaatgaattgttagtggcaagccgtaaagattatgtgaaatatacagattctttttatacgcgtagccatgtgagttttgatgaaggtaatatcgttattgaaacccagcaagatttaaatcgattacataatgctattgttcataccttgttaatgggagcggatgcaaaaggtattgatttatttacttctggcgatgtgccgattagctctcgtccatttcttttggggcaggttgtagatcatcaagggcaacaaattgctaatcaagttatcgcaagtaatttcgccacttatttgattcaaaataaattgcaaacacgtcgattacaaaacgggcataccgtgcaatttgtttctgttcctatgattgcaaaccacgtagaagtgcgtgcacgaaaatatttaccattgattgcg

SEQ ID NO: 308 - protein, 194 aa, Haemophilus influenzae
  Name: NTH0167
MKKYLLLALLPFLYACSNSSNQGINYDEAFAKDTQGLDILTGQFSHNIDRIWGVNELLVASRKDYVKYTDSFYTRSHVSFDEGNIVIETQQDLNRLHNAIVHTLLMGADAKGIDLFTSGDVPISSRPFLLGQVVDHQGQQIANQVIASNFATYLIQNKLQTRRLQNGHTVQFVSVPMIANHVEVRARKYLPLIA

SEQ ID NO: 309 - DNA, 270 bp, Haemophilus influenzae
  Name: NTH0168
atggcaagaacagtattttgtgaatatctcaaaaaagaagcggaaggcttagattttcaactttatcctggagagttggggaagcgtatttttgattcagtaagtaaacaggcttggggtgaatggattaagaaacaaacgatgcttgtgaatgaaaaaaaacttaatatgatgaatgcagagcaccgtaaattattagaacaagaaatggttaattttttgtttgaaggtaaagatgttcatattgaaggttatgttccaccatcaaat

SEQ ID NO: 310 - protein, 90 aa, Haemophilus influenzae
  Name: NTH0168
MARTVFCEYLKKEAEGLDFQLYPGELGKRIFDSVSKQAWGEWIKKQTMLVNEKKLNMMNAEHRKLLEQEMVNFLFEGKDVHIEGYVPPSN

SEQ ID NO: 311 - DNA, 105 bp, Haemophilus influenzae
  Name: NTH0169
gtgatggaaagcccaaaagaagtcccaatcaacccttatcaagtgcggtcaaatattggtatgatcccccaaaatcctgaaccgatcgggctgggctcaggcctg

SEQ ID NO: 312 - protein, 35 aa, Haemophilus influenzae
  Name: NTH0169
VMESPKEVPINPYQVRSNIGMIPQNPEPIGLGSGL

SEQ ID NO: 313 - DNA, 153 bp, Haemophilus influenzae
  Name: NTH0170
atggagaatgaaatgtcacagaacggttcagatcgcgatccttggagtaaaccagggcaaagcaacgaccaacagccgggaaattcatccaataataatggatggaataacaatcaaaatcgtggaaatcaagagcaatctccgccagatatt

SEQ ID NO: 314 - protein, 51 aa, Haemophilus influenzae
  Name: NTH0170
MENEMSQNGSDRDPWSKPGQSNDQQPGNSSNNNGWNNNQNRGNQEQSPPDI

SEQ ID NO: 315 - DNA, 660 bp, Haemophilus influenzae
  Name: NTH0172
ttggaatccttacccgatgaactgattccagaaaatctatatcaaattgaaacggatagctcccgtgtttttcagcgtcatcagtgtcgtcggcttgcgcatttattacttttccaacttctaaaaatagcaggaaaatccaccgcacttttatctcaaattcatcgtactgaaagtggcagaccttattttcttgatgagcgaatagattttaatattagccattctggtgattgggtggcggtaatattagatattagaaaagaagaaaaaagtgcggtgggaattgatattgaatttcctaaaataagaaattttacagcgttgatggagcatattgcaccaaaagaagaaattgattggtttcatcatcagcaggattctttgaacgctttttatcgttgttggtgtttgcgagaggcggtattgaaatctcaaggatttgggatcgtaaaattatccaatgttcgtcattttcctgaacaacaaaaaattttttcagattattgtccgcaggggcagttgtggtttactgatgaacttcctatttatttagccgcttttgtcaatcatcaagaaaaattaccgcacttttatgaatggaatagagaaagtttacagataaaagaacttgaaaaatatgttctttatgaagtgaat

SEQ ID NO: 316 - protein, 220 aa, Haemophilus influenzae
  Name: NTH0172
LESLPDELIPENLYQIETDSSRVFQRHQCRRLAHLLLFQLLKIAGKSTALLSQIHRTESGRPYFLDERIDFNISHSGDWVAVILDIRKEEKSAVGIDIEFPKIRNFTALMEHIAPKEEIDWFHHQQDSLNAFYRCWCLREAVLKSQGFGIVKLSNVRHFPEQQKIFSDYCPQGQLWFTDELPIYLAAFVNHQEKLPHFYEWNRESLQIKELEKYVLYEVN

SEQ ID NO: 317 - DNA, 96 bp, Haemophilus influenzae
  Name: NTH0173
ttgatttatattgccgtaggcgatgtaggttgtcataaaataaaagcaccattcaaaggtgcttttatattaaaaggatttagtttgtgtgtaaat

SEQ ID NO: 318 - protein, 32 aa, Haemophilus influenzae
  Name: NTH0173
LIYIAVGDVGCHKIKAPFKGAFILKGFSLCVN

SEQ ID NO: 319 - DNA, 120 bp, Haemophilus influenzae
  n 111, 112, 113, 114, 115: n is any nucleotide
  Name: NTH0174
atggttatgaaatttaaaatgtcaaaaaatgtgatttgttatgcgtggttatcggtgtgtttgagcagtgcaattcctgcatttgctgtacaacctacattaaaaccaagnnnnnttaat

SEQ ID NO: 320 - protein, 40 aa, Haemophilus influenzae
  Xaa 37, 38, 39: Xaa is any amino acid
  Name: NTH0174
MVMKFKMSKNVICYAWLSVCLSSAIPAFAVQPTLKPXXXN

SEQ ID NO: 321 - DNA, 429 bp, Haemophilus influenzae
  Name: NTH0175
ttgcgtcaggctcttcgccaatacacatcaaattggcgttatttatatggctgtcgtgaaggtgcagtgcgtgttgatttacagggtaatcctgcgggtgtattagatgcagaacacgttgctcacgctgcacagcaacttgctgaagcgaaagcgcgttttgcggaaaaacgtaaagcagaagctgtagctaaaaaagcacaacaaaaaaagcatccgcgtaaacctgcgaataaaaaccttaaaaaagagagtaaattatcactaagtgcggttgatttttcacaaatttctgttggttctgttgtgaaagttaaagctggagataatgctaaaaaagcaacagtggtagaagtattaaaagattcagcacgtgttgaacttgaaaacggtttgattatgaacgttgctgcagatcgtttatttgct

SEQ ID NO: 322 - protein, 143 aa, Haemophilus influenzae
  Name: NTH0175
LRQALRQYTSNWRYLYGCREGAVRVDLQGNPAGVLDAEHVAHAAQQLAEAKARFAEKRKAEAVAKKAQQKKHPRKPANKNLKKESKLSLSAVDFSQISVGSVVKVKAGDNAKKATVVEVLKDSARVELENGLIMNVAADRLFA

SEQ ID NO: 323 - DNA, 117 bp, Haemophilus influenzae
  Name: NTH0176
ttgtgggtggcgcgccattatcattccaagttacagatggccaacggaagtgcaaaatttaacaacgcaaaagctatcattacttatttagcagaaaaatttcctctttgctttgtt

SEQ ID NO: 324 - protein, 39 aa, Haemophilus influenzae
  Name: NTH0176
LWVARHYHSKLQMANGSAKFNNAKAIITYLAEKFPLCFV

SEQ ID NO: 325 - DNA, 192 bp, Haemophilus influenzae
  n 179, 180, 181, 182, 183: n is any nucleotide
  Name: NTH0177
ttgcttcagcatcgccagttagcaaaacgctattctttccatcatcgactaaaatcacacaagaatggggattatcagctcgtgtcgcaacgttgtgaggagaaagtatttgaaaatggcacccttgccaatgccaatcacgcgcagcagtacaaaaagtgcggtaattttccccatannnnnttaattaat

SEQ ID NO: 326 - protein, 64 aa, Haemophilus influenzae
  Xaa 60, 61: Xaa is any amino acid
  Name: NTH0177
LLQHRQLAKRYSFHHRLKSHKNGDYQLVSQRCEEKVFENGTLANANHAQQYKKCGNFPHXXLIN

SEQ ID NO: 327 - DNA, 348 bp, Haemophilus influenzae
  Name: NTH0178
ttgctaactggcgatgctgaagcaaaaaatgagcaaatttttgcccgcactttaggcaaaatcgatgtgttgcaagtggggcatcatgggagtaaaacatcgacaagtgaatacttgctttctcaggttagaccagatgtagcgattatttctagtgggcgttggaatccgtggaaattccctcattattcggttatggaaaggcttcatcgctataaaagtgcggtagaaaataccgctgtttcggggcaagtgcgggtaaatttttttcaagaccgattagaaatccagcaagctcgcacaaaattttccccttggtatgcgcgtgtaattggattatcaaaggaa

SEQ ID NO: 328 - protein, 116 aa, Haemophilus influenzae
  Name: NTH0178
LLTGDAEAKNEQIFARTLGKIDVLQVGHHGSKTSTSEYLLSQVRPDVAIISSGRWNPWKFPHYSVMERLHRYKSAVENTAVSGQVRVNFFQDRLEIQQARTKFSPWYARVIGLSKE

SEQ ID NO: 329 - DNA, 441 bp, Haemophilus influenzae
  Name: NTH0180
atgcaagagcaaaaattacaagaaaatgatttttcaaccttacaaacttttaaacgtttgtggccaatgattaaaccttttaaagcagggcttattgcttcaggtattgcgttagtttttaatgcattggctgattcaggcttgatttatttgttaaaaccgttgttggacgatggttttggcaaggcaaaccattcatttttgaaaataatggcttttgttgttgtgggaatgattattttacgtggcgtgactaactttatttctaattattgcttggcgtgggtatcaggcaaagttgtcatgacaatgcgtcgccgtttatttaaacatttaatggttatgccagggagtttctttgacagaaattcaacggggaaattactttctcgtatcacttatgattctgagatgattgccagtttcttcttcaggatcttt

SEQ ID NO: 330 - protein, 147 aa, Haemophilus influenzae
  Name: NTH0180
MQEQKLQENDFSTLQTFKRLWPMIKPFKAGLIASGIALVFNALADSGLIYLLKPLLDDGFGKANHSFLKIMAFVVVGMIILRGVTNFISNYCLAWVSGKVVMTMRRRLFKHLMVMPGSFFDRNSTGKLLSRITYDSEMIASFFFRIF

SEQ ID NO: 331 - DNA, 741 bp, Haemophilus influenzae
  Name: NTH0181
ttgctcgcggctcgagtgttaatccgtgaaaataaggttgaacaatcggcagcgttattgagggaattaggcgaattaaatgatgcgcaaaaattagatcgtgcattaattgaagcgagaatttctgccgcaaaaaatgccaatgaagtcgcacaaaatcaattacgtgcattggatttaaataaactaagcccgtcacaaaaatctcgttattacgaaaccttagctattgttgccgaaaaccgtaaagacatgattgaagcggtaaaagcgcggatagaaatggataagaatttaacagatgtacaacgtcgtcaagataatattgataaaacttgggctttattgcgttcagcgaatactggcgttattaataatgcctctgatgaaggtaatgcagctttaggcggttggctaacattaatcaaagcctacaacgattatattcgtcagcctgtacaattaagccaagccttacaaagttggaaaaatgcttatccaaatcatgcagccgcaacgttgtacccaaaagaattgcttacattgcttaatttccaacaaacgaatgtgtcacaaattggtttactcttgccattaagtggagatggacaaattcttggtacaaccattcaatcgggttttaacgacgcgaaaggtaactcaaccattccagtgcaagtgtttgatacctcaatgaattctgtcccaagatatcattgcgcaagcaaaacaagcggggat

SEQ ID NO: 332 - protein, 247 aa, Haemophilus influenzae
  Name: NTH0181
LLAARVLIRENKVEQSAALLRELGELNDAQKLDRALIEARISAAKNANEVAQNQLRALDLNKLSPSQKSRYYETLAIVAENRKDMIEAVKARIEMDKNLTDVQRRQDNIDKTWALLRSANTGVINNASDEGNAALGGWLTLIKAYNDYIRQPVQLSQALQSWKNAYPNHAAATLYPKELLTLLNFQQTNVSQIGLLLPLSGDGQILGTTIQSGFNDAKGNSTIPVQVFDTSMNSVPRYHCASKTSGD

SEQ ID NO: 333 - DNA, 525 bp, Haemophilus influenzae
  n 511, 513, 522, 525: n is any nucleotide
  Name: NTH0182
gtgattttagcggatcctgctcaaattcaaggtatggatgtgcttgcattaaatgccacaccacattctcgtgcgattcctcaactttgttattacggactttctccagaagatgaagctgaatctgccgccaataaaatgtggaacgatggcgtgcgtaatccacttgtcgcaatgccgcaaaatgatttaggacaacgcgtaggcaatgcctttaatgtacgttggcagcaattagcaggtactgatgcgaatatccgttactacaatttgcctgcggatgtgacctatttcgttcaagaaaataactcaaatacaaccgcactttatgccgtagcaagtccaactgaactggcagaaatgaaaggttatttaacaaatatcgtacctaatttagcgatttatgccagttctcgagcaagcgcaagtgcgacaaacactaataccgacttcatcgcacagatgaacggtgtacagtttagtgatattccattttttaaagataccaatncnccggggatnccn

SEQ ID NO: 334 - protein, 175 aa, Haemophilus influenzae
  Xaa 171, 174: Xaa is any amino acid
  Name: NTH0182
VILADPAQIQGMDVLALNATPHSRAIPQLCYYGLSPEDEAESAANKMWNDGVRNPLVAMPQNDLGQRVGNAFNVRWQQLAGTDANIRYYNLPADVTYFVQENNSNTTALYAVASPTELAEMKGYLTNIVPNLAIYASSRASASATNTNTDFIAQMNGVQFSDIPFFKDTNXPGXP

SEQ ID NO: 335 - DNA, 558 bp, Haemophilus influenzae
  Name: NTH0183
atggctcgtaagaaaaaaacacgtcgaattacagatattatgccaattcgcaaagcagataaaaaaatagatataacaaaagcacgctctggtaaaaagcttactcgttatgaattggatgctaaagctcgtgaagataagaaaaaacgtaagcataaaggtttagcttcaggatctcgtcatagtgcggttgaagaaaaagcgaataaacttcaaaatgaaattaaagatccaaaaattggtagtaagaaaaagataccgttggttgttgaatttgttaataagcctgaaaaaggtcaagtaattcctgtaataaaacaggtgaaaaaacaagatccaatgaaagagcttgaaaatctggaaaataatgaaattcttaatgaattattggatgctttagatgcgggtaaaactattagtaaatcagatcaacaatttgtagatgaatgcttagatcgaatttctgagttaatggaagaacttggcattgaagacgaagatgaaagcgaagatgatttataccgcactttcgagcgtatggatattaatcaatttagg

SEQ ID NO: 336 - protein, 186 aa, Haemophilus influenzae
  Name: NTH0183
MARKKKTRRITDIMPIRKADKKIDITKARSGKKLTRYELDAKAREDKKKRKHKGLASGSRHSAVEEKANKLQNEIKDPKIGSKKKIPLVVEFVNKPEKGQVIPVIKQVKKQDPMKELENLENNEILNELLDALDAGKTISKSDQQFVDECLDRISELMEELGIEDEDESEDDLYRTFERMDINQFR

SEQ ID NO: 337 - DNA, 1263 bp, Haemophilus influenzae
  Name: NTH0184
ttgctgcctgcggtcgactctatgagacccccttatgttttaggctattattacactgctttaaatttaattgagcattttattcattcttatattgcttggtgtgtatggtggttagtacgtaatacgatttaccgtggtattacggtttcttctcgtcgtttagcacatcgccgtttatcagaaaaacgtcgtcaaaaagcacttgaaaataattatgaaaatatttcctctgatgatgtggttgcagtgggagagccagaggaaggtttagcgttaaatgatgtgcgtagccaattattacgttttgtagatctctttatttggacagcattattggggattttctactatgtatggtcagatttagtcacagtagtgagctatttacgtgaaattacactttggcaacaaaccacgacaaccgatgctggcactgtaatagaaagcattactttatttaatcttcttgttgctttggttatcctaggaattacttatgtgttggttcgtaatatttcaggtattttggaagtattaattttctctcgcgtgaatctttcacaaggtacgccttatacgattacgacattgctcacttatatttttatcgccattggtggtgcgtgggcatttgcaaccttaggaatgtcttggtcaaaattacaatggttatttgccgcactttccgttggtcttggttttggtatgcaagaaatttttgcaaactttgtgtcgggcattattttgctatttgaacgcccaatccgagttggcgatgtcgtaaccattaatggagtgagcggtactgtagcgaaaattcgtattcgtgcaattacattaattgattttgatcgcaaagaaattattgtgccaaataaatcttttgtgacaggtcaagtaaccaattgggcattatctagcacgatgacacgtttagtgattagtgttggtgttgcttatggttctgatttaacactcgttcgtcaattattacttcaagcagctgatgaacagccgactgttttacgcgatcctaaaccatctgcttattttttaacttttggtgcaagtactttggatcacgaattacgtgtttatgtagaacaagttggagatcgtaccagtactacagatgctattaatcgccgtattaatgaattatttgcagaacataatattgatattgcctttaatcaattagatgtatttatcaaaaataatgacactggcgaagaaattccctttgttgatgtaaaaaaa

SEQ ID NO: 338 - protein, 421 aa, Haemophilus influenzae
  Name: NTH0184
LLPAVDSMRPPYVLGYYYTALNLIEHFIHSYIAWCVWWLVRNTIYRGITVSSRRLAHRRLSEKRRQKALENNYENISSDDVVAVGEPEEGLALNDVRSQLLRFVDLFIWTALLGIFYYVWSDLVTVVSYLREITLWQQTTTTDAGTVIESITLFNLLVALVILGITYVLVRNISGILEVLIFSRVNLSQGTPYTITTLLTYIFIAIGGAWAFATLGMSWSKLQWLFAALSVGLGFGMQEIFANFVSGIILLFERPIRVGDVVTINGVSGTVAKIRIRAITLIDFDRKEIIVPNKSFVTGQVTNWALSSTMTRLVISVGVAYGSDLTLVRQLLLQAADEQPTVLRDPKPSAYFLTFGASTLDHELRVYVEQVGDRTSTTDAINRRINELFAEHNIDIAFNQLDVFIKNNDTGEEIPFVDVKK

SEQ ID NO: 339 - DNA, 660 bp, Haemophilus influenzae
  n 446, 467, 564: n is any nucleotide
  Name: NTH0185
atggcaggtaatacaattggacaactttttcgtgtgacgacctttggggagtcacatgggattgcattaggctgtatcgttgatggggtaccgccaaatcttgaattatctgagcaagatattcagccagatttagatcgtcgtaaacctgggacatcacgatataccacgccgcgtcgtgaagacgatgaagttcaaattttatctggtgtgtttgaaggaaaaactacaggcacaagtattgggatgatcattaaaaatgctgatcagcgttctcaagattatggcgagattaaagatcgttttcgccctggtcatgcagactttacctatcagcaaaaatatggcatccgtgattaccgtggcggtgggcgttcttcagcgcgtgaaacagcgatgcgagttgcagcgggagcgattgcaaaaaaatatttacgcgaacattntggtattgaagtccgtggttntttaagtcaaatcggtcatgtgaaaatttcgccacagatcatcggagatattgattgggaaaaggtaaacagcaatccattcttttgccctgatganagtgcggtagataaattcgatgaattgatccgtgaacttaaaaaagaagagattctattggtgcaaaacttactgttattgcagaaaatgtacctg

SEQ ID NO: 340 - protein, 220 aa, Haemophilus influenzae
  Xaa 149, 156, 188: Xaa is any amino acid
  Name: NTH0185
MAGNTIGQLFRVTTFGESHGIALGCIVDGVPPNLELSEQDIQPDLDRRKPGTSRYTTPRREDDEVQILSGVFEGKTTGTSIGMIIKNADQRSQDYGEIKDRFRPGHADFTYQQKYGIRDYRGGGRSSARETAMRVAAGAIAKKYLREHXGIEVRGXLSQIGHVKISPQIIGDIDWEKVNSNPFFCPDXSAVDKFDELIRELKKEEILLVQNLLLLQKMYL

SEQ ID NO: 341 - DNA, 468 bp, Haemophilus influenzae
  n 459, 460, 461, 462, 463: n is any nucleotide
  Name: NTH0186
atgatgatagataaacgcctaattaacacggtggctgacagcaaaaaatggattggcgtcacggtgttgtggaattgggtggcgttagttggcgggattattagtgccgtcgtgttttcttatattttacaggcggcttattttcacaaattgagcctgttaagtgcggtcattttgggcatcgttttgattgcagcattggcattgcgtgcttttgcagggaaaaaatctgtgcaggcgtcttattttgccagcacaaaagtgaagcatgaattgcgtagccttatctatcgtaaattggcttctatgccgcttaaccaagtgaatcaacaatccacctcaagcattattcaagtggcatcagaaggtgtagaacagcttgaaatttacttgggcgtttttcccgcagctttttgtagcggggatctcctagagcaaaccgcaggcagcaagcaggcnnnnnttaat

SEQ ID NO: 342 - protein, 156 aa, Haemophilus influenzae
  Xaa 154, 155: Xaa is any amino acid
  Name: NTH0186
MMIDKRLINTVADSKKWIGVTVLWNWVALVGGIISAVVFSYILQAAYFHKLSLLSAVILGIVLIAALALRAFAGKKSVQASYFASTKVKHELRSLIYRKLASMPLNQVNQQSTSSIIQVASEGVEQLEIYLGVFPAAFCSGDLLEQTAGSKQAXXN

SEQ ID NO: 343 - DNA, 381 bp, Haemophilus influenzae
  Name: NTH0187
atgctactccgtccgtctaccgccgtcttcccccctccccgatcccgctcggcgcctcccaccccctacttcccgtcccctgcactctcccccacccaatcctctttcccctcccgcctctcccctcgtccccctctcccgcatcctcctttccccccctgttcctccccccccccctctcccccgtcctgcgtcgcccatccttacacccctcccctcgcccccgaccccccccgcatgctccccccccctctcctcccccctcgtccctcccccgccccctttcccccctcccttcccttcccctttccctcctcccgcccccccttgtcccccccatttccccccccccgcctctttttcccccgcccccttcccccg

SEQ ID NO: 344 - protein, 127 aa, Haemophilus influenzae
  Name: NTH0187
MLLRPSTAVFPPPRSRSAPPTPYFPSPALSPTQSSFPSRLSPRPPLPHPPFPPCSSPPPSPPSCVAHPYTPPLAPDPPRMLPPPLLPPRPSPAPFPPSLPFPFPSSRPPLSPPFPPPRLFFPRPLPP

SEQ ID NO: 345 - DNA, 252 bp, Haemophilus influenzae
  Name: NTH0188
atgttcccttttatggatgagcttagtttaggggattattctttcacgacattacaatattctgcacaagcgattcagtttaatgaagatgacgaaccttatttcttggtaaaattagagcaagaaatttcattagaaaatagcgaaatttttgaacaagtagaacgttttgaaaaattggctgaacaattttcgggagagtatatcggttgggaatgtgattctttactggatagcaataagccattgaat

SEQ ID NO: 346 - protein, 84 aa, Haemophilus influenzae
  Name: NTH0188
MFPFMDELSLGDYSFTTLQYSAQAIQFNEDDEPYFLVKLEQEISLENSEIFEQVERFEKLAEQFSGEYIGWECDSLLDSNKPLN

SEQ ID NO: 347 - DNA, 486 bp, Haemophilus influenzae
  Name: NTH0189
atgcaaacacgatttattttacaatggttcactattttaagcttctttgttattgcctttgtattagaacttgcaccttggccagttggtttccaaatgctaaagcctgcgtggcttgtacttgtattactttattgggtattagctattcccaataaagtaagtataggctggtcatttttactcggattaacttgggatttaatattaggctctacattaggcgttcacgctctcgtactttctacgagcatgtacatcattgccaaaaactatttaattctgcgaaatttatcactttggttccaaagtttattggttgtacttttcgtcttcattataagattacttattttcttagttgaattttcactccatactgccttttttcattggcaagccatcttaggcgcattcgcttctggtttactatggccgtgggtatttttattaatgcgcaaaatacgcagaaaagttaaattacat

SEQ ID NO: 348 - protein, 162 aa, Haemophilus influenzae
  Name: NTH0189
MQTRFILQWFTILSFFVIAFVLELAPWPVGFQMLKPAWLVLVLLYWVLAIPNKVSIGWSFLLGLTWDLILGSTLGVHALVLSTSMYIIAKNYLILRNLSLWFQSLLVVLFVFIIRLLIFLVEFSLHTAFFHWQAILGAFASGLLWPWVFLLMRKIRRKVKLH

SEQ ID NO: 349 - DNA, 564 bp, Haemophilus influenzae
  Name: NTH0190
gtgggcaagaatactaaccgagtactgctcttcgcaggcgtaacacactcaattccagtgcaagttctacgaaatgatgttcgtggtattgcgagtgggactgggcataccgatgaactaagcctcgataacgtgcctcgttccgttgatatagaaaaaggcgatcttctcgtaacctctgggcttggtggacgttttcttgaaggctatcccgtagctgttgtacaaagcgtttcgcgtgatagctctaattactttgcaatagttaaagctaaacctttagctttattagaacgtttacgttatgtacttttactttggccaagtaacctagatatatcaaaagtaaaatcaatgtcgccagaagaagttcgcaatctggtgcaaaaacgtttagaaagccaagctaatgaagcaaattatagagtgaaaaaaacacccttaacagaaaaagactttctagaaaatgaagaaaaaaccattattgaaccagatattccaacagattttcttcaaaatgaagaagatcttcccatagaacagcaagaagaaaggatagaagac

SEQ ID NO: 350 - protein, 188 aa, Haemophilus influenzae
  Name: NTH0190
VGKNTNRVLLFAGVTHSIPVQVLRNDVRGIASGTGHTDELSLDNVPRSVDIEKGDLLVTSGLGGRFLEGYPVAVVQSVSRDSSNYFAIVKAKPLALLERLRYVLLLWPSNLDISKVKSMSPEEVRNLVQKRLESQANEANYRVKKTPLTEKDFLENEEKTIIEPDIPTDFLQNEEDLPIEQQEERIED

SEQ ID NO: 351 - DNA, 99 bp, Haemophilus influenzae
  Name: NTH0191
gtgataatgcgcttaatctgtcagattccgcaacgcggtcgccgtcaaatcgatttcggctgcattaagagaaaagtgcggttaaaaatggcgttatct

SEQ ID NO: 352 - protein, 33 aa, Haemophilus influenzae
  Name: NTH0191
VIMRLICQIPQRGRRQIDFGCIKRKVRLKMALS

SEQ ID NO: 353 - DNA, 309 bp, Haemophilus influenzae
  Name: NTH0192
atggcaactatcatcgtaaagcgtgatgcaggttcacgcaaattcaccgaaaaaggcgaaattttacaacgtggtaaagcgggcagattagaaagaatgttcgataaacaacgtcgcattaatgccgcgtttgaaaaaatggtggtaaaagaaagtgcggcggatcgcgcaattaaatttgcagccaaccgccaaaaagagcaatttatcgacatagccaactaccactgctgcaaaggtaaacctgctggtacaaacaccgtgcacgcagtgcagaagcgcagactaggggtaagagaattaatacga

SEQ ID NO: 354 - protein, 103 aa, Haemophilus influenzae
  Name: NTH0192
MATIIVKRDAGSRKFTEKGEILQRGKAGRLERMFDKQRRINAAFEKMVVKESAADRAIKFAANRQKEQFIDIANYHCCKGKPAGTNTVHAVQKRRLGVRELIR

SEQ ID NO: 355 - DNA, 102 bp, Haemophilus influenzae
  Name: NTH0193
ttgtttaagtctgtgattttatttttcattttaaatacccttaaaaaaccgccccttcgagcggtcagtggagtagtgcaatcagtctatgctgattttgtc

SEQ ID NO: 356 - protein, 34 aa, Haemophilus influenzae
  Name: NTH0193
LFKSVILFFILNTLKKPPLRAVSGVVQSVYADFV

SEQ ID NO: 357 - DNA, 210 bp, Haemophilus influenzae
  Name: NTH0194
atgaaaaataaaatcacagacttaaacaatcatttattttcccagttagaaaaactgcttgatgaagacttaaccgatgaagaacttaatcgagaaattaaacgtgccaatgccgtatcaggcattgcggcaaatattatcgcaagcaatgcgatttcgcttaaagcaatgacattgtttgaaaatcgtcaaattgataagagaatcccc

SEQ ID NO: 358 - protein, 70 aa, Haemophilus influenzae
  Name: NTH0194
MKNKITDLNNHLFSQLEKLLDEDLTDEELNREIKRANAVSGIAANIIASNAISLKAMTLFENRQIDKRIP

SEQ ID NO: 359 - DNA, 522 bp, Haemophilus influenzae
  Name: NTH0195
atgacctctaatgcggaacgatttaaattcaccgatgaacatattgcgtttattcgcttacattgggataaaaagccatctgatctaattaaattgtttcagcaacagtttgatttattaataaatcgtaatgttttctataaattaaaaaagaaacacaatattccaagccttaagcatgctaatcgttacagcaaagaagaacttgcgttcattaaagcgaattgcacgttaaatgaaagaatcttggctcaaaaaatggaagtttatttcaataaaccatttaatccacacgcgttaaaggttttgcgcgtgaagagacaatggctaaccggacgaagaggtcgatttgagaaaggtgaaaatttcaaaccgattggctttgagcgatattgtaaaaatgcaaaatgttggttaataaaagcaagcattaaacgttatgaacggaaatcgcattatctttggcgcaaatccggtataaacattcgcgttgacatattattgattaccaagacggcaatt

SEQ ID NO: 360 - protein, 174 aa, Haemophilus influenzae
  Name: NTH0195
MTSNAERFKFTDEHIAFIRLHWDKKPSDLIKLFQQQFDLLINRNVFYKLKKKHNIPSLKHANRYSKEELAFIKANCTLNERILAQKMEVYFNKPFNPHALKVLRVKRQWLTGRRGRFEKGENFKPIGFERYCKNAKCWLIKASIKRYERKSHYLWRKSGINIRVDILLITKTAI

SEQ ID NO: 361 - DNA, 204 bp, Haemophilus influenzae
  Name: NTH0196
gtgtattccgatgaattttggctgatttttgaaacttgtttgacttgtttacccgccaaacaggcaaaagtttttatgatgcgagaatttttagatctttcatctgaagaaatttgtcaagaaacgcatttaacttcgtctaatttacataccaccctttatcgggctcgtttacagttgcaaaactgtctttcaaaaaaactt

SEQ ID NO: 362 - protein, 68 aa, Haemophilus influenzae
  Name: NTH0196
VYSDEFWLIFETCLTCLPAKQAKVFMMREFLDLSSEEICQETHLTSSNLHTTLYRARLQLQNCLSKKL

SEQ ID NO: 363 - DNA, 171 bp, Haemophilus influenzae
  Name: NTH0197
atgcgttgtcgccaagccactcgaatgatttccgaatcgcacgaacgttcattagatatacaagaaaaagtagggctaaaagtgcatttagctatgtgctcgcgttgtcgtcgttttcaaagaaattgcaaaaccttaagtatgatgatgaagaaatttaaagattcacat

SEQ ID NO: 364 - protein, 57 aa, Haemophilus influenzae
  Name: NTH0197
MRCRQATRMISESHERSLDIQEKVGLKVHLAMCSRCRRFQRNCKTLSMMMKKFKDSH

SEQ ID NO: 365 - DNA, 132 bp, Haemophilus influenzae
  Name: NTH0198
atgatgccaaaagagccagtcgaaaacgctagagaaaaccacgccagtgaaagcaaaagggagtatgatttgggcgggtgcgtatttaaaagcgcgcgtgagtataatggaaatcaatccgaaccgccacca

SEQ ID NO: 366 - protein, 44 aa, Haemophilus influenzae
  Name: NTH0198
MMPKEPVENARENHASESKREYDLGGCVFKSAREYNGNQSEPPP

SEQ ID NO: 367 - DNA, 378 bp, Haemophilus influenzae
  n 10, 103, 111, 123: n is any nucleotide
  Name: NTH0199
ttgattcgtncgttagcggatgcttatgctcaagattaccaatccccaccccaaaaatcgtttattctcgatggacgtcatgtacatcttcttataccaatgnaaatcctnattatcgagctngctatactatggtggcggttcggattgatttccattatactcacgcgcgcttttaaatacgcacccgcccaaatcatactcccttttgctttcactggcgtggttttctctagcgttttcgactggctcttttggcatcatacgccttaccctctatttttggctcggtgcagttataattgtgggcgcagtgagtttattggcgaagctgaagaaataaaacctttgagattacaaaatgccgtatggataagt

SEQ ID NO: 368 - protein, 126 aa, Haemophilus influenzae
  Xaa 4, 35: Xaa is any amino acid
  Name: NTH0199
LIRXLADAYAQDYQSPPQKSFILDGRHVHLLIPMXILIIELAILWWRFGLISIILTRAFKYAPAQIILPFAFTGVVFSSVFDWLFWHHTPYPLFLARCSYNCGRSEFIGEAEEIKPLRLQNAVWIS

SEQ ID NO: 369 - DNA, 204 bp, Haemophilus influenzae
  Name: NTH0200
atgaaaactatcacattaaacataaaaggcatacattgcggctgttgcgtaaaaagtcttactcaagttttaactgaattagatggtgtacaatctgctgatgtgcaattagagggtaaagcaaatattacttttgatgaaaatcgagtcaatgttgcacagctgattgaggtcattgaagatgctggatttgacgccacagag

SEQ ID NO: 370 - protein, 68 aa, Haemophilus influenzae
  Name: NTH0200
MKTITLNIKGIHCGCCVKSLTQVLTELDGVQSADVQLEGKANITFDENRVNVAQLIEVIEDAGFDATE

SEQ ID NO: 371 - DNA, 204 bp, Haemophilus influenzae; identical to SEQ ID NO: 369
  Name: NTH0201

SEQ ID NO: 372 - protein, 68 aa, Haemophilus influenzae; identical to SEQ ID NO: 370
  Name: NTH0201

SEQ ID NO: 373 - DNA, 204 bp, Haemophilus influenzae; identical to SEQ ID NO: 369
  Name: NTH0202

SEQ ID NO: 374 - protein, 68 aa, Haemophilus influenzae; identical to SEQ ID NO: 370
  Name: NTH0202

SEQ ID NO: 375 - DNA, 189 bp, Haemophilus influenzae
  n 176, 177, 178, 179, 180: n is any nucleotide
  Name: NTH0203
atgctgagttatcgtcactcatttcacgcaggcaatcatgctgatgtcttaaaacatatcgtcttaatgcttattttggaaaaccttaaacttaaagaaaaaggctttttttatttggatacgcactctggtgtaggtcgttatcgtttatcttcaaacgaatcaaaaaaaacggnnnnnttaattaat

SEQ ID NO: 376 - protein, 63 aa, Haemophilus influenzae
  Xaa 59, 60: Xaa is any amino acid
  Name: NTH0203
MLSYRHSFHAGNHADVLKHIVLMLILENLKLKEKGFFYLDTHSGVGRYRLSSNESKKTXXLIN

SEQ ID NO: 377 - DNA, 918 bp, Haemophilus influenzae
  Name: NTH0204
atggcgcgagcttatgcggtgtttgataatggcggtttcctcattgaaccttatatcattgaaaaaattcaagataacacgggtaaagacttatttattgcaaaccctaaaattgcttgcattgaatgtaatgatatacctgtaatttatggcgaaaccaaagacaaaatcaacggctttgccaatattcctttaggcgagagtgccttaaaaccaacagatgacagcaccaatggcgaagaattagatcaacaacctgaaactgtgcctgaactgccagaattacaatcaaatttcaccgcacttaaagaagatgcgattgatttaatggctgctgcaaaaaatgcctcgtcgaaaatagaatatgcgccacgtgtcattagtggcgaacttgcttttctcattcgtagtgccttaaatacggcaatttatggcgaacaaggtttagactggaaaggcaccagctggcgcattgcacaaagtattaaacgtagcgatataggcggtaaaacaggtactaccaacagttcaaaagtggcttggtatgcgggatttggtgcaaacttagtcactacaacttatgttgggtttgatgataacaaacgagtacttgggcgtggagaagcgggtgcgaaaacagccatgccagcttggatcacttatatgaaaatggctttgagtgataaacctgaacgtaaattgccactgccgccaaaaattgtggaaaaaaacattgatactttgacaggtttgctttctccaaacggtgggcgcaaagaatattttattgtgggaacagaaccgacacgtacctatctttcggaaatgcaagagcgtggttattacgttcctacagagttacagcaacgcttaaataatgaaggcaatacgccagcgacgcaaccacaagaactcttc

SEQ ID NO: 378 - protein, 306 aa, Haemophilus influenzae
  Name: NTH0204
MARAYAVFDNGGFLIEPYIIEKIQDNTGKDLFIANPKIACIECNDIPVIYGETKDKINGFANIPLGESALKPTDDSTNGEELDQQPETVPELPELQSNFTALKEDAIDLMAAAKNASSKIEYAPRVISGELAFLIRSALNTAIYGEQGLDWKGTSWRIAQSIKRSDIGGKTGTTNSSKVAWYAGFGANLVTTTYVGFDDNKRVLGRGEAGAKTAMPAWITYMKMALSDKPERKLPLPPKIVEKNIDTLTGLLSPNGGRKEYFIVGTEPTRTYLSEMQERGYYVPTELQQRLNNEGNTPATQPQELF

SEQ ID NO: 379 - DNA, 114 bp, Haemophilus influenzae
  n 49: n is any nucleotide
  Name: NTH0205
atgtggcaccgaaaaaactcgcctgatcgttatgatggcccgatgcgtntacgcgtaggattaggtcaatccaaaaaatatgattgctattcgtgcgatccaaacagcaggtat

SEQ ID NO: 380 - protein, 38 aa, Haemophilus influenzae
  Xaa 17: Xaa is any amino acid
  Name: NTH0205
MWHRKNSPDRYDGPMRXRVGLGQSKKYDCYSCDPNSRY

SEQ ID NO: 381 - DNA, 738 bp, Haemophilus influenzae
  Name: NTH0206
atgatgaaattgacaaaacttttccttgccacagccatttctttaggcgtatcttctgctgttcttgccgctgattatgacttgaaattcggtatgaatgctggaacttcatcaaatgaatataaagcggcagaaatgtttgccaaagaagtcaaagaaaaatcacagggtaaaattgaaatttcactttatccaagttcacaattaggtgatgaccgagcaatgttaaaacaattaaaagacggttctcttgacttcacctttgcagaatctgctcgcttccagttgttttaccctgaagcagcagtatttgccttaccttatgttattagcaactacaatgttgcacaaaaagccttattcgatacagaatttggtaaagatttaattaaaaaaatggacaaagatcttggtgttactttactttcccaagcttataacggtactcgccaaacgacttcaaaccgtgcaatcaacagtattgcagatatgaaaggcttaaaacttcgtgtaccaaatgctgcaacaaacttagcctatgctaaatatgttggtgcatcgccaacaccaatggcattttctgaagtttatcttgcattacaaacgaatgccgtcgatggtcaagaaaacccgttagcagcagtgcaagcacaaaaattctatgaagtgcaaaaggtcttatcaatgactaaccccatttttgaaggacccaccttatttaggaagcgccgagaatta

SEQ ID NO: 382 - protein, 246 aa, Haemophilus influenzae
  Name: NTH0206
MMKLTKLFLATAISLGVSSAVLAADYDLKFGMNAGTSSNEYKAAEMFAKEVKEKSQGKIEISLYPSSQLGDDRAMLKQLKDGSLDFTFAESARFQLFYPEAAVFALPYVISNYNVAQKALFDTEFGKDLIKKMDKDLGVTLLSQAYNGTRQTTSNRAINSIADMKGLKLRVPNAATNLAYAKYVGASPTPMAFSEVYLALQTNAVDGQENPLAAVQAQKFYEVQKVLSMTNPIFEGPTLFRKRREL

SEQ ID NO: 383 - DNA, 525 bp, Haemophilus influenzae
  Name: NTH0207
atgacagggcttccccacttttctgtgtctatcgcagttcgtgtaaaaaatcgcactgaagtcggggttgtttacgatccaatccgcaatgaattatttactgctgtgcgtggcgaaggtgcaaaattaaatgaagtacgtttacgtgtagatagtaaacgtgaacttcaaggttcaattttagccactggttttccattcaaacaaccaaaattaatgccagctcaatttgcaatgatgaatgccttaattgaagatgccgctgatttccgtcgtacgggttctgccgcattagatttatgctatgtggcgtcaaaccgtattgatggttattttgaaatgggcttaaaagcatgggattgtgctgctggcgatttaatcgtgcgtgaagcaggtggtttagtttgcgattttgatgctggtaacggctacttacgcagtggcaatatcattgctgcaccatcacgcgtaattaaagaaatgttaaataaaattcgcccttgtttaggtgctgaatttaatcat

SEQ ID NO: 384 - protein, 175 aa, Haemophilus influenzae
  Name: NTH0207
MTGLPHFSVSIAVRVKNRTEVGVVYDPIRNELFTAVRGEGAKLNEVRLRVDSKRELQGSILATGFPFKQPKLMPAQFAMMNALIEDAADFRRTGSAALDLCYVASNRIDGYFEMGLKAWDCAAGDLIVREAGGLVCDFDAGNGYLRSGNIIAAPSRVIKEMLNKIRPCLGAEFNH

SEQ ID NO: 385 - DNA, 192 bp, Haemophilus influenzae
  Name: NTH0208
atgcttccagaacttggctttttccttcttttactcgcaacagctagcgcgttttttcttgcgttagtgcctcaatttgggttgttcaaaaaaaattcgactttaattaatgctgcttggccgcttagttatatttttacccttgcgacgacgttctcaatttggtttgcttacttattctttctgcgggga

SEQ ID NO: 386 - protein, 64 aa, Haemophilus influenzae
  Name: NTH0208
MLPELGFFLLLLATASAFFLALVPQFGLFKKNSTLINAAWPLSYIFTLATTFSIWFAYLFFLRG

SEQ ID NO: 387 - DNA, 351 bp, Haemophilus influenzae
  n 338, 339, 340, 341, 342: n is any nucleotide
  Name: NTH0209
gtgcggtcaaaaaaaatgataaatgaaaaattgaaaatgtggtgggaaacggctcgaccgaaaactttgcccttagcgttggcatcgattttcacgggttcggcattaggttattgggcgaatccacaaggttttaatgggcttgtaatggtgctttgtttactcacgacaattttattgcaggtgctttctaattttgccaatgattatggggatcatcaaaaaggttcagatactgaagaacgtattgggccattacgtggcattcaaaaaggcgcaatttcagcaaaagaactgaaatggggattaattctaatggtgatggcaagtttttcttnnnnnttaattaat

SEQ ID NO: 388 - protein, 117 aa, Haemophilus influenzae
  Xaa 113, 114: Xaa is any amino acid
  Name: NTH0209
VRSKKMINEKLKMWWETARPKTLPLALASIFTGSALGYWANPQGFNGLVMVLCLLTTILLQVLSNFANDYGDHQKGSDTEERIGPLRGIQKGAISAKELKWGLILMVMASFSXXLIN

SEQ ID NO: 389 - DNA, 765 bp, Haemophilus influenzae
  n 680: n is any nucleotide
  Name: NTH0211
atgaatgatttaaccttatcgcctatcgccattatccacacgccttataaagaaaaattctccgtaccacgccaacctaagttagttgaagacggagtaggcattgtagaactcttaccgccttataattcgcctgaagccgtgagaggattagaacaattcagtcatctttggttaatttttcaattcgaccaaatccaacaagggaaatggcaacccaccgtacgccctcctcggttaggcggtaatcaacgaattggagtgtttgcttcacgcgcaacgcaccgcccaaatcctcttggtttatccaaagtcgaattacgtcaagtagaatgcatcaacggtaacatttttctccatttaggtgcggtggatttagtggatggcacgcccattttcgatatcaaaccctatattgcctatgcggatagtgagccaaatgcacaatcgagctttgctcaagaaaaaccaccagtaaaactgactgttgaatttaccgagcaagccaaaagtgcggtaaaaaaacgagaagaaaaacgaccgcacttaagtcgttttattcgccaagtgctagagcaagatcctcgcccagcctatcaacaaggtaaaccgagtgatcgtatttatggaacaagtttgtacgaatttaatgtgaaatggcgaattaaagcgggtacggnaaattgtgtagaatggattgaaatagaaaaagacaaattgtgtattatgtatataggcagggaatccctcgccctacggcattca

SEQ ID NO: 390 - protein, 255 aa, Haemophilus influenzae
  Xaa 227: Xaa is any amino acid
  Name: NTH0211
MNDLTLSPIAIIHTPYKEKFSVPRQPKLVEDGVGIVELLPPYNSPEAVRGLEQFSHLWLIFQFDQIQQGKWQPTVRPPRLGGNQRIGVFASRATHRPNPLGLSKVELRQVECINGNIFLHLGAVDLVDGTPIFDIKPYIAYADSEPNAQSSFAQEKPPVKLTVEFTEQAKSAVKKREEKRPHLSRFIRQVLEQDPRPAYQQGKPSDRIYGTSLYEFNVKWRIKAGTXNCVEWIEIEKDKLCIMYIGRESLALRHS

SEQ ID NO: 391 - DNA, 609 bp, Haemophilus influenzae
  n 596, 597, 598, 599, 600: n is any nucleotide
  Name: NTH0212
atgtgcaaaatttttaaaacaggattaaaaatgaccgcacttaatcattggcaaccttctgccgatataaaaaatcttcttaaacgggcaaaaattattgctgaaattcgtcaattttttacagaacgcggtttgcttgaagtagagacccctgttctaagtgaatttggcgtcactgatttacatctctccacctttagcacggaatttcttgcgcctttcggtgaacaatccaaaacactttggctttctacaagccctgaatatcatatgaaacgcttgcttgcagcagggagtgggccgatattccaaatcagtaaagtgtttcgcaatgaagaagctggaaatcgccataatccagaatttactatgttggaatggtatcgaccgcactttcatatgcatcgtttaattaatgaagtagatgatttgctccaacaaattttagattgtccacctgcagaaagtttaagctaccaatttgttttccaagaatatgtaggcttagatcccttgtcagcagaacgttcagaattaattgaagcagcacgtaaacataattttatggctgaagataatgaagatcgcgatacgtnnnnnttaattaat

SEQ ID NO: 392 - protein, 203 aa, Haemophilus influenzae
  Xaa 199, 200: Xaa is any amino acid
  Name: NTH0212
MCKIFKTGLKMTALNHWQPSADIKNLLKRAKIIAEIRQFFTERGLLEVETPVLSEFGVTDLHLSTFSTEFLAPFGEQSKTLWLSTSPEYHMKRLLAAGSGPIFQISKVFRNEEAGNRHNPEFTMLEWYRPHFHMHRLINEVDDLLQQILDCPPAESLSYQFVFQEYVGLDPLSAERSELIEAARKHNFMAEDNEDRDTXXLIN

SEQ ID NO: 393 - DNA, 612 bp, Haemophilus influenzae
  Name: NTH0215
ttggaggatatcgtgcaaacagttaatgtcgatattgcgattgttggtgctggtggcggtggtttacgtgcagcgattgccgcagcagaagcaaatcctaacttaaaaattgcattagtttctaaagtatacccgatgcgtagccatactgtagcagcagaaggtggtgcagcggcagttatcaaagaagaagattcttacgataaacacttccaagataccgttgctggtggggactggctttgtgagcaagatgtagtggaatatttcgtgcaacattcccctgtagaaatgactcaattagaacgttggggatgtccttggagccgtaaagctgatggcgatgtaaacgtacgccgtttcggtggaatgaaaattgagcgcacttggttcgctgcagataaaacaggtttccacttattacacacgcttttccaaacttctattcaatatccacaaatccaacgttttgatgaacacttcgtattagatattcttgttgatgatgaccatgctcgtggtatggttgcaatgaacatgatggaaggttcgcttgtgcaaattaatgccaatgcggttgttattgcaactggtggtgggttgtcgtgcatt

SEQ ID NO: 394 - protein, 204 aa, Haemophilus influenzae
  Name: NTH0215
LEDIVQTVNVDIAIVGAGGGGLRAAIAAAEANPNLKIALVSKVYPMRSHTVAAEGGAAAVIKEEDSYDKHFQDTVAGGDWLCEQDVVEYFVQHSPVEMTQLERWGCPWSRKADGDVNVRRFGGMKIERTWFAADKTGFHLLHTLFQTSIQYPQIQRFDEHFVLDILVDDDHARGMVAMNMMEGSLVQINANAVVIATGGGLSCI

SEQ ID NO: 395 - DNA, 144 bp, Haemophilus influenzae
  Name: NTH0216
ttgcaactggtggtgggttgtcgtgcatttaaatttaataccaatggcggcattgtaacaggtgacggcttatctatggcatatcgtcacggtgtaccacttcgtgatatgggagtttgttcaatatcatccaacaggcttacc

SEQ ID NO: 396 - protein, 48 aa, Haemophilus influenzae
  Name: NTH0216
LQLVVGCRAFKFNTNGGIVTGDGLSMAYRHGVPLRDMGVCSISSNRLT

SEQ ID NO: 397 - DNA, 120 bp, Haemophilus influenzae
  n 111, 112, 113, 114, 115: n is any nucleotide
  Name: NTH0217
gtgacggcttatctatggcatatcgtcacggtgtaccacttcgtgatatgggagtttgttcaatatcatccaacaggcttacctaatacgggtattttaatgaccgaaggnnnnnttaat

SEQ ID NO: 398 - protein, 40 aa, Haemophilus influenzae
  Xaa 38, 39: Xaa is any amino acid
  Name: NTH0217
VTAYLWHIVTVYHFVIWEFVQYHPTGLPNTGILMTEGXXN

SEQ ID NO: 399 - DNA, 930 bp, Haemophilus influenzae
  Name: NTH0218
atggcaggtattactgaccagcctttccgccgtctttgtgcatattatggtgcagggcttacattttcagaaatgatgtctacaaatccgcaagtttggcatactgaaaaatccaaattgcgtttggcgtacagcgatgatttaggtctcaatgccgtgcaaattgcaggtagtgatccactcgagatggcacaagctgcggctattaacgtggaatatggcgcgcaaatcatagacattaatatgggttgccccgcaaagaaggtaaatcgcaaacttgcaggctctgcattgttgcaatatcccgatttggtggaaaaaatcttgcgcgaagtggtggctgccgtgaatgtgccagtgaccttaaaaattcgtacaggctgggataaatctaatcgaaactgcgttcaaatcggcaaaattgcagaacaatgtggcatacaagcattaacggtacacggtcgtacaagagcttgtctttttgaagggaaagcggagtacgacaacatcaaagccgttaaacaagcgattggtataccagttatagctaatggcgatattgattctgctcggaaagcaaaattcgttcttgattatactggagcggatgccattatgattggtcgtgctgcgttaggtaacccttggttatttcaagcggtagaaaacctaattgagcataactcgataagtcaaatgccaagtttaaacgaaaagtgcggtcagattttgcgtcatattcaagaattacatcaattctatggcgaacaaaaaggctatcgcattacgcgtaaacacgtggcttggtatttacagggaattcaacctgattccgtttttaaacagacttttaatgcaattagtgatcctaaagagcagctgattgtattggaagattttttcaatttaattttggataaagaaaaatgt

SEQ ID NO: 400 - protein, 310 aa, Haemophilus influenzae
  Name: NTH0218
MAGITDQPFRRLCAYYGAGLTFSEMMSTNPQVWHTEKSKLRLAYSDDLGLNAVQIAGSDPLEMAQAAAINVEYGAQIIDINMGCPAKKVNRKLAGSALLQYPDLVEKILREVVAAVNVPVTLKIRTGWDKSNRNCVQIGKIAEQCGIQALTVHGRTRACLFEGKAEYDNIKAVKQAIGIPVIANGDIDSARKAKFVLDYTGADAIMIGRAALGNPWLFQAVENLIEHNSISQMPSLNEKCGQILRHIQELHQFYGEQKGYRITRKHVAWYLQGIQPDSVFKQTFNAISDPKEQLIVLEDFFNLILDKEKC

SEQ ID NO: 401 - DNA, 297 bp, Haemophilus influenzae
  Name: NTH0220
atgttagaacaacaacgtaatcctgccgatgccttaacggtatcagtattaaatgcgcaatcacaagtgaccagcaaaccattacgcgattcagtcaaacaagcgttgcgtaattatttagcacaattagatggtcaagatgtgaatgatctttacgagctagtattagcggaagttgaacaccctatgttagatatgattatgcaatatactcgtggtaatcaaacccgtgcagcaaatatgcttggtatcaaccgtggtacattacgtaaaaaattaaaaaaatacggtatggga

SEQ ID NO: 402 - protein, 99 aa, Haemophilus influenzae
  Name: NTH0220
MLEQQRNPADALTVSVLNAQSQVTSKPLRDSVKQALRNYLAQLDGQDVNDLYELVLAEVEHPMLDMIMQYTRGNQTRAANMLGINRGTLRKKLKKYGMG

SEQ ID NO: 403 - DNA, 144 bp, Haemophilus influenzae
  Name: NTH0221
ttgtcgttaatgaaaaaggggggggcaagagtcaaaatccgtttagccaaaggtaaaaaccaacaggataacgtgattgatattaaggaacgggaatggaaagtaacaaaagatcgcattatgaaaaatgcacatcgaagatct

SEQ ID NO: 404 - protein, 48 aa, Haemophilus influenzae
  Name: NTH0221
LSLMKKGGARVKIRLAKGKNQQDNVIDIKEREWKVTKDRIMKNAHRRS

SEQ ID NO: 405 - DNA, 666 bp, Haemophilus influenzae
  Name: NTH0222
atgatcaatgcgtttgctatcaatgattcccgcttggttcgtattgacgaagaccaaactgatctcaatactgccatttggcttgatttacttgagccgacaggcgaagaacgtgaaatactacaagaaggcttaggtcagagcctagcatcttttctagaactggaagatatcgaagcttccgcccgtttctttgaagatgaagatggtttacaccttcactcatttttttattgcgaagatgaagacaattatgctgatttagcgagcgttgcttttactattcgtgatggtcgtttatttacgttgcgtgatcgcgagctacccgcattccgtttataccgtatgcgttcacgtagccagcgtttgttagaatgcaattcctatgaagttttactggatttatttgaaacgaaaattgagcaattagcggacgtgattgaaaatatttatgcagatttggaagagttaagtcgcgttattttaaacggaaaacaagatgaagcctttgatgaagcattaaatacactcacggaacaagaagatacgagctcaaaagttcgtttgtgcttgatggatactcaacgtgcattaggtttcttggttcgcaaaactcgcttaccaactaatcagttagaacaagcactgagaaatcttacgagatat

SEQ ID NO: 406 - protein, 222 aa, Haemophilus influenzae
  Name: NTH0222
MINAFAINDSRLVRIDEDQTDLNTAIWLDLLEPTGEEREILQEGLGQSLASFLELEDIEASARFFEDEDGLHLHSFFYCEDEDNYADLASVAFTIRDGRLFTLRDRELPAFRLYRMRSRSQRLLECNSYEVLLDLFETKIEQLADVIENIYADLEELSRVILNGKQDEAFDEALNTLTEQEDTSSKVRLCLMDTQRALGFLVRKTRLPTNQLEQALRNLTRY

SEQ ID NO: 407 - DNA, 273 bp, Haemophilus influenzae
  Name: NTH0223
ttgcaaccgcataatgaatcattattccaaaaagtaaactttttaatgcaagctgcattggtttacatcaatattgaacagaacaaaattatgaatatcttctcggttgcttctgtgatgttcctttctgcaacattacccgcgcttacttatggcatgaactttgattttatgcctgagttacattttaaatatggctatccaatggcaattggattaatgatcgcagccgcactgacaccatatatttattttagaagaaaaggatggtta

SEQ ID NO: 408 - protein, 91 aa, Haemophilus influenzae
  Name: NTH0223
LQPHNESLFQKVNFLMQAALVYINIEQNKIMNIFSVASVMFLSATLPALTYGMNFDFMPELHFKYGYPMAIGLMIAAALTPYIYFRRKGWL

SEQ ID NO: 409 - DNA, 507 bp, Haemophilus influenzae
  n 347, 353: n is any nucleotide
  Name: NTH0224
atggttatgatggaattatcccaaaccgcattatttatcggatcaattattaatctttacgcacttgtagtaatcttacgagcttggttgcagtttgctcgtgtggattattacagtcctgtttcaacatttgcagtcaaaatgactgatccaatattaaaacctctgcgtaaaattgcgcctactgtgaaaaatatcgatacttccgcattactgcttgtatttattattggtatgttaaaaggtattatttattttggcttatcagtaaatgtactcttagtattgggcgtattaactgtattgaaaagcattggtttagctattttctatgtgctttttattgnggctgntttaagttggtttaatcgaggtattaattttataagttatgccttttatcaactctccgaaccccttttaaaacctatccgtcgattcttacctacattaggcctgattgatttttctccgagggccgttggatttaaccttaatacttctaaa

SEQ ID NO: 410 - protein, 169 aa, Haemophilus influenzae
  Xaa 116, 118: Xaa is any amino acid
  Name: NTH0224
MVMMELSQTALFIGSIINLYALVVILRAWLQFARVDYYSPVSTFAVKMTDPILKPLRKIAPTVKNIDTSALLLVFIIGMLKGIIYFGLSVNVLLVLGVLTVLKSIGLAIFYVLFIXAXLSWFNRGINFISYAFYQLSEPLLKPIRRFLPTLGLIDFSPRAVGFNLNTSK

SEQ ID NO: 411 - DNA, 1278 bp, Haemophilus influenzae
  n 1273, 1274, 1275, 1276, 1277: n is any nucleotide
  Name: NTH0225
gtgcggttcaataaagacaagaaagtacaagtgctggtggatcacccaagcattaatcaacccattggtgcacaacaggcgaaatcggtaaaagaagaattgcaagagggcgactgggtcgtcgcaaatttaaaaacccatccattacgtgacgatcgctttttctacgccacaattaatcagtttatttgccgagctgacgatgaattagccccttggtgggtcacattggcacgccacgaacaatcgcgctatcccgtgcaaggcgcagaacattatgaaatgttagatcaaaaaacacgcgaaaatctgaccgcacttcattttgtaaccattgattccgaaagcacaatggatatggacgatgccttatatatcgaacccatagcacaaaacagcacacaaacaggctggaaattagtggtcgccattgctgacccaaccgcttacatcgccttagattctcaaattgaacaagaagccaaacagcgttgcttcacaaattatttaccgggctttaacattccaatgttaccccgtgaattatccgatgaattatgttccttaatcgccaatgaaacccgccccgcacttgtctgttatatcgaaaccgatcttgcaggcaacatcacagccaaaccgcattttgtttccgcttatgtacaatctaaagccaaactggcttataacaaagtgtcggattatttagaacaggcagacaatgcatggcagccagaaacgccagaaacagcacaacaaattcactggctacatcaatttaccaaagcccgcattcaatggcacaaaacccattccttactctttaaagaaaaacccgattatgcctttgtgctggcagaaaacggcaaagtgcaagaaatcaaagcagaatatcgccgcattgccaatcaaattgtggaagaagcaatgattattgccaacatctgcgccgcacaatttttacacgaacaggcaaaaacaggcattttcaacacccacagcggttttgataaaaaattcttagagaacgcacaccatttcttaatggcaaatttagccaatgaacaaaatcaaactgaactggcagaacgttattcagtagaaaacttagcaaccttaaacggctattgccaaatgcgccacgatattgaacccatcgaaagcgattatttagaactgcgtttacgccgttatttaactttcgccgaatttaaatcagaattagcaccgcactttggtcttggtttagaaggctatgccacttggacatcgnnnnnt

SEQ ID NO: 412 - protein, 426 aa, Haemophilus influenzae
  Xaa 425, 426: Xaa is any amino acid
  Name: NTH0225
VRFNKDKKVQVLVDHPSINQPIGAQQAKSVKEELQEGDWVVANLKTHPLRDDRFFYATINQFICRADDELAPWWVTLARHEQSRYPVQGAEHYEMLDQKTRENLTALHFVTIDSESTMDMDDALYIEPIAQNSTQTGWKLVVAIADPTAYIALDSQIEQEAKQRCFTNYLPGFNIPMLPRELSDELCSLIANETRPALVCYIETDLAGNITAKPHFVSAYVQSKAKLAYNKVSDYLEQADNAWQPETPETAQQIHWLHQFTKARIQWHKTHSLLFKEKPDYAFVLAENGKVQEIKAEYRRIANQIVEEAMIIANICAAQFLHEQAKTGIFNTHSGFDKKFLENAHHFLMANLANEQNQTELAERYSVENLATLNGYCQMRHDIEPIESDYLELRLRRYLTFAEFKSELAPHFGLGLEGYATWTSXX

SEQ ID NO: 413 - DNA, 129 bp, Haemophilus influenzae
  Name: NTH0226
ttgaaccgcacttttgcgataaaacgtgtgagcattggctcaattaaagcttctggctcggcttgctctttgtcgccttgcttttcaataggggctttgattttgtcgcccgcgcatcactttttttat

SEQ ID NO: 414 - protein, 43 aa, Haemophilus influenzae
  Name: NTH0226
LNRTFAIKRVSIGSIKASGSACSLSPCFSIGALILSPAHHFFY

SEQ ID NO: 415 - DNA, 207 bp, Haemophilus influenzae
  Name: NTH0227
atgagacaaacaattaaatatgaattttgggtcgggttatttttattacttggtattggtgccttagtttttttaggtttacgcgtagctaatgtacaaggttttgctgagacgaaatcttataccgtgacggcaatttttaataatattggcggacttaaagtgcgcgcaccactaaaaattggaggcgtagtaatgggggtctcc

SEQ ID NO: 416 - protein, 69 aa, Haemophilus influenzae
  Name: NTH0227
MRQTIKYEFWVGLFLLLGIGALVFLGLRVANVQGFAETKSYTVTAIFNNIGGLKVRAPLKIGGVVMGVS

SEQ ID NO: 417 - DNA, 747 bp, Haemophilus influenzae
  Name: NTH0228
gtgatcgactttttccgtgcattggggcgagcaggctttatgttatttggtgcattgatcggcaagccacaaattcgtaagcattttcctttgcttgtgaagcaaatgcatgttttaggtgtccaatcgttactcattattttgttgtccggtttatttattggaatggtattaggactacaaggttatgtcgtattagttgatttttctgctgaaacaagtttaggtcagttggtggcactttctcttttgcgagaattagggcctgttgttaccgcacttttatttgctggtcgagcaggttctgcattgacggctgaaataggcttaatgaaagccactgaacaactttctagtcttgaaatgatggctgttgatcctttacgtcgagtgattgcacctcgtttttgggcaggggttatttccatgccaattttgtcaatcttgtttatcgcgattggtatttggggcagttccttagtaggtgtggattggaaaggtgttgattcaggcagcttttggtctgttatgcaaaattccgtgagttggagctatgatattttaaatggctttattaaagcggttttctttgctgtagccgtaacttggattgcactttttaatggttatgattgtatgccaacatcagaaggtatcagccaagctacaacacgaacagttgtgcacgcttcacttgttgttctaggattagattttattttgactgctattatgtttggcgcaagt

SEQ ID NO: 418 - protein, 249 aa, Haemophilus influenzae
  Name: NTH0228
VIDFFRALGRAGFMLFGALIGKPQIRKHFPLLVKQMHVLGVQSLLIILLSGLFIGMVLGLQGYVVLVDFSAETSLGQLVALSLLRELGPVVTALLFAGRAGSALTAEIGLMKATEQLSSLEMMAVDPLRRVIAPRFWAGVISMPILSILFIAIGIWGSSLVGVDWKGVDSGSFWSVMQNSVSWSYDILNGFIKAVFFAVAVTWIALFNGYDCMPTSEGISQATTRTVVHASLVVLGLDFILTAIMFGAS

SEQ ID NO: 419 - DNA, 822 bp, Haemophilus influenzae
  Name: NTH0230
gtgggggaacaagctgtaaaagatcctgaacgaggatggggtaaagaacggttaactataggagaatttgggcggcaagtgctttccgcatgtgttaatggggatgcacgattagccttgaattgcctcggattaatggtggatatggcagatgaaatggaaaatgcaaagacaattggccacactttattaaaagaagtcttaggcgaacgtcaagcgagatttgataaacaaggtgatcgtttctatgatttaatttctgcgctacataaatctgttcgaggttctgctccagacgctgcactgtattggtatgcaagaattttaacggcaggtggcgatcctttatatgtcgcgcgccgattacttgccattgcttcagaagatgtgggaaatgcagatcctcgtgctatgcaagttgcattggctgcttgggattgctttactcgagtgggggcttatgaaggagagagagccatcgcccaagccattatatatctcgcagtagcgccaaaaagtaatgcggtttatactgcatttaacacagcaaaacagcaagcgaaagatttgcccgattacgatgttccaccacatttacgcaatgcgccaactaatttaatgaaagagcttggctatggggctgaatatcgttatgctcacgatgaacctaacgcttatgcggcaggcgaaaattatttcccacctgaattaaaagatactcaatattattttccaacgaatagaggtatggaaattcagattaaggaaaaactagaacgattacgtgagcaagataaaagtacggtgaaaaaacggtataaa

SEQ ID NO: 420 - protein, 274 aa, Haemophilus influenzae
  Name: NTH0230
VGEQAVKDPERGWGKERLTIGEFGRQVLSACVNGDARLALNCLGLMVDMADEMENAKTIGHTLLKEVLGERQARFDKQGDRFYDLISALHKSVRGSAPDAALYWYARILTAGGDPLYVARRLLAIASEDVGNADPRAMQVALAAWDCFTRVGAYEGERAIAQAIIYLAVAPKSNAVYTAFNTAKQQAKDLPDYDVPPHLRNAPTNLMKELGYGAEYRYAHDEPNAYAAGENYFPPELKDTQYYFPTNRGMEIQIKEKLERLREQDKSTVKKRYK

SEQ ID NO: 421 - DNA, 606 bp, Haemophilus influenzae
  n 581, 597, 598, 599, 600, 601: n is any nucleotide
  Name: NTH0232
gtggataatagcgatattttcttttcagggaagacaatgatgaacacgaaaaaaacaagccaaattttgcccgcactttttgcggtgatttgtgccgcattcgcgggttattttattttaatcggttctgggatgtttacagaaccaactgtagatcttattctgcttgcgacaataactattctcttattaagcagcagtaaaaaatccttctattttattttgctacctcttacgttactgcatgctttttatacacctacggggctaaattttggccctccaagctatcaatatatcgcctcgcttttcgcgacagatatattggaaacgaaggaatttctattgcaaattccagtgagtagttacttaattgctttcgccattcctattttaatttttcttcagtacaaaagtgcggtgaaatttggcataaaattttatcgtaataaaacatttattgccttagcgaccttgctctttgcctacaatatgccacttgccgaacctattaaagaaaccataagttccacattaaaaattgtagatgaagtgcaaaaactaaaacgggtaccgagtcngatattcgtataccannnnnttaat

SEQ ID NO: 422 - protein, 202 aa, Haemophilus influenzae
  Xaa 194, 199, 200, 201: Xaa is any amino acid
  Name: NTH0232
VDNSDIFFSGKTMMNTKKTSQILPALFAVICAAFAGYFILIGSGMFTEPTVDLILLATITILLLSSSKKSFYFILLPLTLLHAFYTPTGLNFGPPSYQYIASLFATDILETKEFLLQIPVSSYLIAFAIPILIFLQYKSAVKFGIKFYRNKTFIALATLLFAYNMPLAEPIKETISSTLKIVDEVQKLKRVPSXIFVYXXXN

SEQ ID NO: 423 - DNA, 342 bp, Haemophilus influenzae
  Name: NTH0233
atgagccaaccaatttataaacgtattttattgaaattaagcggtgaagcattacaaggagaagatggtcttggtatcgatcctgcgattctcgatcgtatggctgttgaaattaaagaattagtggagatgggtgtggaagtcggtgtcgttcttggtggtggcaacttattccgtggcgcaaaactagcaaaagcggggatgaatcgcgtggtgggcgatcatatgggaatgcttgctactgtgatgaatggtttggcaatgcgtgattctttattccgtgctgatgtgaacgcaaaaattaatgtccgctttccaattaaatggtatttgcgatactta

SEQ ID NO: 424 - protein, 114 aa, Haemophilus influenzae
  Name: NTH0233
MSQPIYKRILLKLSGEALQGEDGLGIDPAILDRMAVEIKELVEMGVEVGVVLGGGNLFRGAKLAKAGMNRVVGDHMGMLATVMNGLAMRDSLFRADVNAKINVRFPIKWYLRYL

SEQ ID NO: 425 - DNA, 123 bp, Haemophilus influenzae
  Name: NTH0234
atgtccgctttccaattaaatggtatttgcgatacttataactggtctgaagcaatcaaaatgttacgcgaaaaacgcgtagtcattttctctgcgggaacgggaaatccatttctttaccac

SEQ ID NO: 426 - protein, 41 aa, Haemophilus influenzae
  Name: NTH0234
MSAFQLNGICDTYNWSEAIKMLREKRVVIFSAGTGNPFLYH

SEQ ID NO: 427 - DNA, 90 bp, Haemophilus influenzae
  n 81, 82, 83, 84, 85: n is any nucleotide
  Name: NTH0235
ttgcgtggtattgaaattgaagctgatgttgtgttgaaagcgactaaagtgatggggtaccgagtccgatttcggtaccannnnnttaat

SEQ ID NO: 428 - protein, 30 aa, Haemophilus influenzae
  Xaa 27, 28, 29: Xaa is any amino acid
  Name: NTH0235
LRGIEIEADVVLKATKVMGYRVRFRYXXXN

SEQ ID NO: 429 - DNA, 105 bp, Haemophilus influenzae
  Name: NTH0236
atggctaaagagaaaattgaaattgtcgtggcaaacgacgatacgcgaattgaaaagtcgatcagggggtaccaccccttgccttatttgaaaaaacccagcaag

SEQ ID NO: 430 - protein, 35 aa, Haemophilus influenzae
  Name: NTH0236
MAKEKIEIVVANDDTRIEKSIRGYHPLPYLKKPSK

SEQ ID NO: 431 - DNA, 936 bp, Haemophilus influenzae
  Name: NTH0237
ttggtagaaaatggctcaaaattgaaagtggttcaggtcaaaggtgttgaaaaacaagcagaagataaggtaagttcaattggcaattttgtacaagagcaaggttggaacaaatttgagaaagaaggcggattggtcttgggagcgggtatcgctaaagaacttgatgtaaaagtaggggattggattaccttgcttatttctcagcaaaacggcgatgaacaatttgctcaaccaactcgtgagccagtgcaagttaccgctattttacgcttagatggtcagcttgattatagttatgccttattgccgcttgctcaagcacaaacctttttgacttatcaacctgatcaaattacaggtgttgaattgaaattagatgatcctttttctgcgagaaatctggatttatcaatgcttaatgattatccgcagatgctatatatgcaaaattggattagtaaatttggttatatgtatcgcgatattcagcttattagaaccgtaatgtatatcgcaatggtgcttgtgatcggtgttgcgtgttttaatattgtttctacgctgattatggcggtaaaagataagcagggcgatattgccattatgcgcacgcttggggcgaataatgcgtttatcaaacgtatttttatttggtatggcttacaggcaggaatgaaaggttgtttaattggaattgtgttaggcattatacttgcattaaatcttacaacctttattcaaggtattgagtgggttatcggtaagaaattattatcgggcgatgtgtattttgtggatttcttgccaagcgagttacattggttggatgttttgatggttttagttgcagcacttgcattgagtttaatggcaagcctttatccagcaagccgagctgctaaattacaacctgcacaagtattaagtagccat

SEQ ID NO: 432 - protein, 312 aa, Haemophilus influenzae
  Name: NTH0237
LVENGSKLKVVQVKGVEKQAEDKVSSIGNFVQEQGWNKFEKEGGLVLGAGIAKELDVKVGDWITLLISQQNGDEQFAQPTREPVQVTAILRLDGQLDYSYALLPLAQAQTFLTYQPDQITGVELKLDDPFSARNLDLSMLNDYPQMLYMQNWISKFGYMYRDIQLIRTVMYIAMVLVIGVACFNIVSTLIMAVKDKQGDIAIMRTLGANNAFIKRIFIWYGLQAGMKGCLIGIVLGIILALNLTTFIQGIEWVIGKKLLSGDVYFVDFLPSELHWLDVLMVLVAALALSLMASLYPASRAAKLQPAQVLSSH

SEQ ID NO: 433 - DNA, 705 bp, Haemophilus influenzae
  n 696, 697, 698, 699, 700: n is any nucleotide
  Name: NTH0238
atggatattcgattatggagatctattgttagacaaagaacattacgagctctcacaagtaaagaaaagaaaatcagacaaagaggcggaaagcctaaatataaacatcttgctcataaatcctttaatctttttgaggttatcgccccatataaaattattttagctaaagaaatagggtatgaatttgtagcatttaaagaagagctcgaagaaaaagcaaaactagcagcacgaagtcgaagtcgcctgaaactaaattttcgggacactgatattatcgatgctgccgcttgtagcgttttaatagctgttttagatacgataaaatcgcaatatagaaccttgaaatttcaaattgtaagaccaaaatcaaaaccagcagatcatcgtaaacatattccctatgatgttgatgctatattttgtcatataggactatataaatccttagggtttaattatacatcttcatcttctcaagaaaatgtgaaatgttggcattatgtttatagtgatagtgcagatggcgaaatcacaaagccactattagatgaacttaaaagtatgggggtgaaagggatatatcctagttacattgaagcgattgcaaatgcggtagaacatgcttacgcccaaaatatttatagtgaacgagaatttcctataaaacgttggtggatgttgcttgctatnnnnnttaat

SEQ ID NO: 434 - protein, 235 aa, Haemophilus influenzae
  Xaa 232, 233, 234: Xaa is any amino acid
  Name: NTH0238
MDIRLWRSIVRQRTLRALTSKEKKIRQRGGKPKYKHLAHKSFNLFEVIAPYKIILAKEIGYEFVAFKEELEEKAKLAARSRSRLKLNFRDTDIIDAAACSVLIAVLDTIKSQYRTLKFQIVRPKSKPADHRKHIPYDVDAIFCHIGLYKSLGFNYTSSSSQENVKCWHYVYSDSADGEITKPLLDELKSMGVKGIYPSYIEAIANAVEHAYAQNIYSEREFPIKRWWMLLAXXXN

SEQ ID NO: 435 - DNA, 966 bp, Haemophilus influenzae
  n 961, 962, 963, 964, 965: n is any nucleotide
  Name: NTH0239
ttggatagtgggcaagaaggcattattgcggtttatgatttaggcggtggcacatttgatatttcaattttacgtttatcaaaaggtatctttgaagttttagcaacggggggagacactgcattaggtggagatgattttgatcatttaattgcagattgggtaatagaacaaactaagctaaaaccacaaacagcaaatcaacagcgtgagctaataacccttgccaaccaagctaaaattaccttgactaatgaaaaaagtgcggttatttcttggcaagatttttcagtagagatttcgcgggaacaattcaatgaattaatttatccgcttgtaaaacgttcattgctaacttgtcgtcgggcattgaaagatgccaatgtggaatccgaagaagtacaagccgtagtaatggttggtggttcaactcgcgtgccttatgtaagagaacaagttggcgagttttttggtaaaacaccattaacctcaatcgatcctgataaagttgtggcacttggtgctgcaattcaagcagatattttagtcgggaataaaactgattctgatatgttattacttgatgttgtcccgctttccttaggcattgagacgatgggcggattagtggaaaaaattattccacgtaatacaacaattcctgtggctcgtgcgcaagagtttactacttttaaagatgggcaaacggcaatgagtgttcatgtgctacaaggcgaacgagagctagtcgatgattgtcgttctttaggacgctttactctacgaggtattccgccaatggcggcgggggcagcccatattagagtgacttatcaagtggatgcagatggtttattaagcgttacagcgatggaaaaatcgacaaaagtacaggcttcaatacaaattaaaccatcttatggattaactgatgaagaagtaaccgcaatgtggggtctcnnnnnt

SEQ ID NO: 436 - protein, 322 aa, Haemophilus influenzae
  Xaa 321, 322: Xaa is any amino acid
  Name: NTH0239
LDSGQEGIIAVYDLGGGTFDISILRLSKGIFEVLATGGDTALGGDDFDHLIADWVIEQTKLKPQTANQQRELITLANQAKITLTNEKSAVISWQDFSVEISREQFNELIYPLVKRSLLTCRRALKDANVESEEVQAVVMVGGSTRVPYVREQVGEFFGKTPLTSIDPDKVVALGAAIQADILVGNKTDSDMLLLDVVPLSLGIETMGGLVEKIIPRNTTIPVARAQEFTTFKDGQTAMSVHVLQGERELVDDCRSLGRFTLRGIPPMAAGAAHIRVTYQVDADGLLSVTAMEKSTKVQASIQIKPSYGLTDEEVTAMWGLXX

SEQ ID NO: 437 - DNA, 132 bp, Haemophilus influenzae
  Name: NTH0240
gtgattacagttccagcttatttcgatgatgctcagcgtcaaagcaataaagatgctgcgcgtttagctgggctaaatgtattacgtttattgaatgaaccctactgcagctgcacttgcttatggattgga

SEQ ID NO: 438 - protein, 44 aa, Haemophilus influenzae
  Name: NTH0240
VITVPAYFDDAQRQSNKDAARLAGLNVLRLLNEPYCSCTCLWIG

SEQ ID NO: 439 - DNA, 579 bp, Haemophilus influenzae
  Name: NTH0241
ttgttagcttgcctggatcctcaagtaagccaacttgctttaacgcttgccccgattttacaagaaacgaatctcaatcaagtatttgtcacctctttattgccgacttcttatacggatgcggaaaccgtgacgaaacttgcgggacaaacagcccgtttattaaatggtattccattagacgaagaagaaactcgcttagcctttgatgtttatccgcatcaagcacctaatttatcgaatcaattacaacgaatttttccgcaattagatcgtgctacattccactcaatccaagtgcctgtattttatggattggcacaaaaagtcaccgcactttcagattatgatttcgactatcagcctcaaaatagcgagcttgtcgctttagaagaaaccttaattacgcctgtgcttaatggagaacaagaaaatggcgaagaatcagtaaaacttcatttaagtcaaataagtgcggtagaaaatggcgtagaattttggtctgtggcagatgaacaacgctttaatctcgctttactttcagtgaaattgttggaaggaatttatcagcaaggttat

SEQ ID NO: 440 - protein, 193 aa, Haemophilus influenzae
  Name: NTH0241
LLACLDPQVSQLALTLAPILQETNLNQVFVTSLLPTSYTDAETVTKLAGQTARLLNGIPLDEEETRLAFDVYPHQAPNLSNQLQRIFPQLDRATFHSIQVPVFYGLAQKVTALSDYDFDYQPQNSELVALEETLITPVLNGEQENGEESVKLHLSQISAVENGVEFWSVADEQRFNLALLSVKLLEGIYQQGY

SEQ ID NO: 441 - DNA, 804 bp, Haemophilus influenzae
  Name: NTH0242
atgagccgttttgaaacgcaatttgcgacacttaacgcaaaaaatgaaggggctttcgtgccgttcgttaccctttgcgaccctactttcgactgctcttttgagatcatttgcacacttgtggataacggtgcagatgctttagaactcggttttcctttttccgatccgctactcgatggcccagttattcaagccgcgaataatcgtgctttaactgcaggtcatagcagtgaagatagctttaaactattggaaaaagtgcggtcaaaatatcccgagattccgattagcttattactttgtgccaatttaatttttgctaaaggtttagatgctttttatcaacgctgtgcagaagttggtgttgatgctgtgcttgtagcagatattccgttactcgcaaaagaagattatgtacaagcggccaaaaaacacggcattcaacccgtctttatttgcccgccaaatgcggatgagaaaacaattcaaggcgtagcgaaaaatagcgaaggctatacctatttagtctcacgtgcaggcgtaaccagtgctgaaaatcaagctcacgcagcaaatttagatacccttgtagaacaacttaaagcccactatgccccgccaattttacaaggcttcggcattgcacagcctgcacaagttaaagaagccttagctttgggagcggctggtgcaatttcaggttcggcaacagtaaaaattattgagcgaaatttagataatcacgagccatgtttagctgaattagctgaatttgttcaaacgatgaaagctgcaacaaaa

SEQ ID NO: 442 - protein, 268 aa, Haemophilus influenzae
  Name: NTH0242
MSRFETQFATLNAKNEGAFVPFVTLCDPTFDCSFEIICTLVDNGADALELGFPFSDPLLDGPVIQAANNRALTAGHSSEDSFKLLEKVRSKYPEIPISLLLCANLIFAKGLDAFYQRCAEVGVDAVLVADIPLLAKEDYVQAAKKHGIQPVFICPPNADEKTIQGVAKNSEGYTYLVSRAGVTSAENQAHAANLDTLVEQLKAHYAPPILQGFGIAQPAQVKEALALGAAGAISGSATVKIIERNLDNHEPCLAELAEFVQTMKAATK

SEQ ID NO: 443 - DNA, 174 bp, Haemophilus influenzae
  Name: NTH0243
ttggcaaaacacgaaggcattattcctgcattagaaagctcacacgccttggcttatgccttgaaattgattaaacaaaatcctgaaaaagaacaacttttagtggttaatctttcaggacgaggcgataaagatatttttactgttgataaaattttaaatggaggaacgaac

SEQ ID NO: 444 - protein, 58 aa, Haemophilus influenzae
  Name: NTH0243
LAKHEGIIPALESSHALAYALKLIKQNPEKEQLLVVNLSGRGDKDIFTVDKILNGGTN

SEQ ID NO: 445 - DNA, 735 bp, Haemophilus influenzae
  n 726, 727, 728, 729, 730: n is any nucleotide
  Name: NTH0244
atgaaaatgaaaaaatttattctaaaatcttttttattggctactttaggttgtgttgcttttacttctatggcacaagcggaggaacgtgttgtcgcgacagtagatggtattcctattttagaaagccaagttcgtgccaatatgggtaaaaaaggcgatcgccaaagtgcacttgataaaattattgatgatcttttagtgcaaaaagcgattcaagaatctggtgtgaaaattgatcctcgtgaaatcgatcgtgttgtggaagacactgcagctagaaatggcttaacttatggtcaatttttggatgcgttagattatcaaggcatttcattaaatacattccgtcagcaaattgccaatcaaatggtgatgggggctgtacgtaacaaagctattcaagaaagtattgatgtaacgcgtgaagaagtggttgcacttggtcaaaaaatgttggatgaggcaaaatcacaaggcactgcacaaaaagttacaggtaaagaatacgaagtgcgtcacattttgttaaaacttaatccattgttaaatgatgctcaagcaaaaaaacaattagctaaaattcgttctgatattattgcaggtaaaacaacttttgctgatgcggctttaaaatattctaaagattatttatcgggtgcgaatggcggtagtttaggttatgcgttcccagaaacttatgcaccacagtttgcgcaaaccgtnnnnnttaat

SEQ ID NO: 446 - protein, 245 aa, Haemophilus influenzae
  Xaa 243, 244: Xaa is any amino acid
  Name: NTH0244
MKMKKFILKSFLLATLGCVAFTSMAQAEERVVATVDGIPILESQVRANMGKKGDRQSALDKIIDDLLVQKAIQESGVKIDPREIDRVVEDTAARNGLTYGQFLDALDYQGISLNTFRQQIANQMVMGAVRNKAIQESIDVTREEVVALGQKMLDEAKSQGTAQKVTGKEYEVRHILLKLNPLLNDAQAKKQLAKIRSDIIAGKTTFADAALKYSKDYLSGANGGSLGYAFPETYAPQFAQTVXXN

SEQ ID NO: 447 - DNA, 573 bp, Haemophilus influenzae
  Name: NTH0245
ttgtgcattgaaatactattgataaagctgggaaaaatggaaaaaattattattgatcatgatcgttttcttcgcacaatttcgcgtatttctcacgaaattattgaaaaacatcaaaccttagatgatcttgttattgttggaattaaacgccgtggcgcggaaattgcagaattattacaacgtcgagttgaagagttaagtggtataaatttaccttcaatggaactggatattaccttttatcgagatgatttaactttggttgatcaggaagataaaatgccagtttatagtggttcatcacaatatttgaatattcaagataaaaccgtcattttggttgatgatgtgttgtttactggtcgaaccattcgagcggcaatggatgcgcttactgattttggtcgtgctgcaaaaattgaattagtgatttttgttgatcgtggccatcgtgaattacccattcgtgctgattacgtaggtaaaaatgtgccaacaagccgtgatgaacttgtacaagttcgtactgaaaaacaagatggctgttacgaagttgctattctagggaaa

SEQ ID NO: 448 - protein, 191 aa, Haemophilus influenzae
  Name: NTH0245
LCIEILLIKLGKMEKIIIDHDRFLRTISRISHEIIEKHQTLDDLVIVGIKRRGAEIAELLQRRVEELSGINLPSMELDITFYRDDLTLVDQEDKMPVYSGSSQYLNIQDKTVILVDDVLFTGRTIRAAMDALTDFGRAAKIELVIFVDRGHRELPIRADYVGKNVPTSRDELVQVRTEKQDGCYEVAILGK

SEQ ID NO: 449 - DNA, 459 bp, Haemophilus influenzae
  Name: NTH0246
ttgcaccatgtttcttgttcgttatactatccaaaacattccatcaaaggaaataaaattatgcactactctattcaagattttattcaactcatcgcccaacttcgcaatccaaatggcggatgcccttgggatttaaaacaaaattatgaatccatgattccttgtttaacggaagaaacttacgaagtaatcgaagccattgagaaaaaagacataccaaatttacgtgaagaattaggggatttattgttgcaagtcgttttcttcagccagcttgcaacggaagataaatactttacttttgacgatgtgttacaagatatcgctgaaaaaattgtacgccgtcatcctcacgtgtttggtgatgcaaaagcgggggacgaaacagaagccctttcccgttggaacgaaatgaaagccaaagaaaaacaaggtaaaagtgaagaaacctctttt

SEQ ID NO: 450 - protein, 153 aa, Haemophilus influenzae
  Name: NTH0246
LHHVSCSLYYPKHSIKGNKIMHYSIQDFIQLIAQLRNPNGGCPWDLKQNYESMIPCLTEETYEVIEAIEKKDIPNLREELGDLLLQVVFFSQLATEDKYFTFDDVLQDIAEKIVRRHPHVFGDAKAGDETEALSRWNEMKAKEKQGKSEETSF

SEQ ID NO: 451 - DNA, 477 bp, Haemophilus influenzae
  Name: NTH0247
atgtctggacaaacaacatcggaatacattagccaccatttatcctttctcaaaacaggggatggattttggaatgttcatatagatacgttgttcttttctattcttgctgcggttattttcctatttgttttttctcgagtagggaaaaaagcaacaactggcgttccaggaaaaatgcaatgcttagttgaaattgttgtggaatgggttaatggaatcgtgaaagaaaattttcatggtccacgtaacgtagttgcgccacttgcattaacaattttctgttgggtattcatcatgaatgctatcgacttaattcctgttgatttcttacctcaatttgcaggtttgttcggtattcattatcttcgtgcagtgccgacagcagatattagcgcaactttgggtatgtccatttggggtttctttttaattcttttttatacaataaaatctaaaggattccaagggttaagt

SEQ ID NO: 452 - protein, 159 aa, Haemophilus influenzae
  Name: NTH0247
MSGQTTSEYISHHLSFLKTGDGFWNVHIDTLFFSILAAVIFLFVFSRVGKKATTGVPGKMQCLVEIVVEWVNGIVKENFHGPRNVVAPLALTIFCWVFIMNAIDLIPVDFLPQFAGLFGIHYLRAVPTADISATLGMSIWGFFLILFYTIKSKGFQGLS

SEQ ID NO: 453 - DNA, 375 bp, Haemophilus influenzae
  Name: NTH0248
gtgatgtcgcgcattttatctcacgctaaaaaaaactacagaaaagctattattattgagagtcttttgcttgtagttttttatttgcttatttatggatggcaacgccaaagtgcggtagattttagctacggttttttaagtgcctttttgcctttttgtacatttatatttatcattttttacagaaaacaaaatttttcaacaaaactgaccgcactttatcgtgctgaagcaataaagtttattttaacgatggtttttatcattattgccatcaaatggttattcgttatcaattttattgcgttttttgttggttttttattggcattagtgctgaataatattattccacttattctcaataaaatt

SEQ ID NO: 454 - protein, 125 aa, Haemophilus influenzae
  Name: NTH0248
VMSRILSHAKKNYRKAIIIESLLLVVFYLLIYGWQRQSAVDFSYGFLSAFLPFCTFIFIIFYRKQNFSTKLTALYRAEAIKFILTMVFIIIAIKWLFVINFIAFFVGFLLALVLNNIIPLILNKI

SEQ ID NO: 455 - DNA, 609 bp, Haemophilus influenzae
  Name: NTH0249
atgaaagccaaattagtcagtttacttgcgcaagcaaatataaaaataagtgatcaacaaattcagcagttgattaatctggtcaatttactcaataaatggaataaagcttataatttgacgtcagttcgtgatccgcaagaaatgttagttaaacatattttagatagtcttgttgtaagtccttatttacaaggtgatcgttttattgatgtcggtacagggcctggtttgcctggtttacctttggcaattattaatccttccaaacaatttgtcctccttgatagcttaggtaagcgtattagttttattcgaaatgctatacgtgagcttagactaactaatgtaacccccgttttaagtcgagtagaagaatatcaacctgaagataaatttgatggtgtattaagccgtgcttttgcttcactaaaagatatgacagattggtgccatcatttaccaaaagaaaatggatatttttatgcattaaaagggatttatcaggaagatgaaattaatgaattgaataaaaaatatactattcaaaaagtgattgaattatctgttcctgaacttataggcgaacgacatttaatcgttttacgt

SEQ ID NO: 456 - protein, 203 aa, Haemophilus influenzae
  Name: NTH0249
MKAKLVSLLAQANIKISDQQIQQLINLVNLLNKWNKAYNLTSVRDPQEMLVKHILDSLVVSPYLQGDRFIDVGTGPGLPGLPLAIINPSKQFVLLDSLGKRISFIRNAIRELRLTNVTPVLSRVEEYQPEDKFDGVLSRAFASLKDMTDWCHHLPKENGYFYALKGIYQEDEINELNKKYTIQKVIELSVPELIGERHLIVLR

SEQ ID NO: 457 - DNA, 165 bp, Haemophilus influenzae
  n 128, 159: n is any nucleotide
  Name: NTH0250
ttggctttcatatttattatctctttgaaaaattacgctattttacttaaaagtgcggtaaatttccttaatgtttttagtaatttgatgaattatttaccgaatcaatgtccagttttacaccatanattgaatgcacctccgcataattcatttcanaggctt

SEQ ID NO: 458 - protein, 55 aa, Haemophilus influenzae
  Xaa 43, 53: Xaa is any amino acid
  Name: NTH0250
LAFIFIISLKNYAILLKSAVNFLNVFSNLMNYLPNQCPVLHHXLNAPPHNSFXRL

SEQ ID NO: 459 - DNA, 90 bp, Haemophilus influenzae
  Name: NTH0251
gtgcggttgaaaaacattaaattttttaaccgcacttttatctttctcgtaagttacatctgccgtaccttacaatacaaaaaggtgcaa

SEQ ID NO: 460 - protein, 30 aa, Haemophilus influenzae
  Name: NTH0251
VRLKNIKFFNRTFIFLVSYICRTLQYKKVQ

SEQ ID NO: 461 - DNA, 1041 bp, Haemophilus influenzae
  n 1028: n is any nucleotide
  Name: NTH0252
atggggtttattatgaaactaaccaaaacagcattatgcaccgcactttttgccacctttactttttcagcgaacgcacaaacttatcctgatttgccagtgggaatcaaaggaggaacaggtgcattaattggcgacaccgtttatgtgggattaggctctggtggcgataaattctataccttagacctaaaagatccttcagcacaatggaaagaaattgctacatttccgggtggcgaacgtaatcaacctgttgcagctgcggtagatggcaaactttatgtattcggtggtttacaaaaaaatgaaaaaggcgaacttcaactcgttaatgatgcttatcgctataacccaagcgataatacttggatgaaacttcctactcgttctcctcgcggtttagtaggatcaagtggtgcatctcacggagataaagtttatattttaggcggctctaacctctctatatttaatggcttcttccaagacaacgttgcagcaggagaagataaagggaaaaaagatgaaatcgttgcagcttacttcgatcaacgtccagaagattatttctttacaacagaattattgagctatgaaccctcaaccaacaaatggcgcaatgaaggtcgcattccattctctggtcgtgctggtgctgcctttacaattcaaggtaatgatctagtggttgtcaatggcgaaattaaacctggacttcgcaccgctgaaacccatcaaggtaaattcactgctaaaggtgtgcaatggaaaaacttacctgacttacctgcgccaaaaggcaaatcacaagatggtttagctggtgcacttgcaggctatagtaacggttattatttagtcactggtggcgcaaattttccaggttcaatcaaacaattcaaagaaggaaaacttcacgcacataaaggtttaagcaaagcttggcataacgaagtttatactttaaataatggtaaatggagcatcgttggggaattaccaatgaatattggctatggtttttnctgtatcttacaa

SEQ ID NO: 462 - protein, 347 aa, Haemophilus influenzae
  Xaa 343: Xaa is any amino acid
  Name: NTH0252
MGFIMKLTKTALCTALFATFTFSANAQTYPDLPVGIKGGTGALIGDTVYVGLGSGGDKFYTLDLKDPSAQWKEIATFPGGERNQPVAAAVDGKLYVFGGLQKNEKGELQLVNDAYRYNPSDNTWMKLPTRSPRGLVGSSGASHGDKVYILGGSNLSIFNGFFQDNVAAGEDKGKKDEIVAAYFDQRPEDYFFTTELLSYEPSTNKWRNEGRIPFSGRAGAAFTIQGNDLVVVNGEIKPGLRTAETHQGKFTAKGVQWKNLPDLPAPKGKSQDGLAGALAGYSNGYYLVTGGANFPGSIKQFKEGKLHAHKGLSKAWHNEVYTLNNGKWSIVGELPMNIGYGFXCILQ

SEQ ID NO: 463 - DNA, 114 bp, Haemophilus influenzae
  n 16, 38: n is any nucleotide
  Name: NTH0253
ttggctatggtttttnctgtatcttacaataataaagntttactgattggcggcgaaactgatggaggtaaggctttaactagcgtcaaagcaatcagctatgatggtaaaaat

SEQ ID NO: 464 - protein, 38 aa, Haemophilus influenzae
  Xaa 6, 13: Xaa is any amino acid
  Name: NTH0253
LAMVFXVSYNNKXLLIGGETDGGKALTSVKAISYDGKN

SEQ ID NO: 465 - DNA, 114 bp, Haemophilus influenzae
  Name: NTH0254
atgcgctataaagagctggcatttttattaatagaattaaacgatggtatttattccaccaccactactcttgttattcattgcataacaatggatttttttgccaaagattgc

SEQ ID NO: 466 - protein, 38 aa, Haemophilus influenzae
  Name: NTH0254
MRYKELAFLLIELNDGIYSTTTTLVIHCITMDFFAKDC

SEQ ID NO: 467 - DNA, 129 bp, Haemophilus influenzae
  n 120, 121, 122, 123, 124: n is any nucleotide
  Name: NTH0255
atgaaagttttaatgatgatgggcgtgattttagccgcaagcagtgttttgactggctgctcaacttctcaaggtgatttattgccaacaggcggtgcaacaagaaaggggaaccgagcnnnnnttaat

SEQ ID NO: 468 - protein, 43 aa, Haemophilus influenzae
  Xaa 41, 42: Xaa is any amino acid
  Name: NTH0255
MKVLMMMGVILAASSVLTGCSTSQGDLLPTGGATRKGNRAXXN

SEQ ID NO: 469 - DNA, 1428 bp, Haemophilus influenzae
  Name: NTH0256
gtgcacttcaaacaaataagggagcggccaatgcaaatgaaagcaaataaagcgttctatgttattggtgggattaccgctcttgtcgtgacgctgatggctggatttcttttctccggtagtagttcaacaaatacagcagaaaccaagaaagaagatactttagatatctcttttaaagatttatcaccggaagaattacgagcaatggggattgagggtgacacatctaaagatacggtaagaacacttataggtaaagtgaaagagcataataagcgatttgatgaagtgattttacaaaatgaacgcttggtaaaagagaatgagcagttaaaaaatcaagcaaacaatacggattatcaaattcaacaggcggtacaagcagaaacaggggcgttaattaatgagattaatgcgttaaaagatcaggttgtacaagctggtaatcaagttgtagggaatggaaatgcccaggcaaatcccaatgctcctctaccaataaacggagcaacaactggccctcaggttgaaactcgagggggaattaattgggtgaaccctagtgatatgccaactacagacagacaagggaatgctctacaaggtattggtgtaaatggtgcaggaatcggttttcccaaaaccttcgataacaatgtgaatgacatccgaaaatctaatgatgggttgcaatctagtacaggtaataatgcaatatttaataccgctacaccatttttcacaattgcagctaactctactttaactaattctgttgctatgactgcgcttgttgggcgtgtgccgattgacaataaggtaaccgagccttatccgtttaaattgcttattggtcgagataacttaattgcaaatggcattgaactgccggatattgaaggcgcaattgtctctggaacagcaagcggtgactggacgctatcttgtgttcgtggtgatgtgaaaagcttaacttttgtgtttagcgatggccgcattgtttcaacagacaattctgacgataaaattggctggttatctgatccacatggtgtgccttgcattcctggagaacgcagaacaaatgctccggaatatctaacgaccaacttcttcttaacgggggcttcagcagctgcacaaggcttatcatcttctcaatcaacaacagtggttgatggcggtgcagtaattggtgcggtaacgggtaataacggtaagtatattcttggtcaagcgttaggtggcggtttgagagaaacagcagactggttccgtcagcgttatggccaaatgtttgatgcggtatatgttccaccgggtaaagaagtggctgtacacatcgaaaaacaaattgatattgattatgaccgcatgtctcgaaaagtgaaatacggacaagcctcaagacaatctaacttggat

SEQ ID NO: 470 - protein, 476 aa, Haemophilus influenzae
  Name: NTH0256
VHFKQIRERPMQMKANKAFYVIGGITALVVTLMAGFLFSGSSSTNTAETKKEDTLDISFKDLSPEELRAMGIEGDTSKDTVRTLIGKVKEHNKRFDEVILQNERLVKENEQLKNQANNTDYQIQQAVQAETGALINEINALKDQVVQAGNQVVGNGNAQANPNAPLPINGATTGPQVETRGGINWVNPSDMPTTDRQGNALQGIGVNGAGIGFPKTFDNNVNDIRKSNDGLQSSTGNNAIFNTATPFFTIAANSTLTNSVAMTALVGRVPIDNKVTEPYPFKLLIGRDNLIANGIELPDIEGAIVSGTASGDWTLSCVRGDVKSLTFVFSDGRIVSTDNSDDKIGWLSDPHGVPCIPGERRTNAPEYLTTNFFLTGASAAAQGLSSSQSTTVVDGGAVIGAVTGNNGKYILGQALGGGLRETADWFRQRYGQMFDAVYVPPGKEVAVHIEKQIDIDYDRMSRKVKYGQASRQSNLD

SEQ ID NO: 471 - DNA, 867 bp, Haemophilus influenzae
  Name: NTH0257
gtgacaggcacagccttttcaggaacagtgaaagtaaacgatgaaatttacctttccactggacagaaagttcgtataaaagcgattcacgcacaaaatacatcaagcgaacaaggtattgcggggcaacgtttagcgttaaatttaaatgctgatttagaccgcacatcaatgaaacgaggtgattggttattgcagaatgagccacttccaccaacagatcgcatcagtgtacaaattttggctgaagtaccattaaatgaaaaccaaccagtgcatatttatcacggtgcaagtcgcactacgggtaaactcactttattacagggaaaaaatgccgcaaaaaatgaccgcactttagctgaaatcatattggattcaccattattcttggcttttggagacaaacttattttacgcagtggcgatacaaaaaccttaattgccggcgcacgagtattggaaattaactcgccaaaacgtcataaacgcactgaagtgcggttaaatttcttagcgaatttagcattggcagagaacgcttcgcaacgtattgcgcttacccttaaacataatgcgacaacagcacgccaattaatgtggacggaacaactgacttccttgcaattagataaagcactcgtcgagcgagacgccgtacgttatcaagattggtgttttaatactaattacatacaagaaaaaacgcagcaaattttaaccgcacttaatacttatcacgagcaacataatgatcaacttggtgtaagcaaagccagattatatcgaatgaccgccttaaaccagcctgaaaacttgatcaatcttttattgatgaaatgtaaaaggggtaccgagtccgaatcg

SEQ ID NO: 472 - protein, 289 aa, Haemophilus influenzae
  Name: NTH0257
VTGTAFSGTVKVNDEIYLSTGQKVRIKAIHAQNTSSEQGIAGQRLALNLNADLDRTSMKRGDWLLQNEPLPPTDRISVQILAEVPLNENQPVHIYHGASRTTGKLTLLQGKNAAKNDRTLAEIILDSPLFLAFGDKLILRSGDTKTLIAGARVLEINSPKRHKRTEVRLNFLANLALAENASQRIALTLKHNATTARQLMWTEQLTSLQLDKALVERDAVRYQDWCFNTNYIQEKTQQILTALNTYHEQHNDQLGVSKARLYRMTALNQPENLINLLLMKCKRGTESES

SEQ ID NO: 473 - DNA, 636 bp, Haemophilus influenzae
  Name: NTH0258
atgtctgagattttaaaaaatgacattgatccaatcgaaacacaagattggttgcaatcattagattcattaattcgtgaagagggcgttgagcgtgctcaatatattgttgagcaagttattggtcaagcacgtacaagtggtgtttcattgccaacaggagttaccactgattacgtgaatactattcctgtggctgagcaacctgcttatccaggtgatcacgccatcgaacgtcgtattcgttcagcagtacgttggaatgcgatcgcgatggttttacgcagtcagaagaaagatcttgatttaggtgggcatatttccactttccaatctgcagcaacaatgtatgaagtttgctacaaccacttttttaaagctgcaacagagaaaaatggcggcgatttaattttcttccaaggccatgcagcaccaggtatgtatgcgcgtgctttcttagaaggtcgtttaactgaagaacaaatggataacttccgtcaagaagcctttaccgacggtttatcttcatatccacaccctaaattaatgcctgaattctggcaattctctacggtttctatgggtttaggcccctgtgaatgccatctaccaagcgcgtttcttaaaatatctcga

SEQ ID NO: 474 - protein, 212 aa, Haemophilus influenzae
  Name: NTH0258
MSEILKNDIDPIETQDWLQSLDSLIREEGVERAQYIVEQVIGQARTSGVSLPTGVTTDYVNTIPVAEQPAYPGDHAIERRIRSAVRWNAIAMVLRSQKKDLDLGGHISTFQSAATMYEVCYNHFFKAATEKNGGDLIFFQGHAAPGMYARAFLEGRLTEEQMDNFRQEAFTDGLSSYPHPKLMPEFWQFSTVSMGLGPCECHLPSAFLKISR

SEQ ID NO: 475 - DNA, 183 bp, Haemophilus influenzae
  Name: NTH0259
gtgaatgccatctaccaagcgcgtttcttaaaatatctcgataaccgtggtttaaaagataccaaagatcaaaaagtttatgcattcttaggcgatggcgagatggatgaaattgagtctaaaggtgcattaacttttgcggctcgtgagaagttagataacttaatcttcacgtatcagctg

SEQ ID NO: 476 - protein, 61 aa, Haemophilus influenzae
  Name: NTH0259
VNAIYQARFLKYLDNRGLKDTKDQKVYAFLGDGEMDEIESKGALTFAAREKLDNLIFTYQL

SEQ ID NO: 477 - DNA, 1515 bp, Haemophilus influenzae
  n 1510, 1511, 1512, 1513, 1514: n is any nucleotide
  Name: NTH0260
gtgcctgaaggtgtaggcttaatcgtccgtactgctggtgtgggaaaatcgccagaagaattacaatgggatataaaagtattattacatcattgggaagcgatcaaacaagcttcacaaagtcgtccagctccatttttaattcatcaagaaagcgatgtgattgtacgcgctattcgcgattatttgcgtcgtgatattggtgagatcctgattgatagcccaaaaatttttgagaaagcgaaagagcatatcaaacttgtgcgtcctgatttcatcaatcgcgtgaaactttatcaaggcgaagtgccacttttcagtcactatcaaattgaatctcaaattgaatccgcattccaacgtgaagtgcgtttaccttctggcggttcaatcgttattgatgtaactgaagcattaaccgccattgatattaactccgcacgttctactcgtggtggcgatattgaagaaaccgcattaaataccaaccttgaagcggcagatgaaatcgcgcgtcaattacgcttacgtgacttaggtggattagttgtcattgatttcattgatatgacaccaattcgccatcaacgtgaagtagaaaatcgtattcgtgatgcggttcgtccagatcgtgcccgtattcaaattagccgaatttctcgttttggtttgttagaaatgtcacgtcagcgtttaagcccatcattgggcgaatcttcgcaccatatttgccctcgttgtcaaggaacaggcaaagtgcgtgataatgaatctctttctttatctattttacgtttgctggaagaagaagcattaaaagagaacaccaagcaagtacataccattgtgccagtacaaattgcctcttatcttcttaacgaaaaacgcaaagcaatcagtaatattgaaaagcgtcataatgtcgatattattgttgccccaaatgaagcaatggaaacaccgcactttagtgttttccgtttacgtgatggcgaagaagtaaatgaattaagctataacttagcgaaaattcactgcgctcaagatgaaaatactgaagaatcactgctttctcgtaatgtggaaacaacagctgttattgaacaaccagcggttgaaagtgcagtagttgcactttctatttcagaagcagccccaacgccagttgagcgtaaatcaaatgaaccctctttgttagctaaaattattgcgaaaattaaaggtttatttgcgactaaatctgaagaaaacaaaccgaaaaataaccgcacttcgcgcaatcctaatcgtaatcaacgccgttcacaggatcgtcgttcttctcgtcgtccacgttctgaaaataacgaaacagaaagaaccgaagaacaggttcgtaatgtccgtgagcgtaatcaacgccgtccgcgccgtaacttagtggaagaaagtatcgctgaaagtgcggtaaattctacacctgtttttgaggctaaagaagaaaggggtaccgagtccgaatcgtatacannnnnt

SEQ ID NO: 478 - protein, 505 aa, Haemophilus influenzae
  Xaa 504, 505: Xaa is any amino acid
  Name: NTH0260
VPEGVGLIVRTAGVGKSPEELQWDIKVLLHHWEAIKQASQSRPAPFLIHQESDVIVRAIRDYLRRDIGEILIDSPKIFEKAKEHIKLVRPDFINRVKLYQGEVPLFSHYQIESQIESAFQREVRLPSGGSIVIDVTEALTAIDINSARSTRGGDIEETALNTNLEAADEIARQLRLRDLGGLVVIDFIDMTPIRHQREVENRIRDAVRPDRARIQISRISRFGLLEMSRQRLSPSLGESSHHICPRCQGTGKVRDNESLSLSILRLLEEEALKENTKQVHTIVPVQIASYLLNEKRKAISNIEKRHNVDIIVAPNEAMETPHFSVFRLRDGEEVNELSYNLAKIHCAQDENTEESLLSRNVETTAVIEQPAVESAVVALSISEAAPTPVERKSNEPSLLAKIIAKIKGLFATKSEENKPKNNRTSRNPNRNQRRSQDRRSSRRPRSENNETERTEEQVRNVRERNQRRPRRNLVEESIAESAVNSTPVFEAKEERGTESESYTXX

SEQ ID NO: 479 - DNA, 300 bp, Haemophilus influenzae
  Name: NTH0261
ttgggtgagaatatgttggataattgcttttcttttcctgttcgtgtgtattatgaagatactgatgcaggtggcgtagtgtatcacgctcgctatttgcatttttttgaacgagcaagaacagaatatttgcgtacattaaattttacgcaacaaaccttactagaggaacaacaactcgcatttgttgtcaaaacgctcgccattgattattgcgtggcagcaaaattggatgatttacttatggtggaaacagaggtttcagaagtaaaaggggctacatgccttttgaacatagac

SEQ ID NO: 480 - protein, 100 aa, Haemophilus influenzae
  Name: NTH0261
LGENMLDNCFSFPVRVYYEDTDAGGVVYHARYLHFFERARTEYLRTLNFTQQTLLEEQQLAFVVKTLAIDYCVAAKLDDLLMVETEVSEVKGATCLLNID

SEQ ID NO: 481 - DNA, 909 bp, Haemophilus influenzae
  Name: NTH0262
atggattacgaaaatcaaattgccaatattttctcactaaatggcgaattaagccaaaatatcaaaggttttcgtcctcgagctgaacaacttgaaatggcacatgctgtaggtaaagcaattcaaaataaatcttctcttgttattgaagctggaacgggtacaggaaaaacctttgcatatctcgcgccagctttagtttttggtaaaaaaaccattatttctacaggatctaaaaatcttcaagatcagctttttaatcgagatcttcctgctattaaaaaagcccttaatttcacgggaaaaattgcgttgctaaaaggtcgggcaaactatctttgtttagagcgtttagatcaagtgattgctcaaggtgtgcttggagataagtctgttttagctgaattaagtaaagtacgaaaatggaataatagtactaaaacaggcgatttcacagaatgtatcgagcttgcagaagatagcccaattattcctcaactgacgagtacagctgaaagttgtttaggcaccgattgccctaattattcagaatgttatgtagcaagtgcgcgtaaaaaagcattaaatgctgatttggttgtagttaatcatcatttattttttgctgatatggctgtgaaagaaagtggttttggcgaacttattccaaatgcagaagtgattatttttgacgaagctcatcagctgccagatattgccagtcagtattttggtcaatctttaacatcacgccagctttttgatttatgcaaggatattaatattgtctatcgcacagaacttaaagatatgcagcagcttggcacaacatctgataccttactgagagtgggacaagattttcgtttattactgggtaatgggagtaatgtttcgaggaaattggcg

SEQ ID NO: 482 - protein, 303 aa, Haemophilus influenzae
  Name: NTH0262
MDYENQIANIFSLNGELSQNIKGFRPRAEQLEMAHAVGKAIQNKSSLVIEAGTGTGKTFAYLAPALVFGKKTIISTGSKNLQDQLFNRDLPAIKKALNFTGKIALLKGRANYLCLERLDQVIAQGVLGDKSVLAELSKVRKWNNSTKTGDFTECIELAEDSPIIPQLTSTAESCLGTDCPNYSECYVASARKKALNADLVVVNHHLFFADMAVKESGFGELIPNAEVIIFDEAHQLPDIASQYFGQSLTSRQLFDLCKDINIVYRTELKDMQQLGTTSDTLLRVGQDFRLLLGNGSNVSRKLA

SEQ ID NO: 483 - DNA, 828 bp, Haemophilus influenzae
  n 779, 791, 823, 824, 825, 826, 827: n is any nucleotide
  Name: NTH0263
ttgcaaggttggcaattcgttaaattggtggaatggcctgtttttcgtcagcaatgtttgcccacatttagcttgatttttatgctgtgctttaccagttttaccgttgttcttacgttaggtggtgggcctcaatatacaacattagaaacagcaatttaccaagcgattttatttgaatttgatctgccgaaagcggcactctttgctatgttgcaatttgtattttgcttgcttttatttagtttaacatctcgtttttcgccttctaatcaaaatggcttgagcaatagtaatatttggtttgtgaaacctaaaagtgcggtcaaaattttctatgtttttgttttaattgtttttgtctttttccttttttcgccagttttgaatattcttattagcgcattgagttcatcaagtttactcaaggtttggcataattctcaactttggcgtgcgttaggttattcactttctatcgcacccttgtccgcattacttgcattaacgatggcgattgccttattgcttttatcacgccgtttagaatggttacattatcagaaaatcgctcaatttattattaatgcaggaatggtaattttggcaatcccgattttagtactcgcaatggggttatttttattattacaagagcgtgatttttcgaatattgatttgtttattatcgttgtattttgcaatgcgttaagtgcaatgccttttgttttacgtattttgagcgcacctttcataataatatgcgttattacgaaatntgtggggtctcntagagtcgacctgcaggcagccaagtctggcnnnnnt

SEQ ID NO: 484 - protein, 276 aa, Haemophilus influenzae
  Xaa 260, 264, 275, 276: Xaa is any amino acid
  Name: NTH0263
LQGWQFVKLVEWPVFRQQCLPTFSLIFMLCFTSFTVVLTLGGGPQYTTLETAIYQAILFEFDLPKAALFAMLQFVFCLLLFSLTSRFSPSNQNGLSNSNIWFVKPKSAVKIFYVFVLIVFVFFLFSPVLNILISALSSSSLLKVWHNSQLWRALGYSLSIAPLSALLALTMAIALLLLSRRLEWLHYQKIAQFIINAGMVILAIPILVLAMGLFLLLQERDFSNIDLFIIVVFCNALSAMPFVLRILSAPFIIICVITKXVGSXRVDLQAAKSGXX

SEQ ID NO: 485 - DNA, 186 bp, Haemophilus influenzae
  Name: NTH0264
ttggggggaaaaaagggcggaaatagtgaacaagcgggtgaaaatgcgggtgtaaaagcaggaaataaaggtgcagaaacagcatggacgcgcttgaaatggatatgttattcaacaaaatggggcggcataaatcatgacagaacaaaaacaagtgaaaaagccttctgctcgtcgtcgtgcgcg

SEQ ID NO: 486 - protein, 62 aa, Haemophilus influenzae
  Name: NTH0264
LGGKKGGNSEQAGENAGVKAGNKGAETAWTRLKWICYSTKWGGINHDRTKTSEKAFCSSSCA

SEQ ID NO: 487 - DNA, 216 bp, Haemophilus influenzae
  n 203, 204, 205, 206, 207: n is any nucleotide
  Name: NTH0265
atgctgtttctgcacctttatttcctgcttttacacccgcattttcacccgcttgttcactatttccgcccttttttccccccaattattggctcccctttctatccctccctttccaaccgtttttcccccccttcccctccccaattcccttgcccctccttcccaccgccttatttcccttcccttttacccttacccannnnnttaattaat

SEQ ID NO: 488 - protein, 72 aa, Haemophilus influenzae
  Xaa 68, 69: Xaa is any amino acid
  Name: NTH0265
MLFLHLYFLLLHPHFHPLVHYFRPFFPPIIGSPFYPSLSNRFSPPSPPQFPCPSFPPPYFPSLLPLPXXLIN

SEQ ID NO: 489 - DNA, 363 bp, Haemophilus influenzae
  Name: NTH0266
ttgtattcttgggcagtatccggcaatactgcagaacaagtggaattagcctttgtgttagatcaagatatggatggggtagataaaccttacttccgtaaattatttcgtcaaacagtagaaaatattgaaaccgttgatttttcaatttcgccttatattgaccgcgcttttgatgagcttgatcctattgaaacggcaattttacgtttggccgtttatgaattgtgcttcgagttagatgtgccatataaagtggttatcaatgaagcgattgaagtggcaaaagtattcggtgcagatgaaagccataaatatatcaatggcgtacttgataaaatcgcaccagcattagggcgtaaa

SEQ ID NO: 490 - protein, 121 aa, Haemophilus influenzae
  Name: NTH0266
LYSWAVSGNTAEQVELAFVLDQDMDGVDKPYFRKLFRQTVENIETVDFSISPYIDRAFDELDPIETAILRLAVYELCFELDVPYKVVINEAIEVAKVFGADESHKYINGVLDKIAPALGRK

SEQ ID NO: 491 - DNA, 480 bp, Haemophilus influenzae
  Name: NTH0267
atggcaatgggtgaatttgatttaattaaacgatattttcagcaacaaatattagttgatgattccgttcaattatctattggcgacgattgtgcgctggtttccgtgccagagaattatcagcttgccattacgaccgatacaatggtggaaaatacgcattttttaccaaccatttcacctgaggacttggcttataaggcggttgcaacaaatttaagtgatcttgctgcaatgggggcacagccaaaatgggtttcactggcattaactttgccaaatgtagacgaaaattggatttcaacatttagccaaagtttattacacacgttaaaacaatacaacgtcacattaattggtggcgatactacaaaaggtaatttgtctattacgattacggcacaaggttttgtcgaaaaaaacaaaggaatttgtcggcataaagcacaaatcggtgatttaatttatgtttcaggcact

SEQ ID NO: 492 - protein, 160 aa, Haemophilus influenzae
  Name: NTH0267
MAMGEFDLIKRYFQQQILVDDSVQLSIGDDCALVSVPENYQLAITTDTMVENTHFLPTISPEDLAYKAVATNLSDLAAMGAQPKWVSLALTLPNVDENWISTFSQSLLHTLKQYNVTLIGGDTTKGNLSITITAQGFVEKNKGICRHKAQIGDLIYVSGT

SEQ ID NO: 493 - DNA, 432 bp, Haemophilus influenzae
  Name: NTH0268
ttgcaacaacgacatcttagacccacacctagaattgaacttgggcgggcgttaattgatattgctcatgctgccattgatctttccgatgggctaatatctgatttagggcatattcttgaacgaagtcaatgtagtgctgaagttgaactgactgcattacctctttcatcatcgattttaaataaatatgatcgcactcaagcggaacaatttgccttaagtggtggcgaagactatgaactttgttttaccataccgcccgaatataaagatgaattagaattacgcttgaaaaaactgaacgtgccttgcacttgtattggtaaaattaatgaaaagtgcggtgacttttctccccgttttttacgggatggaaaacctgtgaatataattttttcaagcggtttcgatcattttaaggaatcaaaa

SEQ ID NO: 494 - protein, 144 aa, Haemophilus influenzae
  Name: NTH0268
LQQRHLRPTPRIELGRALIDIAHAAIDLSDGLISDLGHILERSQCSAEVELTALPLSSSILNKYDRTQAEQFALSGGEDYELCFTIPPEYKDELELRLKKLNVPCTCIGKINEKCGDFSPRFLRDGKPVNIIFSSGFDHFKESK

SEQ ID NO: 495 - DNA, 489 bp, Haemophilus influenzae
  Name: NTH0269
atgacagaaaataatcctcttaaaaaaatctctcttttaaatcctattcatttgcttgccgttggttttggctcgggtttaatttatccagcacccggcacttgggggagcttagctggaacaattttaggtgtgattttactttccttattaggcgtaaaaatctttttaattttcaccgcactttgttttctactcggttgctacctttgccaaaaaactactgcagatatgggcgtacacgatcatggttctatcgtctgggatgaatttgtcggcgtatttattgtattagcagcgataccgtcattatcttggcaatggattttggctgcttttgcgttattccgcttttttgatattttaaaaccgtttccaattcgttattttgacgaaaaactcgaaaatggttttggcattatgatcgatgacgttttagcggcaatttatgctgtgattgttgtatttgctattcaatattggatgttg

SEQ ID NO: 496 - protein, 163 aa, Haemophilus influenzae
  Name: NTH0269
MTENNPLKKISLLNPIHLLAVGFGSGLIYPAPGTWGSLAGTILGVILLSLLGVKIFLIFTALCFLLGCYLCQKTTADMGVHDHGSIVWDEFVGVFIVLAAIPSLSWQWILAAFALFRFFDILKPFPIRYFDEKLENGFGIMIDDVLAAIYAVIVVFAIQYWML

SEQ ID NO: 497 - DNA, 219 bp, Haemophilus influenzae
  n 214, 215, 216, 217, 218: n is any nucleotide
  Name: NTH0270
ttggatgttgtgatgctaaatttaatcattgtgcatttatttggattaatgacgccagggcctgatttcttttatgtaagtcgaatggcggcaagtaactctcgtcgtaataccagtttggggcattttaagcataacgcttggtatcgctttttggggaatgcttctatgttggattggccggggtttgttcttaccattccaccttacatgnnnnnt

SEQ ID NO: 498 - protein, 73 aa, Haemophilus influenzae
  Xaa 72, 73: Xaa is any amino acid
  Name: NTH0270
LDVVMLNLIIVHLFGLMTPGPDFFYVSRMAASNSRRNTSLGHFKHNAWYRFLGNASMLDWPGFVLTIPPYMXX

SEQ ID NO: 499 - DNA, 270 bp, Haemophilus influenzae
  Name: NTH0271
ttgagacttggttgggggcaggattggtcttatggtatttcatcacgtcttacttttagttatgccaatcgagtgtatagagagaaagatttgattgggatacagcaaaaaaatcgtgaatacgcaaccacaattactttatggcatcgaaatatacattttatggggctaacacctaaattatcgtgggattatcaaaaatccactagtaatcatgctttttatcgttatgataaaaatagaatttatctcgaaattggaaaaatattt

SEQ ID NO: 500 - protein, 90 aa, Haemophilus influenzae
  Name: NTH0271
LRLGWGQDWSYGISSRLTFSYANRVYREKDLIGIQQKNREYATTITLWHRNIHFMGLTPKLSWDYQKSTSNHAFYRYDKNRIYLEIGKIF

SEQ ID NO: 501 - DNA, 132 bp, Haemophilus influenzae
  Name: NTH0272
atgaaacgtacatttcaaccttctgtattaaaacgtagtcgtactcacggtttccgtgctcgtatggcaactaaaaatggccgtcaagttttagcacgtcgccgtgctaaaggtcgtaaaagtttatctgca

SEQ ID NO: 502 - protein, 44 aa, Haemophilus influenzae
  Name: NTH0272
MKRTFQPSVLKRSRTHGFRARMATKNGRQVLARRRAKGRKSLSA

SEQ ID NO: 503 - DNA, 357 bp, Haemophilus influenzae
  Name: NTH0273
gtggttaagctgaacttttcaagggagttacgtttattaactcccattcaattcaaaaatgttttcgaacagccattcagagctagtactcccgaaattacaatccttgctagaaaaaataatcttgaacatccgcgtttaggtttgaccgttgctaaaaaacatttaaaacgcgcccacgagcgtaatcgaattaaacgcttagtacgagaaagttttcgtttatcacagcatcgcttgcctgcttatgattttgtttttgtagctaaaaatggtattggaaaactcgacaatagcgcatttgcacaaatactcgaaaaattatggcagagacacattcgcttggcacaaaaatct

SEQ ID NO: 504 - protein, 119 aa, Haemophilus influenzae
  Name: NTH0273
VVKLNFSRELRLLTPIQFKNVFEQPFRASTPEITILARKNNLEHPRLGLTVAKKHLKRAHERNRIKRLVRESFRLSQHRLPAYDFVFVAKNGIGKLDNSAFAQILEKLWQRHIRLAQKS

SEQ ID NO: 505 - DNA, 240 bp, Haemophilus influenzae
  n 231, 232, 233, 234, 235: n is any nucleotide
  Name: NTH0274
atgattagtccgtttattggggctcgttgtcggtttgtgcctacttgttcttgctatggtattgaagcattaaaaacacacggattattaaaaggtggttggcttacgctgaaacgtgtattaaaatgccatcctttaaacgcaggtggattcgatcctgttccaccaaaaaccaataataatgatgagataaaaataaggactgggtaccgagtccgaattcgataccannnnnttaat

SEQ ID NO: 506 - protein, 80 aa, Haemophilus influenzae
  Xaa 77, 78, 79: Xaa is any amino acid
  Name: NTH0274
MISPFIGARCRFVPTCSCYGIEALKTHGLLKGGWLTLKRVLKCHPLNAGGFDPVPPKTNNNDEIKIRTGYRVRIRYXXXN

SEQ ID NO: 507 - DNA, 438 bp, Haemophilus influenzae
  Name: NTH0275
atgaacacccaaactttggctacacaatatgaaatggatttttcttataatccactgccttttttcagtgatatagaagataaccttaaattcaacaaaaaattagatttaaatctttactgtatcaaacgtccaaaacaaacttgttttattcatataactaacccaaatatgttggcttggggaattgaaagcggcgatatgttagtcgtcgaaaaaaatgacgatctttattctggtgatcttgttgtgctagaagaaaataacgaatttcatgtctatgaatttatgacgcatagcggcaattacctttttatggcattggattccacaacacaaaatataaatacaaaagattggtcaaatttacctattgtcggcaccgtaaccaatacgattcatcaaatgaaacgtcgcaataaaatgaaatgggcagcg

SEQ ID NO: 508 - protein, 146 aa, Haemophilus influenzae
  Name: NTH0275
MNTQTLATQYEMDFSYNPLPFFSDIEDNLKFNKKLDLNLYCIKRPKQTCFIHITNPNMLAWGIESGDMLVVEKNDDLYSGDLVVLEENNEFHVYEFMTHSGNYLFMALDSTTQNINTKDWSNLPIVGTVTNTIHQMKRRNKMKWAA

SEQ ID NO: 509 - DNA, 654 bp, Haemophilus influenzae
  Name: NTH0277
gtgcctgcagcgggcgagtttttagatatgattacacctcagtatttggcagattttatgagctggggggcgattggggctagaacaacagaatcacaagttcatcgtgagttggcttcaggtttatcttgtgctgttgggtttaaaaatgccactaatggtggtgtgaaagtcgctttagatgcaattggtgcggcggaagctccccactatttcttatctgtcactaaatttggtcattctgcaattgtttctacaaaagggaatgaagattgccatattattttacgaggtggagataaaggtcctaactatagtgctgaagatgtagaaaaagtttgtgctgatattgaaaaaacagggcgtattccacacgttatggttgattttagccatgcaaacagcagtaaacaatataaaaagcaaatggatgtttgccaagacgtatgtaatcagattgcatttggttctaaacaaatctttggcgtaatggtggaaagccatttagtggaaggtcgtcaagatttagttgatggcaaagcgcagacttatggacaaagtattacggatgcgtgcattggatgggaagattctgaaagattattgcaacaactttctgatgcagttattgctagacgtaaagcgacgagtaat

SEQ ID NO: 510 - protein, 218 aa, Haemophilus influenzae
  Name: NTH0277
VPAAGEFLDMITPQYLADFMSWGAIGARTTESQVHRELASGLSCAVGFKNATNGGVKVALDAIGAAEAPHYFLSVTKFGHSAIVSTKGNEDCHIILRGGDKGPNYSAEDVEKVCADIEKTGRIPHVMVDFSHANSSKQYKKQMDVCQDVCNQIAFGSKQIFGVMVESHLVEGRQDLVDGKAQTYGQSITDACIGWEDSERLLQQLSDAVIARRKATSN

SEQ ID NO: 511 - DNA, 246 bp, Haemophilus influenzae
  Name: NTH0278
atgacaccattcaactttggagttgatatgcgcgacgcgccatcaaaagcatcttacacatcaggaatattcgccttcttagttgcacgcattgccgatatgttctcaaatgtaaattgggctgatgtcgcatcgattacaggtattgtgattggtgtcgccacctgtcttgtaaattggtattacaagaacaaagattttgaattaaaagaaaaagaactcaaacaacggatccatcatcatgat

SEQ ID NO: 512 - protein, 82 aa, Haemophilus influenzae
  Name: NTH0278
MTPFNFGVDMRDAPSKASYTSGIFAFLVARIADMFSNVNWADVASITGIVIGVATCLVNWYYKNKDFELKEKELKQRIHHHD

SEQ ID NO: 513 - DNA, 516 bp, Haemophilus influenzae
  Name: NTH0279
atgattaaacgttccgccaaatacatatgcgccatatccgccgttgttggacatgtgattgcctatcatggaaatgaaattcgaacatccgaaaaaggcttgttactgattggcaatgcagaaggttgtatgaaaaagccctatcaatgccctgccgatgttttaacagtcggcataggcataaccgatgccgttgaaaaaattgaccgcaataaaatttacaccttgcaagaaattgccgaattatacgtaaaaggcattaaacaatcagaaaaatgcgttaatcaatatgccaacgggaaaaccatgccacaaggtgcatttgatgccctcgtctccatcacctttaacgtaggatgcggcaaattaaaaaatagctcactttttaaaatggcacgccaaggctacagcaaagccatgtgcggtcaattcgaacgttggatttatgcagcaggaaaaccgctaaaaggattaattgaacgccgtcaaaaggagaaaaacctatgtttaatttct

SEQ ID NO: 514 - protein, 172 aa, Haemophilus influenzae
  Name: NTH0279
MIKRSAKYICAISAVVGHVIAYHGNEIRTSEKGLLLIGNAEGCMKKPYQCPADVLTVGIGITDAVEKIDRNKIYTLQEIAELYVKGIKQSEKCVNQYANGKTMPQGAFDALVSITFNVGCGKLKNSSLFKMARQGYSKAMCGQFERWIYAAGKPLKGLIERRQKEKNLCLIS

SEQ ID NO: 515 - DNA, 348 bp, Haemophilus influenzae
  Name: NTH0280
atgtttaatttcttaaccgccaaagaacgaggcattttccttatcgggccaatactgcttgtactcctcattgtttttctgggatttaaggctaattattggcgaaaagaaatgctcaaagaagaacagctaaaactgaaatggcaaaacgcttacattgagttaaatcatagcgttcaaaattttgccgaacagcaagcacagctaatccaagccgtaaacaacctcaaagcaaaccaaaatcaacaaacacaggatttaaaaaatgtacttaaatcaaaccaagattgggctaaccgccctttgcctgatgatgttaaacgcgtgctcaactcagcaggaagtcat

SEQ ID NO: 516 - protein, 116 aa, Haemophilus influenzae
  Name: NTH0280
MFNFLTAKERGIFLIGPILLVLLIVFLGFKANYWRKEMLKEEQLKLKWQNAYIELNHSVQNFAEQQAQLIQAVNNLKANQNQQTQDLKNVLKSNQDWANRPLPDDVKRVLNSAGSH

SEQ ID NO: 517 - DNA, 213 bp, Haemophilus influenzae
  Name: NTH0282
atgacagatcaattcgaccgagcacaacagcttgaagaaatgcaacgcgaaatcgccctcaaaaaacaccgcacttttaaagcagtaagtcgcctttattgtgaagattgtgatgcccccatcccagaaaagcgcagacaaatgattcaaggcgtaacacgttgcgtgacttgccaacaaagatttgaaatacaacaacggaatttcagaaaa

SEQ ID NO: 518 - protein, 71 aa, Haemophilus influenzae
  Name: NTH0282
MTDQFDRAQQLEEMQREIALKKHRTFKAVSRLYCEDCDAPIPEKRRQMIQGVTRCVTCQQRFEIQQRNFRK

SEQ ID NO: 519 - DNA, 120 bp, Haemophilus influenzae
  Name: NTH0283
atgagaagaaccacacttttccttgctatcgctgccgcattgccttgtttagcaaatacctacaccgtgccatttagagatggtccatttgtaaatattcaaattatcctgacggaagaa

SEQ ID NO: 520 - protein, 40 aa, Haemophilus influenzae
  Name: NTH0283
MRRTTLFLAIAAALPCLANTYTVPFRDGPFVNIQIILTEE

SEQ ID NO: 521 - DNA, 108 bp, Haemophilus influenzae
  Name: NTH0284
ttgatgacggacactggacatttgattgttgccgtagataaagacaaccgaccattaatttgcagagatacgcaaaatgaaaaagcccaaccaactgcgcaaaatcct

SEQ ID NO: 522 - protein, 36 aa, Haemophilus influenzae
  Name: NTH0284
LMTDTGHLIVAVDKDNRPLICRDTQNEKAQPTAQNP

SEQ ID NO: 523 - DNA, 165 bp, Haemophilus influenzae
  Name: NTH0285
atgaaaaagcccaaccaactgcgcaaaatccttgaacaaagccatcccgattttgtaaaaaatcccgaccatctacaactttatgtgggacgggtggcaaaatcgtcgcaacgggagccgcatcatttagttttgaatatcgttaccactcaaggttgtagtgac

SEQ ID NO: 524 - protein, 55 aa, Haemophilus influenzae
  Name: NTH0285
MKKPNQLRKILEQSHPDFVKNPDHLQLYVGRVAKSSQREPHHLVLNIVTTQGCSD

SEQ ID NO: 525 - DNA, 864 bp, Haemophilus influenzae
  Name: NTH0286
atggcaactccagtcgtcgcccttgttggtcgcccgaatgtgggaaaatccacattatttaatcgccttactcgtacgagagatgcgttagtcgctgattttccaggtttaactcgtgatagaaaatatggtcacgcacatattgctggctatgattttattgttattgatactggcggtattgatggaacggaagagggcgtagaagaaaaaatggcggagcaatctttgcttgctattgatgaagccgacattgttcttttccttgtggatgcgcgagcaggtttaacggcagctgatattggtattgctaattatttacgccaacgtcaaaacaaaattactgtggtggtggcaaataaaaccgatggtattgatgcggattctcattgtgctgaattttatcagttaggtttaggagaaattgagcaaattgcagcctcacaaggtcgtggtgttactcaattaatggaacaagtacttgcgccttttgcggaaaaaatggaaaacgccgatgaaaatgaccgcacttctgaggaagaacaagacgaatgggaacaagaattcgattttgattcagaagaagatacggcattaattgatgatgcgttagacgaagaacttgaagaagaacaagataaaaatatcaaaatagccattgtaggtcgtccaaatgtgggtaaatctactttaaccaatcgtattttaggcgaagatcgtgtagtggtttttgatatgccaggtacgacacgtgacagtatttatattccaatggagcgtgatggacagcaatataccttgattgatacggctggtgtgcgtaagcgtggtaaagggcatttggcaggggaaaattctctggga

SEQ ID NO: 526 - protein, 288 aa, Haemophilus influenzae
  Name: NTH0286
MATPVVALVGRPNVGKSTLFNRLTRTRDALVADFPGLTRDRKYGHAHIAGYDFIVIDTGGIDGTEEGVEEKMAEQSLLAIDEADIVLFLVDARAGLTAADIGIANYLRQRQNKITVVVANKTDGIDADSHCAEFYQLGLGEIEQIAASQGRGVTQLMEQVLAPFAEKMENADENDRTSEEEQDEWEQEFDFDSEEDTALIDDALDEELEEEQDKNIKIAIVGRPNVGKSTLTNRILGEDRVVVFDMPGTTRDSIYIPMERDGQQYTLIDTAGVRKRGKGHLAGENSLG

SEQ ID NO: 527 - DNA, 1266 bp, Haemophilus influenzae
  Name: NTH0287
gtgcaaacaacagcgagagaggcggggacgcgtcaccacacagccgcgaaaggaaagacgcggacggcccgaagaaccacatcgggggggaacgaaaaatcaaaacggcgacaggaattgagaccggcgaaaccgcagacaaaacggaggagaaacgggggcgaaaaaaaaaaaaaacgcgcgaaccgcaaacagcatggaccgcaaagggaggacaaacaagatggggtacggacgcgcgcagtcgggagcaaaaaccgaaaccgggcgccgccagcgagaatgggaaaacattcgggggaaatattgaaaaagttggggaggcataatatgcctgaagctgctcaaggcgttcaaacgcaagacgttattaaaatctccgcaacatctggtttaacaccagcaccacaagcgagagatcataaagttgaagtcgcaaaattaattgatgtttcaacttgtataggatgtaaagcctgtcaagtgggttgttcagagtggaatgatattcgctctgatatcaatgcacaatgtgttggggtttatgacaatccagttgatcttgatgcaaaagcatggacggtgatgcgttttaacgaagttgaagaaaacgatcgtttagaatggctgattcgtaaagatggctgtatgcactgcacagaacctggttgtttaaaggcttgtcctgcacccggtgcaatcattcaatatgctaacggtattgtagatttccaatccgataaatgtattggttgtggttattgtattgcaggctgtccattcaatattccacgaatgaatcctgaagacaatcgtgtatacaaatgtactctttgtgtggatcgtgtttctgtgggacaagagccagcttgcgtgaaaacctgtccaacaggtgctattcgtttcggctctaaagaagaaatgaaaatttacgcagaacaacgcgtggcagatttaaaatcccgtggttatgaaaacgcaggactttacgatcctccaggtgtaggcggtacacacgtaatgtatgtgttgcatcacgcagataaacctgagctttacaatggtcttccaaaagatcctcaaattgatttgagtgtgaccttatggaaagatgtattgaaaccagtcgctgcagttgcaatgggtggtctagctctagcagaagttgcgcactacttaaccgttggcccaaatgtagaagaagatgtggaagatcatcatcacgaatttgaagaaaataaaccatccaagggggaaaataatgag

SEQ ID NO: 528 - protein, 422 aa, Haemophilus influenzae
  Name: NTH0287
VQTTAREAGTRHHTAAKGKTRTARRTTSGGNEKSKRRQELRPAKPQTKRRRNGGEKKKKRANRKQHGPQREDKQDGVRTRAVGSKNRNRAPPARMGKHSGEILKKLGRHNMPEAAQGVQTQDVIKISATSGLTPAPQARDHKVEVAKLIDVSTCIGCKACQVGCSEWNDIRSDINAQCVGVYDNPVDLDAKAWTVMRFNEVEENDRLEWLIRKDGCMHCTEPGCLKACPAPGAIIQYANGIVDFQSDKCIGCGYCIAGCPFNIPRMNPEDNRVYKCTLCVDRVSVGQEPACVKTCPTGAIRFGSKEEMKIYAEQRVADLKSRGYENAGLYDPPGVGGTHVMYVLHHADKPELYNGLPKDPQIDLSVTLWKDVLKPVAAVAMGGLALAEVAHYLTVGPNVEEDVEDHHHEFEENKPSKGENNE

SEQ ID NO: 529 - DNA, 159 bp, Haemophilus influenzae
  n 97, 146, 147, 148, 149, 150: n is any nucleotide
  Name: NTH0289
ttgaaattagcaacgatactcgcgttatccgccatagaaccccagcacgtatcagtcactggatgttggttatttgcttttattatgacgatggttncactggtgttgctttttatgggtaccgagtctgatattcgtataccagnnnnnttaattaat

SEQ ID NO: 530 - protein, 53 aa, Haemophilus influenzae
  Xaa 33, 49, 50: Xaa is any amino acid
  Name: NTH0289
LKLATILALSAIEPQHVSVTGCWLFAFIMTMVXLVLLFMGTESDIRIPXXLIN

SEQ ID NO: 531 - DNA, 546 bp, Haemophilus influenzae
  Name: NTH0290
atgctgacaagaattttacttttaatgtcacttgcttggattatgaaacttactgcaccattatttactctgtttaatcaagcaatttctgggcgtgatttgattttattaatcggaggtttattcctgattataaaaagctttggggaaattaaagaggcaataaatcatcaagaacaccataattctgaaagcaaaaacaaagtgagttattttggcgtattaattcaaattgcagtgctagatattgttttttctttagattctgtgattacagcagtaggtatggcaagccaccttcctgtgatgattttggcgattattattgccgttggcgtgatgatgtttgcagcaaaaccaatcggcgctttcgtagatacgcatccaaccttgaaaattctagctttagccttcttggttttagttggaattagtttaattgcagaaagtttagatattcacatcccgaaaggttacatctattttgcaatgggattctctgttgtggtcgaaatgatcaatattcgaatgagaagattgataaaa

SEQ ID NO: 532 - protein, 182 aa, Haemophilus influenzae
  Name: NTH0290
MLTRILLLMSLAWIMKLTAPLFTLFNQAISGRDLILLIGGLFLIIKSFGEIKEAINHQEHHNSESKNKVSYFGVLIQIAVLDIVFSLDSVITAVGMASHLPVMILAIIIAVGVMMFAAKPIGAFVDTHPTLKILALAFLVLVGISLIAESLDIHIPKGYIYFAMGFSVVVEMINIRMRRLIK

SEQ ID NO: 533 - DNA, 327 bp, Haemophilus influenzae
  Name: NTH0291
atgacagaacaatttgcagatcgtatttacttcgcacatttacgttctactcaacgtgaagataatccactaaccttccatgaagcagctcatctagaaggagacgtagatatgtttaatgtggtaaaagccttattaaatgaagaatatcgtcgattaaatcaaggagaaacgcgtttaatcccaatgcgcccagatcatgggcatcaaatgttggatgacttacgtaaaaaaaccaaccctggctactctgccattggtcggttaaaaggtctagctgaatttcgcggtttagagatggcactaaaaaaagtgtatttcaataag

SEQ ID NO: 534 - protein, 109 aa, Haemophilus influenzae
  Name: NTH0291
MTEQFADRIYFAHLRSTQREDNPLTFHEAAHLEGDVDMFNVVKALLNEEYRRLNQGETRLIPMRPDHGHQMLDDLRKKTNPGYSAIGRLKGLAEFRGLEMALKKVYFNK

SEQ ID NO: 535 - DNA, 138 bp, Haemophilus influenzae
  n 9, 46, 81: n is any nucleotide
  Name: NTH0292
atgatcctnccacgcccaatcttaggcttaccgcgcatagtttcanctattgaagatatgcaatggttggtagaaactcancccattaccagcaaatggttttacaatgtgtacgggttcttatggcgtacgctccga

SEQ ID NO: 536 - protein, 46 aa, Haemophilus influenzae
  Xaa 16, 27: Xaa is any amino acid
  Name: NTH0292
MILPRPILGLPRIVSXIEDMQWLVETXPITSKWFYNVYGFLWRTLR

SEQ ID NO: 537 - DNA, 513 bp, Haemophilus influenzae
  Name: NTH0294
atgaatctattttggaaattcactggcacagcaatcgtatttgaaagccaagaagatgcggttgcaggcattttaggtggcaaagtcaaagaaggtcatgttgttgttatccgttacgaagggcctaaaggcggaccaggtatgcaagaaatgttatacccaaccagttacttaaaatcgatgggcttgggcaaaaaatgcgctttattaacggatggtcgcttctctggcggtacatcaggcttgtctattggacatgcttcaccagaagctgcttctggcggtgcaatcggcttagtacgcgatggcgatattatcaacattgatattccaaatcgtgcaattaacttagaaatcagtaatgatgaactcgcagcacgcagagccgaacaagatcaaaaaggttggcagccagctaaccgtgaacgtgaagtatctttcgctttaaaagtattcggtcactttgcgacctcagcggacaaaggtgcggtacgcgataaaacattattaaaa

SEQ ID NO: 538 - protein, 171 aa, Haemophilus influenzae
  Name: NTH0294
MNLFWKFTGTAIVFESQEDAVAGILGGKVKEGHVVVIRYEGPKGGPGMQEMLYPTSYLKSMGLGKKCALLTDGRFSGGTSGLSIGHASPEAASGGAIGLVRDGDIINIDIPNRAINLEISNDELAARRAEQDQKGWQPANREREVSFALKVFGHFATSADKGAVRDKTLLK

SEQ ID NO: 539 - DNA, 924 bp, Haemophilus influenzae
  Name: NTH0295
atgaaaaatctactcaccaatcctcaaccctctcaatcagattatatcaatgccattgttaaacttggttcgcgcgtatatgaagctgcacaagtgacccctttacaaaaaatgggaaaactttctgaacgactgcacaataatatctggattaaacgagaagaccgtcagccagtaaatagctttaaactacgcggtgcttacgcaatgatttctagcctttcagaggaacaaaaagcagcaggcgtaatagcggcatctgcaggtaaccatgcacaaggcgtggcattatcagcgaaacaattaggcttaaaagcattaattgttatgccacaaaacaccccaagcattaaagtggatgcagtgcgtggttttggtggtgaggtgttgttgcacggtgctaatttcgatgaagccaaagcaaaagccatcgagctttcaaaagaaaaaaatatgacatttattccaccattcgatcatccattggtaatcgctggacaaggcacgttagcgatggaaatgctacaacaagtggcagatttggattatgtgtttgtacaagtcggtggtggtggcttagctgcgggtgtggcaattttgcttaagcaatttatgccagaaattaaaatcatcggtgtagaatcaaaggattctgcatgcttaaaagccgctctcgataaaggcgaaccaacagatttaacccatgttggattatttgccgatggcgttgccgtaaaacgcattggcgacgaaacattccgcctatgccaacaatatcttgatgatatggtattggtcgatagtgacgaagtatgcgcagcaatgaaagatttgtttgagaacgttcgtgctgttgcagaaccatcaggtgcattaggtttggctggtttgaaaaaatatgcgaaacaaaaccaggggattccc

SEQ ID NO: 540 - protein, 308 aa, Haemophilus influenzae
  Name: NTH0295
MKNLLTNPQPSQSDYINAIVKLGSRVYEAAQVTPLQKMGKLSERLHNNIWIKREDRQPVNSFKLRGAYAMISSLSEEQKAAGVIAASAGNHAQGVALSAKQLGLKALIVMPQNTPSIKVDAVRGFGGEVLLHGANFDEAKAKAIELSKEKNMTFIPPFDHPLVIAGQGTLAMEMLQQVADLDYVFVQVGGGGLAAGVAILLKQFMPEIKIIGVESKDSACLKAALDKGEPTDLTHVGLFADGVAVKRIGDETFRLCQQYLDDMVLVDSDEVCAAMKDLFENVRAVAEPSGALGLAGLKKYAKQNQGIP

SEQ ID NO: 541 - DNA, 717 bp, Haemophilus influenzae
  Name: NTH0296
ttgccattattgaccgcacttgagattgaagaagtgattaaagtatggcaggaacaacttcgtgaacttggtgcgaaataccaatgggtgcaaatttttgaaaacaaaggggctgcaatggggtgttctaaccctcatccgcatggtcaaatttgggcaaatagtttcttgccaaatgaagttgctcgtgaagatcgtacacaacgtgattatttgctaaaacatggctcagtaatgttggttgattatgtaaaacgagaattggcgttgaaagaacgtattgtcgttgaaactgaacattgggtcgctttagtaccttattgggctatttggccatttgaaacattgcttctaccaaaaactcatgtaaaacgtttaactgaattaagtgacgaacaatcaaaagatcttgcggttattttgaaaaaattgacgaccaaatacgacaatctctttgaaacctctttcccatattcaatgggatttcatgcggcaccgtttaatggcgaagataacgaacattggcagctacatgctcatttttaccctcctcttttgcgttcagcaactgtgcgtaaatttatggtggggtatgaaatgttaggcgaaaaccaacgcgatttaacggcagaacaggcagcggagcgattacgtgctttgagtgaagttcattataaagaaagaactacctatcttgtccggtcccctttttacctt

SEQ ID NO: 542 - protein, 239 aa, Haemophilus influenzae
  Name: NTH0296
LPLLTALEIEEVIKVWQEQLRELGAKYQWVQIFENKGAAMGCSNPHPHGQIWANSFLPNEVAREDRTQRDYLLKHGSVMLVDYVKRELALKERIVVETEHWVALVPYWAIWPFETLLLPKTHVKRLTELSDEQSKDLAVILKKLTTKYDNLFETSFPYSMGFHAAPFNGEDNEHWQLHAHFYPPLLRSATVRKFMVGYEMLGENQRDLTAEQAAERLRALSEVHYKERTTYLVRSPFYL

SEQ ID NO: 543 - DNA, 90 bp, Haemophilus influenzae
  Name: NTH0297
atgaaacgcttaaacgatgatgagattttggagttaaaaattgtacttttgattgcggcagtttgggtaatgtttaatatggtgtttggc

SEQ ID NO: 544 - protein, 30 aa, Haemophilus influenzae
  Name: NTH0297
MKRLNDDEILELKIVLLIAAVWVMFNMVFG

SEQ ID NO: 545 - DNA, 219 bp, Haemophilus influenzae
  Name: NTH0298
atggcgaaagagtataaatgcaaagtttgtggcaaagcgtttgtaaaaacctttagctcaacacaaaaagtttgctcgcctgaatgtgcgattaaattagtccgagaacaatcaagaaaaaggcaaaagaaagcggaaaaacaagaacagatagagcgtaaaaaaagattactagatggtgagagggcattggctaaaagctcttcaaaaagaggtaaa

SEQ ID NO: 546 - protein, 73 aa, Haemophilus influenzae
  Name: NTH0298
MAKEYKCKVCGKAFVKTFSSTQKVCSPECAIKLVREQSRKRQKKAEKQEQIERKKRLLDGERALAKSSSKRGK

SEQ ID NO: 547 - DNA, 387 bp, Haemophilus influenzae
  Name: NTH0299
atggtgagagggcattggctaaaagctcttcaaaaagaggtaaataaatttataagattgagagataaaggacaaccttgtattgcttgtggaacggtatggaaacctagttttcaagcgtctcattttattccgcagggaagaagctcatttttaagatttgatgagaggaatatccattctggctgtatcagatgcaatcttttcgtaggtggcggaaatatacatggatatagaccaagactagtcgagaagattggcgagcaagaggttgagtggttggaagaaaatcaacatcgaattaaaaaatgggaaatttctgagcttaaagaaatgctaaaactatacagattgaagaacaaggaattagaaaatgaaatgcaagat

SEQ ID NO: 548 - protein, 129 aa, Haemophilus influenzae
  Name: NTH0299
MVRGHWLKALQKEVNKFIRLRDKGQPCIACGTVWKPSFQASHFIPQGRSSFLRFDERNIHSGCIRCNLFVGGGNIHGYRPRLVEKIGEQEVEWLEENQHRIKKWEISELKEMLKLYRLKNKELENEMQD

SEQ ID NO: 549 - DNA, 663 bp, Haemophilus influenzae
  n 125: n is any nucleotide
  Name: NTH0300
atgaaatgcaagattgatggttgcaacagagaggctatgtataaagctgattgcgtttgccaaatgcactattttagatttatgagaaacggaacttatgatcttcttccgaaaccaatccgaanatacagaagacacaatggaaagggttatcagttaattttcgaaccaagacaccaattagcaatgagcgatgggtatgtttatgagcatagatttgtgatttatagcatttatcaaaataatttacctaactgcaagctttgtggctgcaagctaacttggagcagttgtcacatcgatcatattgataatgacattaccaacaacacgctagaaaaccttagaccaatttgccgagcttgtaacgtaatgagaagtcacacattaatacctaaatatacacacaaaggtcattctaaaataacttttaatggattaacaatgacagcagctgagtgggctagacaagatggcgtaacagtagctgggaatacaatcttgagaagaattagagatgggtggagcatagaaagagcattatttgagacaagttcaacacatccaaatgcagcagttaagcacactactactaagtataaaaatagatttgaagtgaaatctactggaataagcttagatttaagattgcaaggcgatgat

SEQ ID NO: 550 - protein, 221 aa, Haemophilus influenzae
  Xaa 42: Xaa is any amino acid
  Name: NTH0300
MKCKIDGCNREAMYKADCVCQMHYFRFMRNGTYDLLPKPIRXYRRHNGKGYQLIFEPRHQLAMSDGYVYEHRFVIYSIYQNNLPNCKLCGCKLTWSSCHIDHIDNDITNNTLENLRPICRACNVMRSHTLIPKYTHKGHSKITFNGLTMTAAEWARQDGVTVAGNTILRRIRDGWSIERALFETSSTHPNAAVKHTTTKYKNRFEVKSTGISLDLRLQGDD

SEQ ID NO: 551 - DNA, 222 bp, Haemophilus influenzae
  Name: NTH0301
gtgaatattgatgtgatttcagttgaatttggttattgggctacacctcgttatgagactgaatttccacgtgtagccgcagggtttgcagagatgaaatgtgatgctcgttatgctgaaaaatatcgtatgcgtcctataagcgatgaattaggcatggaaattgatggctaccttggtgtaattagaaaagtccccccagaccttatgatgtattcgttc

SEQ ID NO: 552 - protein, 74 aa, Haemophilus influenzae
  Name: NTH0301
VNIDVISVEFGYWATPRYETEFPRVAAGFAEMKCDARYAEKYRMRPISDELGMEIDGYLGVIRKVPPDLMMYSF

SEQ ID NO: 553 - DNA, 522 bp, Haemophilus influenzae
  Name: NTH0302
ttggttggtaagcaacaaaacaccgcccaaaaagcagaaattctaatccgctctttagccaaagtgggcattgtggcattagtggatgaagtcaccggctatcaagatgcacgagccaaagacgcactcgcaaaaatttttgaagcctttgtcgcaaaagaattacaaccttgggttaaaacctttcctttagactattacaaggaattatgtcgtttatatggcgttcaattccctccgaaaaataataatcaatttccacaattcttcgggcatattacaaacaacgccgtgtatgcccgactcgctccagagttattaccagaactcaaaaaatcggcaagtaaacaagcaaaaaaagtaaaattacaccagtttttaacggaagacgtagggcaccctaaattgcgtgaacatttatcttctatcgttacacttttaaagctatctaaagataaagataatttttatgaaatgttagataagatacaccccaaactcacacttcaggaaggacaagaa

SEQ ID NO: 554 - protein, 174 aa, Haemophilus influenzae
  Name: NTH0302
LVGKQQNTAQKAEILIRSLAKVGIVALVDEVTGYQDARAKDALAKIFEAFVAKELQPWVKTFPLDYYKELCRLYGVQFPPKNNNQFPQFFGHITNNAVYARLAPELLPELKKSASKQAKKVKLHQFLTEDVGHPKLREHLSSIVTLLKLSKDKDNFYEMLDKIHPKLTLQEGQE

SEQ ID NO: 555 - DNA, 849 bp, Haemophilus influenzae
  n 836, 837, 838, 839, 840: n is any nucleotide
  Name: NTH0303
atgggaattaaaatgaccgattttagattaaacaaacatccctattccgttatgcttgggctaacggcaggtgttgcttatgcagctcaaccaaccaaccaaccaaccaaccaaccaaccaaccaaccaaccaaccaaaatggtaatgtttctgaacaactagagcaaattaatgtatctggttctaccgaagatagtgatacaaaaacaccaccaaaaattgctgaaacggtaaaaacggccaaaacgccccccccagaacaagcaaacaatattaaagacatcgccaaataccatacgggtgttattgtccctgaagctgggctttttcgtccaaccgctcccccattcgtgttgtccataacacccccccatttattactaccgcccgcttacgttcacatctttccttttcttcgccgcgctttcatcatttttctccggcatttttacataagtagtcccttcccgcttccctcctctcctcttcctccttatttttattatgatgtttataagaatctcctctcttacctattccagcctcgttgttctactcgccttctgctaaccctttctcccttttccatcctctctaccccgccccccctttctcttttttttccccctttcttttttccccccacccctcacttttccccgctttattttttacacaccccccgacacaacattcatctccctttgtatccgctcatctttccccccccccccccaccatcctccgcactctatctttccattctatacccccccttcccttttcccccccccccccctttccgactgcaattttttttcttctccccctccgnnnnnttaattaat

SEQ ID NO: 556 - protein, 283 aa, Haemophilus influenzae
  Xaa 279, 280: Xaa is any amino acid
  Name: NTH0303
MGIKMTDFRLNKHPYSVMLGLTAGVAYAAQPTNQPTNQPTNQPTNQNGNVSEQLEQINVSGSTEDSDTKTPPKIAETVKTAKTPPPEQANNIKDIAKYHTGVIVPEAGLFRPTAPPFVLSITPPHLLLPPAYVHIFPFLRRAFIIFLRHFYISSPFPLPSSPLPPYFYYDVYKNLLSYLFQPRCSTRLLLTLSPFSILSTPPPLSLFFPPFFFPPTPHFSPLYFLHTPRHNIHLPLYPLIFPPPPPPSSALYLSILYPPFPFPPPPPFRLQFFFFSPSXXLIN

SEQ ID NO: 557 - DNA, 204 bp, Haemophilus influenzae
  Name: NTH0304
atggctgctaaaatccgtcaaaatgatgaagtaattgttcttactggtaaagataagggcaagcgtggcaaggtaactaaagtgttaccaaacggtaaagtgtttgttgaaggtatcaacatcattactaagcatgaaaaaccagttcctgcattaggaaaggctggtggtttggtgaaaaaagaagctgcaattgacgcttca

SEQ ID NO: 558 - protein, 68 aa, Haemophilus influenzae
  Name: NTH0304
MAAKIRQNDEVIVLTGKDKGKRGKVTKVLPNGKVFVEGINIITKHEKPVPALGKAGGLVKKEAAIDAS

SEQ ID NO: 559 - DNA, 369 bp, Haemophilus influenzae
  Name: NTH0305
atgatccaagaacagactatgctggatgttgctgataattcaggcgctcgcagcgtaatgtgtatcaaggttctaggtggatcgcaccgtcgttatgctgcgattggtgacatcatcaaaattactgtaaaagaagcaattccacgcggtaaagtaaaaaaaggtgatgtattaaaagcagttgttgtgcgcaccaagaagggtgttcgtcgcccagatggctcagttattcgtttcgatggtaacgcttgtgtaattttaaataataacactgagcaaccaatcggtactcgtatttttggaccagtgactcgtgaacttcgttctgagaaattcatgaagatcatttctttagctccagaagtactg

SEQ ID NO: 560 - protein, 123 aa, Haemophilus influenzae
  Name: NTH0305
MIQEQTMLDVADNSGARSVMCIKVLGGSHRRYAAIGDIIKITVKEAIPRGKVKKGDVLKAVVVRTKKGVRRPDGSVIRFDGNACVILNNNTEQPIGTRIFGPVTRELRSEKFMKIISLAPEVL

SEQ ID NO: 561 - DNA, 198 bp, Haemophilus influenzae
  Name: NTH0306
gtggagcaagatctcctctattttaataaagtagataaattttcagcctttaaaaggaaagatttaaaaaattacagaaaatttaaagagattttgatagattttcaaagattttataaattagaaagatttaacttaaaagagctcgatctgtatctttggcttttaggcaaggaaattttcccaaaatctgaaaac

SEQ ID NO: 562 - protein, 66 aa, Haemophilus influenzae
  Name: NTH0306
VEQDLLYFNKVDKFSAFKRKDLKNYRKFKEILIDFQRFYKLERFNLKELDLYLWLLGKEIFPKSEN

SEQ ID NO: 563 - DNA, 390 bp, Haemophilus influenzae
  n 385, 386, 387, 388, 389: n is any nucleotide
  Name: NTH0307
ttgccggaatcaaccattatggctatcactgtagtcattcatcctcaagataaattacaggcgcatttagacaaattaagtagtcgagctgtcggtaataactatgagtctatctatttaaaacaagatgccctcacagtaacggaatatttaaaagacggacacaagctttatcaagctggcatggttttctatgtaagagggaaagacgatcaagagctacgcattcgctcaagagaattaagaacggttttactcagtaataatttagtgccggtaaaagaaggcaacgaagttgcgcctcttaatagctatttacgctggctaccgatgaattttaatcctcaattagatgcaaaatcctcgtttttataccaaatattannnnnt

SEQ ID NO: 564 - protein, 130 aa, Haemophilus influenzae
  Xaa 129, 130: Xaa is any amino acid
  Name: NTH0307
LPESTIMAITVVIHPQDKLQAHLDKLSSRAVGNNYESIYLKQDALTVTEYLKDGHKLYQAGMVFYVRGKDDQELRIRSRELRTVLLSNNLVPVKEGNEVAPLNSYLRWLPMNFNPQLDAKSSFLYQILXX

SEQ ID NO: 565 - DNA, 1056 bp, Haemophilus influenzae
  Name: NTH0308
atggctttattccaagacgtgttagaggctttcttccctgctaaaaaaggtgataagcctcaacctaaaaaggaacctatcctaacatccattgcaccggaagaagcacagcaggatgataccaataacgtagaagagacgattgaaatcactcctgttatgcgtaatagaaaaatgaccagagagcaacatgttaaaatgctttatgggcgcgatccctcttttatctccaatcttccttatgcggaatatttggaagaagaaggcgtaatgctttttgatgatgctaaaagtgcaggtgcggtatttgatattaagcctataggaactgagggaagaagcagcgactatcttaatcgcgttcgcacattggttaaagatgccttacaggatagtttcgatgaacttgataccaacccttacgttgtacaattctattgccaggatgacaaggatttaagcggttatgttgagaatctgagacagtacattaaaaccacttcacctgaagcgagcggtagtgagtttacagaacagtggcttggtgaaatggagcgtcacttaaaagcagtaggtaaaccaggtgggctttttgttgatgaccgggtaacaaatacggcatgggctggaaaagtgcgtaaaacacgcatggttatttatcgttatgctggaaataatgagacagatacaatcgagaaattaaatacagcttgtgatcgtgttcaaagtgcttttatcacagctggattaaccatggaacgccaaaatgaaacacaaattcatcgttggttattagaatggtttaatccaaatccatcacgctattttaacggactcgatgataaagcttgctatgatcttttatcactctctaaggatgaatctgctctaccattacaagaccaagattttagtgaaaatctcttttttacgccaccggaaagtaaaaatggctattggtattttaatgagcaacctcacgaagtcattgtagttgataatattcgtaagcagccggatgttggccacatgacatggcgaagtcactcgaggtcg

SEQ ID NO: 566 - protein, 352 aa, Haemophilus influenzae
  Name: NTH0308
MALFQDVLEAFFPAKKGDKPQPKKEPILTSIAPEEAQQDDTNNVEETIEITPVMRNRKMTREQHVKMLYGRDPSFISNLPYAEYLEEEGVMLFDDAKSAGAVFDIKPIGTEGRSSDYLNRVRTLVKDALQDSFDELDTNPYVVQFYCQDDKDLSGYVENLRQYIKTTSPEASGSEFTEQWLGEMERHLKAVGKPGGLFVDDRVTNTAWAGKVRKTRMVIYRYAGNNETDTIEKLNTACDRVQSAFITAGLTMERQNETQIHRWLLEWFNPNPSRYFNGLDDKACYDLLSLSKDESALPLQDQDFSENLFFTPPESKNGYWYFNEQPHEVIVVDNIRKQPDVGHMTWRSHSRS

SEQ ID NO: 567 - DNA, 246 bp, Haemophilus influenzae
  Name: NTH0309
atgaaatttgttgatgatggcgaagtggatgataaaatcgtttgtgttcctgcagatgatcgtgatacaggaaatgcctacaattcattagcagatttaccggcaaacttaattaaacaaattgagttccatttcaataactataaagcgcttaagaaacctggctcaacgaaagtgacccattggggcgatgtagaagaagcgaaagaagtgattcgtgagtctattaaacgttggaatgagcgt

SEQ ID NO: 568 - protein, 82 aa, Haemophilus influenzae
  Name: NTH0309
MKFVDDGEVDDKIVCVPADDRDTGNAYNSLADLPANLIKQIEFHFNNYKALKKPGSTKVTHWGDVEEAKEVIRESIKRWNER

SEQ ID NO: 569 - DNA, 123 bp, Haemophilus influenzae
  Name: NTH0310
atgagtttcagagatttagataataaaaaaacacctttcggtgcttactttatttttaaagtggtgggtcgtgaaggattcgaaccttcgaccaacggattaaaagtccgctgctctaccgac

SEQ ID NO: 570 - protein, 41 aa, Haemophilus influenzae
  Name: NTH0310
MSFRDLDNKKTPFGAYFIFKVVGREGFEPSTNGLKVRCSTD

SEQ ID NO: 571 - DNA, 555 bp, Haemophilus influenzae
  Name: NTH0311
atgaaattcaatatcccaattttcctaacgatctttcgagtcattttgattccttttttcgtgattgcattttatttacccattgaatcatctcctttcatcacaacactgattttttttattgcaggtgtcactgactggctagatggctatctagctcgtaaatggaaacagaccacgcgctttggtgcatttcttgatcctgttgctgataaagtaatggtagtggctgcactagttttaattgtcgaacatcaacatacattttggataaccattcctgccattattatgatttctcgtgaaattatcatctccgcattacgtgaatggatggcagagcttggggaacgtagcaaagtcgcagtctcttggtggggaaaatggaaaaccacagcgcaaatgttagcactaggcggattattatggcgttataacaactatatggaaatagcagcaattatcttactttatatcgccgctattttaactatatggtcaatgatccaatatttacaagtagcaaaaggaagcttgctagataatattcaatta

SEQ ID NO: 572 - protein, 185 aa, Haemophilus influenzae
  Name: NTH0311
MKFNIPIFLTIFRVILIPFFVIAFYLPIESSPFITTLIFFIAGVTDWLDGYLARKWKQTTRFGAFLDPVADKVMVVAALVLIVEHQHTFWITIPAIIMISREIIISALREWMAELGERSKVAVSWWGKWKTTAQMLALGGLLWRYNNYMEIAAIILLYIAAILTIWSMIQYLQVAKGSLLDNIQL

SEQ ID NO: 573 - DNA, 141 bp, Haemophilus influenzae
  Name: NTH0312
atgttacgtatggttgatgcattacaatcccatgaagatcacggtgaagtttgccctgctcaatgggaaaaaggtaaagaagggatgaaagataaccctgaaggtgttgcaaaatacttaaaacaaaacgctgataaactt

SEQ ID NO: 574 - protein, 47 aa, Haemophilus influenzae
  Name: NTH0312
MLRMVDALQSHEDHGEVCPAQWEKGKEGMKDNPEGVAKYLKQNADKL

SEQ ID NO: 575 - DNA, 156 bp, Haemophilus influenzae
  Name: NTH0313
atgcatcaaccatacgtaacatttcatcgatattacgacctaatggaagatcgtttactacttggtgacgaacacgccatttttgtcgataagaatggaacgcgaatgcaacgcctgctttggttgttcaataccgatgctggagcaattccggtt

SEQ ID NO: 576 - protein, 52 aa, Haemophilus influenzae
  Name: NTH0313
MHQPYVTFHRYYDLMEDRLLLGDEHAIFVDKNGTRMQRLLWLFNTDAGAIPV

SEQ ID NO: 577 - DNA, 822 bp, Haemophilus influenzae
  Name: NTH0314
atggcaaaagcacgtaaagtgactgttgttgaaggtttagcgacttttaccgattctcacacattagttgcgcgtgatcgcgatggaaacccaacgactgttaaattcgacaatgccattattgcggcaggttctcgtccagttcaattaccctttatcccacacgaagatcctcgtatttgggattcaacagatgcacttaaattaaaagaagtaccgaaaaaactacttattatgggcggtggtatcatcggtttagaaatgggtactgtatacaatgctttaggttctgaagttgaagttgttgaaatgttcgaccaagtgattcccgcagcagataaagatgttgttggtatttacactaaacaagttgagaaaaaattcaagttaatgcttgaaaccaaagtgactgcagttgaagcaaaagatgatggtatctacgtttcaatggaaggcaaagcctgtaatgacaccaaacgttatgatgcagtacttgtcgctatcggtcgtgtgccaaatggtaaattgattgatgcaggtaaagcaggcgttgaagtagatgatcgtggttttattcacgttgataaacaaatgcgtaccaacgtgccacatatctacgcaattggggatattgtaggtcagccaatgttagcacataaaggtgttcacgaaggtcacgttgccgcagaagtcattgcaggacaaaaacactacttcgatcctaaagtaattccatcaatcgcttataccgaaccagaagtggcgtgggtaggtaaaactgagaaagaatgtaaacaagaaggcttaaactacgaagtggct

SEQ ID NO: 578 - protein, 274 aa, Haemophilus influenzae
  Name: NTH0314
MAKARKVTVVEGLATFTDSHTLVARDRDGNPTTVKFDNAIIAAGSRPVQLPFIPHEDPRIWDSTDALKLKEVPKKLLIMGGGIIGLEMGTVYNALGSEVEVVEMFDQVIPAADKDVVGIYTKQVEKKFKLMLETKVTAVEAKDDGIYVSMEGKACNDTKRYDAVLVAIGRVPNGKLIDAGKAGVEVDDRGFIHVDKQMRTNVPHIYAIGDIVGQPMLAHKGVHEGHVAAEVIAGQKHYFDPKVIPSIAYTEPEVAWVGKTEKECKQEGLNYEVA

SEQ ID NO: 579 - DNA, 114 bp, Haemophilus influenzae
  Name: NTH0315
atgacgaagttaatctttgataaagatacgcatcgtatactgggcggtgcaatcgtaggttctaatgtggggaattataaggcgaaaatgggtaaccgagcttcgatattcgta

SEQ ID NO: 580 - protein, 38 aa, Haemophilus influenzae
  Name: NTH0315
MTKLIFDKDTHRILGGAIVGSNVGNYKAKMGNRASIFV

SEQ ID NO: 581 - DNA, 996 bp, Haemophilus influenzae
  Name: NTH0316
atgaaacctagtcaaaaacaaactcaaagacaaccgcacttttccaaagattcagcaaagaaacgtgatttttcagctaaaaatgacagacgttcagtatctcgtactgctcgcatagaaacagcaaatacgaaaaaaagtgcggttaattctgacaacaaatttttatctaagccaaaagcgaaacctgttgtaagagcctcgaatcaaccgaaagcagagggcgaaaaattacagaaagttttagcgcgtgctggacaaggctctcgtcgtgaaattgaaacgatgattgccgcaggcagagtgagcgtagagggtaaaattgcgactttaggcgatcgtattgacgtacattctggcgtgaaagtgcgtattgatggtcaaatcattaatcttagccacgcacaaaaagaaatttgccgtgtattaatgtattacaaacctgaaggcgaactctgtacacgtagcgacccagaagggcgtgcgaccgtgtttgatcgtttgccgcgtttaacgggatctcgttggattgcggtggggcgtttagatattaatacatcaggtttattgctttttaccactgatggcgaattagcaaatcgtttaatgcacccaagccgtgaagttgaacgtgaatattctgtgcgtgtatttggtcaagttgatgatgcgatgttagcgcgtttacgtaaaggcgttcagcttgaagatggtcctgctaattttaaagaaattaaatttacaggcggtgtgggtattaaccaatggtatgacgtaaccttgatggaaggacgtaaccgtgaggttcgtcgtttgtgggaatctcaagggattcaagttagccgcttgattcgtattcgttatggaaatatcaaactgatgaaaggtttgcctcgtgggggctgggaagaaatggatcttgaaaacgtcaattatttacgtgaattggtgggattacctgctgagactgaaacgaaattagatgttaaacaggtt

SEQ ID NO: 582 - protein, 332 aa, Haemophilus influenzae
  Name: NTH0316
MKPSQKQTQRQPHFSKDSAKKRDFSAKNDRRSVSRTARIETANTKKSAVNSDNKFLSKPKAKPVVRASNQPKAEGEKLQKVLARAGQGSRREIETMIAAGRVSVEGKIATLGDRIDVHSGVKVRIDGQIINLSHAQKEICRVLMYYKPEGELCTRSDPEGRATVFDRLPRLTGSRWIAVGRLDINTSGLLLFTTDGELANRLMHPSREVEREYSVRVFGQVDDAMLARLRKGVQLEDGPANFKEIKFTGGVGINQWYDVTLMEGRNREVRRLWESQGIQVSRLIRIRYGNIKLMKGLPRGGWEEMDLENVNYLRELVGLPAETETKLDVKQV

SEQ ID NO: 583 - DNA, 228 bp, Haemophilus influenzae
  Name: NTH0317
ttgctttcagccttaggcgagccgattttatcttgttcgttaatgttgccgaatgaagaacatactacgcaatccgatcctgaagaaattcgtgatcgtttggaacatcaagtggatttaattattcatggtggatatttagggcaagagcctacaacagtggtagatttaacggaagaatcgccagtgattttacgcgaaggaagtggaagtactgctccttttatt

SEQ ID NO: 584 - protein, 76 aa, Haemophilus influenzae
  Name: NTH0317
LLSALGEPILSCSLMLPNEEHTTQSDPEEIRDRLEHQVDLIIHGGYLGQEPTTVVDLTEESPVILREGSGSTAPFI

SEQ ID NO: 585 - DNA, 1074 bp, Haemophilus influenzae
  n 64, 1065, 1066, 1067, 1068, 1069: n is any nucleotide
  Name: NTH0318
gtgctctctaaaggattagcagaaaacgttgtaaaacgtattacaaatcaaccagcagaagtcnccgaatacaaagacgttcgtgaaaaagaaacggcgcccttgccttattcactttctgcgttacaaattgatgcagcaaagcgattcggtatgtccgctcaagccgtattagatgcatgccaacgcctgtatgaaactcatcgtttaattacttatccgcgttctgattgtcgctatttacccgaagaacattttgccgaacgccacaatgtattaaatgcaatttcaacccattgtgaagcttatcaacgcttaccaaatgtcatttcaactgaacagagaaatcgctgttggaatgataaaaaagtagaggctcaccacgcaatcattcctactgccaaaaatcgtccagtaaatctaacacaagaagaacgtaatatttacagccttatcgctcgccaatatttaatgcaattttgtcctgacgcagaatatcgtaaaagtaaaatcacattaaatatcgctggcggtacttttatagcccaagcgcgaaatttacaaacggctgggtggaaagaattgttaggcaaagaagacgacacagaaaatcaagaacccttattaccaatagtaaagaaaggtcaaattttgcattgtgaacgaggagaagtgatgagtaaaaaaactcagccgccaaagcctttcaccgatgcaaccttgctttcagcaatgacgggcattgcgcgatttgtgcaggataaagaactcaaaaaaatcctgcgagaaaccgatggattgggtacagaggctactcgtgctggcatcattgaattactttttaaacgcagttttttaactaaaaaagggcgaaatattcacagtacagaaactggaagaattttaattcaggcattaccagatattgccacccaaccagatatgacggctcattgggaatcgcaactcacagacattagtcaaaaacaagcaacctatcaacaatttatgcataacttgaatcaaatgttacctgatttagtccgttttgtagattctaaatgnnnnnttaat

SEQ ID NO: 586 - protein, 358 aa, Haemophilus influenzae
  Xaa 22, 355, 356, 357: Xaa is any amino acid
  Name: NTH0318
VLSKGLAENVVKRITNQPAEVXEYKDVREKETAPLPYSLSALQIDAAKRFGMSAQAVLDACQRLYETHRLITYPRSDCRYLPEEHFAERHNVLNAISTHCEAYQRLPNVISTEQRNRCWNDKKVEAHHAIIPTAKNRPVNLTQEERNIYSLIARQYLMQFCPDAEYRKSKITLNIAGGTFIAQARNLQTAGWKELLGKEDDTENQEPLLPIVKKGQILHCERGEVMSKKTQPPKPFTDATLLSAMTGIARFVQDKELKKILRETDGLGTEATRAGIIELLFKRSFLTKKGRNIHSTETGRILIQALPDIATQPDMTAHWESQLTDISQKQATYQQFMHNLNQMLPDLVRFVDSKXXXN

SEQ ID NO: 587 - DNA, 117 bp, Haemophilus influenzae
  Name: NTH0319
ttgaaagtgcggttgatttttctggagtttttcttctttgctctctgggataacccaagcctgtactttaaagaggcctttggcctggaaagctcaaattctaaatctgacggacat

SEQ ID NO: 588 - protein, 39 aa, Haemophilus influenzae
  Name: NTH0319
LKVRLIFLEFFFFALWDNPSLYFKEAFGLESSNSKSDGH

SEQ ID NO: 589 - DNA, 1233 bp, Haemophilus influenzae
  n 80: n is any nucleotide
  Name: NTH0320
atgagcgatccagtaattctgccactcggtattgccgcattcacggttattgtattagtgttagtggcaatcatcttatntgcgaaatcaaaattagtcgattctggtgatattactatcgacatcaatgacgatcctgaaaaagcgatcacattacctgcaggtggcaaattattaggggctttagcaagtaaaggtattttcgtgtcttctgcttgcggtggcggtggctcttgtggtcaatgtattgttaaagtgaaaaatggcggtggagaaattcttccaaccgaactttctcacattaacaaacgtgaagcaaaagaaggttatcgtctagcttgtcaagttaatgtaaaaggtaatatggaagttgaacttccagaagaaatcttcggcgtgaaaaaatgggaatgtactgttatttctaacgataacaaagcaacttttattaaagaacttaaattagcgatccctgaaggcgaggaagtgcctttccgcgcaggtggttatatccaaatcgaagctgagccacatgtggtgaactataaagatttcgatattcctgaagaataccacgaagactgggataaatacgatttatggcgttatgtctctaaagtggacgagcatattatccgtgcttactcaatggcttcataccctgaagagaaaggtatcattatgcttaacgttcgtattgcgactccaccaccacgccaacctgatgcgcctccaggtcaaatgtcttcttacatttggtcattaaaagcaggagataaagtcacaatttctggtccatttggtgaattcttcgcgaaagaaactaatgcagaaatggtatttatcggtggtggtgcgggtatggctccaatgcgttcacatatcttcgaccaattaaaacgtttacattctaaacgtaaaatgtcgttctggtatggtgcacgttctaaacgtgaaatattctatcaagaagactttgaccaattacaagctgaaaatccaaactttgtatggcacgtggcactttcagatgcattgcctgaagataattggactggctatacaggctttattcacaatgtactttatgaaaactacttgaaaaatcatgaagcaccagaagactgtgaatactatatgtgtgggcctccagtgatgaatgcagctgtaattaaaatgttgaaagatcttggtgttgaagatgaaaacattttattagatgactttggtggc

SEQ ID NO: 590 - protein, 411 aa, Haemophilus influenzae
  Xaa 27: Xaa is any amino acid
  Name: NTH0320
MSDPVILPLGIAAFTVIVLVLVAIILXAKSKLVDSGDITIDINDDPEKAITLPAGGKLLGALASKGIFVSSACGGGGSCGQCIVKVKNGGGEILPTELSHINKREAKEGYRLACQVNVKGNMEVELPEEIFGVKKWECTVISNDNKATFIKELKLAIPEGEEVPFRAGGYIQIEAEPHVVNYKDFDIPEEYHEDWDKYDLWRYVSKVDEHIIRAYSMASYPEEKGIIMLNVRIATPPPRQPDAPPGQMSSYIWSLKAGDKVTISGPFGEFFAKETNAEMVFIGGGAGMAPMRSHIFDQLKRLHSKRKMSFWYGARSKREIFYQEDFDQLQAENPNFVWHVALSDALPEDNWTGYTGFIHNVLYENYLKNHEAPEDCEYYMCGPPVMNAAVIKMLKDLGVEDENILLDDFGG

SEQ ID NO: 591 - DNA, 573 bp, Haemophilus influenzae
  n 568, 569, 570, 571, 572: n is any nucleotide
  Name: NTH0321
atgaggttttttatggctggaattaataaagtcattattgtaggtcatttaggtaatgatcctgaaattcgtactatgccaaacggcgatgccgttgcaaatatcagcgtagcaaccagtgaaagctggaacgaccgtaatactggcgaacgccgtgaagtaacagaatggcaccgcattgtattctatcgtcgtcaagcagagatttgcggcgaatatttacgtaaaggttctcaagtatatgtggagggtcgtttaaaaacgcgtaaatggcaagatcaaaacggtcaagatcgttacgccacagaaattcaaggcgatgtaatgcaaatgcttggtggacgtaatcaaaacgcaagtggttctggtaatgatatgggcggttcgccacaatcttcttaccaagctcgtcaaactaacaatggtaatagttatcaatcatctcgcccagctccacaacaatctgcacctcaggctgaaccaccaatggatggatttgatgactatattccgacctatatgtttatattgccccccacctgccttttttcttccatttttttttttnnnnnt

SEQ ID NO: 592 - protein, 191 aa, Haemophilus influenzae
  Xaa 190, 191: Xaa is any amino acid
  Name: NTH0321
MRFFMAGINKVIIVGHLGNDPEIRTMPNGDAVANISVATSESWNDRNTGERREVTEWHRIVFYRRQAEICGEYLRKGSQVYVEGRLKTRKWQDQNGQDRYATEIQGDVMQMLGGRNQNASGSGNDMGGSPQSSYQARQTNNGNSYQSSRPAPQQSAPQAEPPMDGFDDYIPTYMFILPPTCLFSSIFFFXX

SEQ ID NO: 593 - DNA, 423 bp, Haemophilus influenzae
  Name: NTH0323
ttgagttattttatggaaaatatcgatattcgcggggctagaacccataatctgaaaaatattaatttaactattccacgcaataaacttgtggtgattactgggctttcaggttcgggaaaatcctctttagcctttgatacactttatgcggaagggcaacgccgctatgttgaatctctttcggcgtatgcgcgtcaatttttgtctttaatggaaaagcctgatgtggattctattgaagggctttcccctgcaatttccattgaacaaaaatctacctcacacaatccacgttctacagtgggaacaattacggaaatttacgattatttacgtttattgtttgcacgagtaggggagccgcgttgtcccgatcataatgttccattaacggcacaaacaattagtcaaatggtggga

SEQ ID NO: 594 - protein, 141 aa, Haemophilus influenzae
  Name: NTH0323
LSYFMENIDIRGARTHNLKNINLTIPRNKLVVITGLSGSGKSSLAFDTLYAEGQRRYVESLSAYARQFLSLMEKPDVDSIEGLSPAISIEQKSTSHNPRSTVGTITEIYDYLRLLFARVGEPRCPDHNVPLTAQTISQMVG

SEQ ID NO: 595 - DNA, 957 bp, Haemophilus influenzae
  Name: NTH0324
ttggctgatcagtttcaagtgcggtttagaattgatggtgttttacaaccacaacccttaataagcaaaatattcgccaatcgtattatttcacgcttaaaattactggctaaattagatattagtgaaaatcgacttccacaagatggacgatttcaatttaaaaccactttttccgatattcttgattttcgcctttcaaccttaccaacccattggggcgaaaaaatcgtgttgcgagcgcaacaaaataaacctgtagaacttagctttgctgaactgggtatgaccgaaaatcagcaacaagcatttcaacgctcacttagccagccacaaggattaattttagtaaccggccccacaggaagtgggaaaagtatctcgctttacaccgcacttcagtggctaaatacgcctgataaacatattatgaccgctgaagatcccattgaaattgaacttgatggtattattcaaagccaaattaatccgcagattggattagattttagccgtctattgcgtgcttttttacgtcaagatcccgacatcattatgctaggtgaaattcgagatgaagaaagtgcaaggattgcactacgtgccgctcaaacgggacatttggtgctttcaactttacataccaatgatgcaatatctgccatttctcgcttacaacaactcggtattcaacaacatgaaattgaaaacagtttactactcgtcattgcacagcgtcttgtacgaaaaatctgtccaaagtgcggtggaaatttaataaattcttgtgattgccatcaaggttatcgagggcgaatcggcgtgtatcaatttctacattggcaacagaatggctatcaaacggattttgagaatttacgagagagtggtttggaaaaagttagccaaggcataacagatgagaaagaaattgaacgtgtgttaggtaaaaactca

SEQ ID NO: 596 - protein, 319 aa, Haemophilus influenzae
  Name: NTH0324
LADQFQVRFRIDGVLQPQPLISKIFANRIISRLKLLAKLDISENRLPQDGRFQFKTTFSDILDFRLSTLPTHWGEKIVLRAQQNKPVELSFAELGMTENQQQAFQRSLSQPQGLILVTGPTGSGKSISLYTALQWLNTPDKHIMTAEDPIEIELDGIIQSQINPQIGLDFSRLLRAFLRQDPDIIMLGEIRDEESARIALRAAQTGHLVLSTLHTNDAISAISRLQQLGIQQHEIENSLLLVIAQRLVRKICPKCGGNLINSCDCHQGYRGRIGVYQFLHWQQNGYQTDFENLRESGLEKVSQGITDEKEIERVLGKNS

SEQ ID NO: 597 - DNA, 600 bp, Haemophilus influenzae
  Name: NTH0325
atgactaaaaaactcttttattatcaaggtagtaacgcattaaatcagaaacaaaaaggctcaattattgcggatacgaaacaacaagcgcactttcagttaataagccgcgggcttactcacatcaaattacaacaaaactggcaatttggggcaaaacccaaaaattcagaaatcagtgaattactcaatcaattagcgacattgctacagtccgtaattccgttaaaaaacagcctacaaattttgcaacaaaattgtactcaaattatgctcaacaaatggcttgaacgactgcttcaatccattgaatctggcttagcattctcacaagccattgaacaacaaggaaaatatctcacacaacaagaaattcaactgattcaagtgggagaaatgacaggaaaacttgccgtagtttgtaaaaaaatagccacgcaccgtagtcaatctttggctttatcacgcacatacagaaaattatgttatatccctcaatggtattggggaatttctctattattgacactcgcattactgctttttatcgcgcctcaatttgctgaatgtacagtggtcataatgcggagttaccaacaa

SEQ ID NO: 598 - protein, 200 aa, Haemophilus influenzae
  Name: NTH0325
MTKKLFYYQGSNALNQKQKGSIIADTKQQAHFQLISRGLTHIKLQQNWQFGAKPKNSEISELLNQLATLLQSVIPLKNSLQILQQNCTQIMLNKWLERLLQSIESGLAFSQAIEQQGKYLTQQEIQLIQVGEMTGKLAVVCKKIATHRSQSLALSRTYRKLCYIPQWYWGISLLLTLALLLFIAPQFAECTVVIMRSYQQ

SEQ ID NO: 599 - DNA, 1158 bp, Haemophilus influenzae
  n 1145: n is any nucleotide
  Name: NTH0326
atgttttcacgcaaagatattattattttaggaatgatgatcttcgccttatttttaggtgcgggtaatatcatttttccgcctatggaaggattttcctcaggacaacattggacgagtgcttccttaggctttgttttaactggcgttttaatgccatttattacgcttgttgtggtagcgattttaggtcgtggcgaagaacttactaaagatttaccaaaatgggctggcacaggtttcctcgttatactttatttaaccattggctctacctttgcaatgccccgcatcactaatgttgcttatgaaatggcgtggttgcctttaggcttaacagaaaataatgcgaatgttcgttttgtattctcactaatttttaacttaatcgcgatgggctttatgattagcccaaatacgatcatttcaagcgtgggtaaatttatgacaccagctttattagtgttacttattgctgtggcaattaccgtatttatttcgcctttatctgaaattcaagcaccaagtaatgcttatgaaaatagccattctttattaatcggcttaaccagtggttatcaaaccatggatgtacttgcagccatcgctttcggtggaattgtcgcccgagcattatcagcgaaaaatgtgacaaaaaccaaagatattgtgaaatacaccatttcagccggatttgtttctgtcattttactcgccagtttatatttttcgcttttctatctaggtgcaactagtgctgcagttgcagaaggggcaacgaatggtggacaaattttctctcgttatgtaaatgtcttattcggttcagctgggacttggattatggcgggtattattgtattagcgagcttaacaacacttgttggtgtaactagcgcatctgctgattatttttcaaaattctctgtgcgtttttcttatccattctgggccgcactttttaccgcaatgacaatcactgtttcacaatatggtttaacggatctacttcgcataacgatcccagctttgttattaatttacccagtagctattgtgcttgttttattgcaattcttacgaaaaaaacttccatcaataaaatttacatacaatagtacattgctcgttacggttggtttaanttatgtgacagct

SEQ ID NO: 600 - protein, 386 aa, Haemophilus influenzae
  Xaa 382: Xaa is any amino acid
  Name: NTH0326
MFSRKDIIILGMMIFALFLGAGNIIFPPMEGFSSGQHWTSASLGFVLTGVLMPFITLVVVAILGRGEELTKDLPKWAGTGFLVILYLTIGSTFAMPRITNVAYEMAWLPLGLTENNANVRFVFSLIFNLIAMGFMISPNTIISSVGKFMTPALLVLLIAVAITVFISPLSEIQAPSNAYENSHSLLIGLTSGYQTMDVLAAIAFGGIVARALSAKNVTKTKDIVKYTISAGFVSVILLASLYFSLFYLGATSAAVAEGATNGGQIFSRYVNVLFGSAGTWIMAGIIVLASLTTLVGVTSASADYFSKFSVRFSYPFWAALFTAMTITVSQYGLTDLLRITIPALLLIYPVAIVLVLLQFLRKKLPSIKFTYNSTLLVTVGLXYVTA

SEQ ID NO: 601 - DNA, 96 bp, Haemophilus influenzae
  n 91, 92, 93, 94, 95: n is any nucleotide
  Name: NTH0327
ttgcccgaaaatcgccttagggggaaaatagggcagggtgaaaatttaccgctttttaaaaaaattattacaggccttacctattttttannnnnt

SEQ ID NO: 602 - protein, 32 aa, Haemophilus influenzae
  Xaa 31, 32: Xaa is any amino acid
  Name: NTH0327
LPENRLRGKIGQGENLPLFKKIITGLTYFLXX

SEQ ID NO: 603 - DNA, 156 bp, Haemophilus influenzae
  n 143, 144, 145, 146, 147: n is any nucleotide
  Name: NTH0328
atgactatggtattagtaacccgtcaagcaccagattttacttcatctgctgtattaagcaatggcgaaatcgttgataacttcaactttaaaaaacacattgctggaaaagctgcagtaatctttttctacccattagactnnnnnttaattaat

SEQ ID NO: 604 - protein, 52 aa, Haemophilus influenzae
  Xaa 48, 49: Xaa is any amino acid
  Name: NTH0328
MTMVLVTRQAPDFTSSAVLSNGEIVDNFNFKKHIAGKAAVIFFYPLDXXLIN

SEQ ID NO: 605 - DNA, 1185 bp, Haemophilus influenzae
  Name: NTH0329
atgcaacaacacaatctctcaacaacatttgtccatgcagggcgtcaaaaacgtttttcacaaggatcggtaaaccctgttttacagcgagcttcttcattactatttgacagtattgaagataaaaaacacgctactcaacgtagagcaaaaggcgaattattttatggcagaagagggacgctaacacattttgctttacaagatttaatgtgcgaaatggaggggggggcaggttgttatctttatccttgtggtacagcagcagtaactaattcgattctttcttttgttaaaactggcgaccatgtgttaatgagtggtgcagcttacgagccaacccaatatttctgtaatattgtgctgaaaaaaatgcagatcgatataacttattacgatcctcttattggtgcggatattgcaacgcttattcaaccgaatacaaaagtacttttcttagaagcaccgagttctattacaatggaaattcccgatattccgactattgtgaaggctgcaagaaaggtgaaccctaatattgtgattatgattgataatacttggtcggcaggtgttctatttaaagcgttagagcatgatattgatatttctattcaggcgggtacgaaatatttagtgggtcattcagatattatgattggtactgccgttgcgaatgcgcgaacttgggatcaacttagagaacattcctatttaatggggcaaatggttgatgcagattctgcttatacgactgctcgtggtatccgtacattgggggtacgattaaaacaacatcaggaaagcagtattaaagtggcaaaatggttgagtgagcaaccagaagtaaaaactgtgtaccatccagctttaccaagttgccctggtcatgaattctttttacgtgattttagtggaagcagtggtttattttcttttgaattaacccagcgattaacttcagagcaagtatcaaaatttatggatcattttcaactgttcgctatggcttattcatggggaggatttgagtctctaattctttgtaatcaaccagaagaaattgcacatattcgtccaaatattaaacgtaatcttacaggttcattaattcgtgtgcatattggttttgaaaatgtggatgaactaattgcagatttgaaagctggttttgagcgaattgct

SEQ ID NO: 606 - protein, 395 aa, Haemophilus influenzae
  Name: NTH0329
MQQHNLSTTFVHAGRQKRFSQGSVNPVLQRASSLLFDSIEDKKHATQRRAKGELFYGRRGTLTHFALQDLMCEMEGGAGCYLYPCGTAAVTNSILSFVKTGDHVLMSGAAYEPTQYFCNIVLKKMQIDITYYDPLIGADIATLIQPNTKVLFLEAPSSITMEIPDIPTIVKAARKVNPNIVIMIDNTWSAGVLFKALEHDIDISIQAGTKYLVGHSDIMIGTAVANARTWDQLREHSYLMGQMVDADSAYTTARGIRTLGVRLKQHQESSIKVAKWLSEQPEVKTVYHPALPSCPGHEFFLRDFSGSSGLFSFELTQRLTSEQVSKFMDHFQLFAMAYSWGGFESLILCNQPEEIAHIRPNIKRNLTGSLIRVHIGFENVDELIADLKAGFERIA

SEQ ID NO: 607 - DNA, 327 bp, Haemophilus influenzae
  Name: NTH0330
ttgctgcctgcggtcgactctaggagaccccagttccgtgattttgcaggttttcgcaccctagattccgttatccgcgccgataaaattttccaagtgaaaacatttacgattgtcagtcaaaaatttcattgcgaacgcgcgctattaattgcccaagcacataatattgatgccatttgctttgtggcaaaacagccagaattacatttttccacacaaataagagaagtttttgcccgcataaaagcggtttttgacttgatattaggtgttgagccttattttttaggggaacctcagccattgccaaacagcaccacatta

SEQ ID NO: 608 - protein, 109 aa, Haemophilus influenzae
  Name: NTH0330
LLPAVDSRRPQFRDFAGFRTLDSVIRADKIFQVKTFTIVSQKFHCERALLIAQAHNIDAICFVAKQPELHFSTQIREVFARIKAVFDLILGVEPYFLGEPQPLPNSTTL

SEQ ID NO: 609 - DNA, 123 bp, Haemophilus influenzae
  Name: NTH0331
ttgctgaattttgggctgtggtggaataaaatgtaccatcaaagcaaagggctgatatttaaaatcagcccttattttttggaatattatttccaagaatatttcacacccacggtgccttgg

SEQ ID NO: 610 - protein, 41 aa, Haemophilus influenzae
  Name: NTH0331
LLNFGLWWNKMYHQSKGLIFKISPYFLEYYFQEYFTPTVPW

SEQ ID NO: 611 - DNA, 288 bp, Haemophilus influenzae
  Name: NTH0333
atgattgccgtgtgtgggatgctcaaagacaaagatgcaaatggggtatttgagcatttaacacctattattgatgaatggcattgtgtaactttaggcggctatcgcgggcagtcaggcgatgaattagcagagaaattgaaaagtcatttcccaaatattcaagctacatcagataattctgttatggatggtgtgtgtacagcactcaaaagtgcggtaaaaaatgatgtggttttagtctttggatctttccacaccgttgctgaattttgggctgtggtggaa

SEQ ID NO: 612 - protein, 96 aa, Haemophilus influenzae
  Name: NTH0333
MIAVCGMLKDKDANGVFEHLTPIIDEWHCVTLGGYRGQSGDELAEKLKSHFPNIQATSDNSVMDGVCTALKSAVKNDVVLVFGSFHTVAEFWAVVE

SEQ ID NO: 613 - DNA, 123 bp, Haemophilus influenzae
  n 110, 111, 112, 113, 114: n is any nucleotide
  Name: NTH0334
ttgagcatcccacacacggcaatcattttaccctcgatgctacgtttaagtgcggtcatttttcagataaatatttgcaggggtaccgagtctgatattcgtataccagnnnnnttaattaat

SEQ ID NO: 614 - protein, 41 aa, Haemophilus influenzae
  Xaa 37, 38: Xaa is any amino acid
  Name: NTH0334
LSIPHTAIILPSMLRLSAVIFQINICRGTESDIRIPXXLIN

SEQ ID NO: 615 - DNA, 108 bp, Haemophilus influenzae
  Name: NTH0335
ttggcaccccaaggcgaggaatggaacccatcctttgatggtgggatccaacactttgatacacatcttggtaaatccgctttatgtggtggcttcttatcccaaggg

SEQ ID NO: 616 - protein, 36 aa, Haemophilus influenzae
  Name: NTH0335
LAPQGEEWNPSFDGGIQHFDTHLGKSALCGGFLSQG

SEQ ID NO: 617 - DNA, 399 bp, Haemophilus influenzae
  Name: NTH0336
ttggggtgccaaatatggtcgctcgtattcggggcagatatcaatttgagttcaattgcaggtacttatccttatgcgggcagtaatgtatatggtggaactaaagcttttgtcacacaatttagcttaaatttacgagccgatctggcaggcacaaaaattcgagtaagcaatgttgaaccgggtttatgtggcggtacggagttctctaatgtgcgttttcacggcgatgatgaaagagccgcaaaagtctatgaaaacgtgcaatcggttcagcctgaagatattgcgaacattgtattatggcttcatcaacaacctgaacacgtaaacattaatcgtattgaagtaatgccaaccgctcaatcttttgcaggaatgagcgtttcaaaagaaaaa

SEQ ID NO: 618 - protein, 133 aa, Haemophilus influenzae
  Name: NTH0336
LGCQIWSLVFGADINLSSIAGTYPYAGSNVYGGTKAFVTQFSLNLRADLAGTKIRVSNVEPGLCGGTEFSNVRFHGDDERAAKVYENVQSVQPEDIANIVLWLHQQPEHVNINRIEVMPTAQSFAGMSVSKEK

SEQ ID NO: 619 - DNA, 1173 bp, Haemophilus influenzae
  n 826, 1160, 1161, 1162, 1163, 1164: n is any nucleotide
  Name: NTH0337
atgtcagacacacttcttaacccttattttggcgaatttggcggaatgtatgtacccgaaattttagtgcctgttttgaagcaattagaacaagcctttgtggaggctcaaaatgatcctacattccaagcagaatttgctgatttactcaaaaattatgcgggcagaccgaccgcacttactctttgtcgtaacttaaccaaatgcacaaaaactaaactttatcttaaacgtgaagatttattacacggtggtgcacacaaaacaaaccaagtgttagggcaaattttattggctaaacgtatgggcaaaacgcgtattattgccgaaacaggtgcagggcaacacggcgtggcaaccgccctagcttgtgctatgttagatatgccgtgtcgtgtttatatgggtgcaaaagatgttgagcgtcaatcaccaaacgtgttccgtatgcgtttaatgggggctgaagtaattcctgtagaaaaaggctcttgttctttaaaagatgcctgttgtgaagcgatgcgtgattggtcagcaaactatgaaaccacccattatttacttggaacggcggcaggccctcaccccttcccgacgattgtgagagaatttcaaaaaatgattggcgaagaaaccaaacgtcaaattctagaacgagaaggtcgtttacctgatgctgtgattgctgcggttggcggtggttctaacgcaattggtatgtttactgattttattgatgaaccaaatgtgcgtttaattggtgttgaacctgcagggaaaggcattgaaagcggtgaacatggcgcaccattaggtcatgcanaagtgggcatttatttcgggatgaaatcccctttaatgcaaaccgaaaatggtcaagtagaggaatcttactctgtttcacctgggctatactccccttttttctggcccgcacatgcttatttatttcagattgggccggcctgttatgcatccattacccgtgttttacccctttattccctcccagcacgcgtattattccacgcttttttccctccccttaaagttccccatcccttccctcacctttttctattcccattcccccccctgttacacattccctttctttcccacccctttttttcccttccccttttcctccttcccannnnnttaattaat

SEQ ID NO: 620 - protein, 391 aa, Haemophilus influenzae
  Xaa 276, 387, 388: Xaa is any amino acid
  Name: NTH0337
MSDTLLNPYFGEFGGMYVPEILVPVLKQLEQAFVEAQNDPTFQAEFADLLKNYAGRPTALTLCRNLTKCTKTKLYLKREDLLHGGAHKTNQVLGQILLAKRMGKTRIIAETGAGQHGVATALACAMLDMPCRVYMGAKDVERQSPNVFRMRLMGAEVIPVEKGSCSLKDACCEAMRDWSANYETTHYLLGTAAGPHPFPTIVREFQKMIGEETKRQILEREGRLPDAVIAAVGGGSNAIGMFTDFIDEPNVRLIGVEPAGKGIESGEHGAPLGHAXVGIYFGMKSPLMQTENGQVEESYSVSPGLYSPFFWPAHAYLFQIGPACYASITRVLPLYSLPARVLFHAFFPPLKVPHPFPHLFLFPFPPLLHIPFLSHPFFSLPLFLLPXXLIN

SEQ ID NO: 621 - DNA, 213 bp, Haemophilus influenzae
  n 200, 201, 202, 203, 204: n is any nucleotide
  Name: NTH0338
atgattatcaaagatccaaactctgatcgtgtaaatcaagaagatgataaccttgtttatcttcacgacttaacttcaacagtctttgatttagccaatcaaaaagtgccagaaagttttgaagggcagagcatcttccgattatgcgccaacaccaagataaccaacgaaaagggtaccgagtcgatatcgtatacagnnnnnttaattaat

SEQ ID NO: 622 - protein, 71 aa, Haemophilus influenzae
  Xaa 67, 68: Xaa is any amino acid
  Name: NTH0338
MIIKDPNSDRVNQEDDNLVYLHDLTSTVFDLANQKVPESFEGQSIFRLCANTKITNEKGTESISYTXXLIN

SEQ ID NO: 623 - DNA, 222 bp, Haemophilus influenzae
  n 55: n is any nucleotide
  Name: NTH0339
ttgctaaacaccaaagcagaaattttaggattgccgttgttatcggaagaggatntaagtcagattgaatcgcttaatctgctgacaccaggggattttgctgcagtggctcgtcgtcaccaattttccccttttcacaaggtgcaagattggctgatggcactacaaggggaatgtgaagtgaaaccagcgttttctgcaacgacaaggcggatagggttc

SEQ ID NO: 624 - protein, 74 aa, Haemophilus influenzae
  Xaa 19: Xaa is any amino acid
  Name: NTH0339
LLNTKAEILGLPLLSEEDXSQIESLNLLTPGDFAAVARRHQFSPFHKVQDWLMALQGECEVKPAFSATTRRIGF

SEQ ID NO: 625 - DNA, 453 bp, Haemophilus influenzae
  n 436, 447: n is any nucleotide
  Name: NTH0340
gtggcttgtaacgacaatattcatcgtattagtgaagggttaaaacggtcgaaaaaagggcgaatttgttgctatggcccgccgggaacaggaaaaactgcttgggcagcgtggcttgcggaacagttggacatgccgctattgctaagacaaggctcagatttacttaatccttatgtgggcgggacagaacaaaatattgctcaagcctttgaacaagcgaaagccgataatgcaatattggtgctagatgaagtagatacgttcttattttctagagaaggcgcaaatcgaagctgggagcgttcgcaagtgaatgaaatgctaacacaaattgaacgctttgagggcctgatggtggtatcaacaaatttaattgaggttcttgatcacgcagctttacgccgttttgatttaaaattgaagtttgattatntaacgctcaancacgca

SEQ ID NO: 626 - protein, 151 aa, Haemophilus influenzae
  Xaa 146, 149: Xaa is any amino acid
  Name: NTH0340
VACNDNIHRISEGLKRSKKGRICCYGPPGTGKTAWAAWLAEQLDMPLLLRQGSDLLNPYVGGTEQNIAQAFEQAKADNAILVLDEVDTFLFSREGANRSWERSQVNEMLTQIERFEGLMVVSTNLIEVLDHAALRRFDLKLKFDYXTLXHA

SEQ ID NO: 627 - DNA, 867 bp, Haemophilus influenzae
  n 119, 157, 172: n is any nucleotide
  Name: NTH0341
gtgagaggggggcgaaccttggatttgaggatttgggacgcaccccttaaagggaagcgtcctattaaaatcttgtcggaaatggctccagtgccaggtctgcacgtggatgattttgnccatatgcccggcatgaaagagatgatgttacttattntgcaccaagccctanaacatcatcgaaaaggcgtgaatcttttaatttatggcgtgcctggcactggtaaaacagaattcgccgggttgcttgcacaggcgttggggatttcggcgtataacattacttacatggattctgacggagatgttgtggaggcagagcaacgcctgaactacagtcgtcttgctcaaacgctattgaacggcaagcaggcgcttttaatttttgatgaaattgaagatgtgtttaacggctcgtttatggagcgttctgttgcacaaaaaaataaagcgtggacaaatcagttattggaaaacaataacgtgccgatgatttggttatctaactctgtttcgggcatagatcctgcttttttacgccgctttgattttattttagaaatgccagatttgccgttgaaaaataagtcagcactgattacgcaactgactgagggaaaattaagtccggcctatgtgcagcattttgctaaagtgcggtcattaacgccggcgattttaagccgcacaattcgggtggcaaaggaactcaatacatcaaattttgctgagactttgctcatgatgtttaatcaaacgttaaaatcgcaaaataaaccgaaaattgaaccgcttgttttaggcaaagccgactacaactggattatgtggcttgtaacgacaatattcatcgtattagtgaagggt

SEQ ID NO: 628 - protein, 289 aa, Haemophilus influenzae
  Xaa 40, 53, 58: Xaa is any amino acid
  Name: NTH0341
VRGGRTLDLRIWDAPLKGKRPIKILSEMAPVPGLHVDDFXHMPGMKEMMLLIXHQALXHHRKGVNLLIYGVPGTGKTEFAGLLAQALGISAYNITYMDSDGDVVEAEQRLNYSRLAQTLLNGKQALLIFDEIEDVFNGSFMERSVAQKNKAWTNQLLENNNVPMIWLSNSVSGIDPAFLRRFDFILEMPDLPLKNKSALITQLTEGKLSPAYVQHFAKVRSLTPAILSRTIRVAKELNTSNFAETLLMMFNQTLKSQNKPKIEPLVLGKADYNWIMWLVTTIFIVLVKG

SEQ ID NO: 629 - DNA, 441 bp, Haemophilus influenzae
  Name: NTH0342
atggcattcagcctaaacgcttttgcacaaactaatttagcggatgtgcaactcaaagatttaaacaatcagccagttactttaagccaatataaaggcaaacctgtgtatgtcaaaatgtgggcatcttggtgtccgatttgcttggctggattagctgaaattgatgatttaagtgcggaaaaagatcgcaattttgaagtgattaccattgtttcgcccgatcacaaaggcgaaaaagacaccgctgattttattgaatggtacaaaggattggaatataaaaatatcacggtgcttttagatgaaaaaggcgaaatcattgacaaagcaagagtgcgtggctatccgttcaatctctttttagatagcgatttaaacctgaaaaaaaccgtaccagggcatttaggtgcagagcaaataaaagtttttgcagggaaa

SEQ ID NO: 630 - protein, 147 aa, Haemophilus influenzae
  Name: NTH0342
MAFSLNAFAQTNLADVQLKDLNNQPVTLSQYKGKPVYVKMWASWCPICLAGLAEIDDLSAEKDRNFEVITIVSPDHKGEKDTADFIEWYKGLEYKNITVLLDEKGEIIDKARVRGYPFNLFLDSDLNLKKTVPGHLGAEQIKVFAGK

SEQ ID NO: 631 - DNA, 189 bp, Haemophilus influenzae
  Name: NTH0343
gtggtgtggaatttgttgaacccgccgcatgattgggaagaagaaattggtgtactgattgatcctgaagaatacgctgaagtgtgggtgggcttagtcaataaacaagatgaaatggatgatgtctttgctaaattcttaatttctcaccgagaagaagatcgcgaatttcacgttatttggaaaaag

SEQ ID NO: 632 - protein, 63 aa, Haemophilus influenzae
  Name: NTH0343
VVWNLLNPPHDWEEEIGVLIDPEEYAEVWVGLVNKQDEMDDVFAKFLISHREEDREFHVIWKK

SEQ ID NO: 633 - DNA, 162 bp, Haemophilus influenzae
  Name: NTH0344
atggcaacagaaattaaaaagcttgatcccgatacagccattgatattgcttccgatattttcttagaaatggctggagaaaatttagatcctgcctatattcttttattcaacctacaatttgaagaacgcggtggtgtggaatttgttgaacccgccgca

SEQ ID NO: 634 - protein, 54 aa, Haemophilus influenzae
  Name: NTH0344
MATEIKKLDPDTAIDIASDIFLEMAGENLDPAYILLFNLQFEERGGVEFVEPAA

SEQ ID NO: 635 - DNA, 840 bp, Haemophilus influenzae
  Name: NTH0345
gtgtttcgggaaaagtctatatttgcacagcatttagatcgtatattagagcgagaaattgaatttttaggttttagtcaatattcaacaaaattgcttgcagatgagctaggtaaatataactttgctgaaagtggcaccttgattttatgtcaatataatttcttagcgacagattatttgtttattgcattgcttgatagccgtcatagtatgttagtcgatgagcatttagatattcgccgtacagaatatttggatattactcagtttgatattgcggcacggataaatttgacggatttgcaagtaaacgcgaactctaatcgttatttaacctttataaaaggccgtgttggtcgcaaaattagtgatttttttatggattttttaggtgccgaagaaggattaaatccacaagttcaaaatcaatgtttattgcaagctgtgagtgattactgcgatcaaggcgaactcaacaaagagcaaactcaagcggtaaaaaaacaagtgtttgaatattgtaaaggtcagctttcaaatggtaacaatattgaattaagggaactttctgattcattacccactctaaacgaacagccttttgtcgtctttacggaagaacagaattatggtttggaagagagtattccaccaatacgttcaacattgaaatcgctaacaaaattctctgggtcaggaaagggcgttaccctaagttttgatgcggaattattgaatacacgtattcaatgggatcctatgacagataccctaaccatcaaaggcttaccaccaaatttaaaagatcaattacaaaaggctttacaatcagagaat

SEQ ID NO: 636 - protein, 280 aa, Haemophilus influenzae
  Name: NTH0345
VFREKSIFAQHLDRILEREIEFLGFSQYSTKLLADELGKYNFAESGTLILCQYNFLATDYLFIALLDSRHSMLVDEHLDIRRTEYLDITQFDIAARINLTDLQVNANSNRYLTFIKGRVGRKISDFFMDFLGAEEGLNPQVQNQCLLQAVSDYCDQGELNKEQTQAVKKQVFEYCKGQLSNGNNIELRELSDSLPTLNEQPFVVFTEEQNYGLEESIPPIRSTLKSLTKFSGSGKGVTLSFDAELLNTRIQWDPMTDTLTIKGLPPNLKDQLQKALQSEN

SEQ ID NO: 637 - DNA, 138 bp, Haemophilus influenzae
  n 125, 126, 127, 128, 129: n is any nucleotide
  Name: NTH0346
atgcaagttaaaacacttttaggcgcaacctttttagcattaagcctcgcttcttgttccaccgttgaaaagttgtatatcgaattgatgtaccgcaaggcactatttaaggcgactccgttggnnnnnttaattaat

SEQ ID NO: 638 - protein, 46 aa, Haemophilus influenzae
  Xaa 42, 43: Xaa is any amino acid
  Name: NTH0346
MQVKTLLGATFLALSLASCSTVEKLYIELMYRKALFKATPLXXLIN

SEQ ID NO: 639 - DNA, 819 bp, Haemophilus influenzae
  Name: NTH0347
ttgttggcaaatggcgtattcttaggcattacggcaattttcgggcaagaagctatgactgaatgggcgtggcggataccgtttttatcttccgttatcttagtggcaattggcttatatgttcgcctaaaactgactgaagccccgattttccttgcggcactcaataaaccgcagccaaaacgcttaccaatgttggaagttgtcactacttatttcaagccgtttttcttggggatgttaatttgtattgcaggctatgtgctgttctacattatgattgcctttagccaaatttacgccaaatctgccccaacggtttcagaggcaggatacgcaatgggattaggactttccccgcaaatttttaccgctttattgatggcaagtgcggtttctttggctattaccatcgccgtttcgggcaaatatatcgacaaaattggtcgccgtatttggctcatttggacaaccgttggcgttgcgatttttggtttatccttgccgttatttctcgaaaacggtacaactaccagtctgttttggtttttattcatcggtatggggttaattggaatgggctatggaccattagcgagttttttacctgaactcttccctactcacgcccgctattcaggtgcttctttaacctataatattgcaggtttattcggggcaagtgttgcagcaatcattgccttaccgctgaatgctcactacggcttaaaaggtgtggggatttatttaaccctaaacgctgtgttgagcttggttggattatggtttatttcagaaacgaaagataaattactatcc

SEQ ID NO: 640 - protein, 273 aa, Haemophilus influenzae
  Name: NTH0347
LLANGVFLGITAIFGQEAMTEWAWRIPFLSSVILVAIGLYVRLKLTEAPIFLAALNKPQPKRLPMLEVVTTYFKPFFLGMLICIAGYVLFYIMIAFSQIYAKSAPTVSEAGYAMGLGLSPQIFTALLMASAVSLAITIAVSGKYIDKIGRRIWLIWTTVGVAIFGLSLPLFLENGTTTSLFWFLFIGMGLIGMGYGPLASFLPELFPTHARYSGASLTYNIAGLFGASVAAIIALPLNAHYGLKGVGIYLTLNAVLSLVGLWFISETKDKLLS

SEQ ID NO: 641 - DNA, 99 bp, Haemophilus influenzae
  Name: NTH0348
gtggggtattgtagagaaaatatttggcttgtaaaggaaagtgcggttaaattcttagtagaattttatgtaaaatttaaccgcttaatagattgtatt

SEQ ID NO: 642 - protein, 33 aa, Haemophilus influenzae
  Name: NTH0348
VGYCRENIWLVKESAVKFLVEFYVKFNRLIDCI

SEQ ID NO: 643 - DNA, 198 bp, Haemophilus influenzae
  Name: NTH0349
atgacaacccaattcaaaccagaattactttcccctgcaggctctcttaaaaatatgcgctatgcgtttgcttatggtgcagatgcggtttatgcaggacaacctcgttatagcttacgtgtacgcaataatgaatttaatcacgccaatttgaaaatcgggatcgatgaagcccattcccttggcaaaaattctatg

SEQ ID NO: 644 - protein, 66 aa, Haemophilus influenzae
  Name: NTH0349
MTTQFKPELLSPAGSLKNMRYAFAYGADAVYAGQPRYSLRVRNNEFNHANLKIGIDEAHSLGKNSM

SEQ ID NO: 645 - DNA, 300 bp, Haemophilus influenzae
  Name: NTH0350
atggaacacattgcccttgctaactggttcaacacagaagtgcggtcaaattcagacaagattttaaccgcactttctactgcaaaatcacttattgaaaatcaagaaaaagtcttagtcggtgcggaatatacgttatttttaaatgctgatgaagtaatggtgcgcgccaacaatctcgccattgaatcagatgaaattttagaacaagatttccattattatgatgaagaaagccttgctttttgcggtacgcaagattttattcattttctccaatcttatgttgattttattgct

SEQ ID NO: 646 - protein, 100 aa, Haemophilus influenzae
  Name: NTH0350
MEHIALANWFNTEVRSNSDKILTALSTAKSLIENQEKVLVGAEYTLFLNADEVMVRANNLAIESDEILEQDFHYYDEESLAFCGTQDFIHFLQSYVDFIA

SEQ ID NO: 647 - DNA, 1236 bp, Haemophilus influenzae
  Name: NTH0351
atgacttctcaacactccgctaaaaaatcatcgaaaaacacgccaaaaaataaccgcacttttaaaggttttttacttaaatttagcttcactgcacttgtcttaacgattttttacggcggttatctcgattggcaaattcgttctaaaatggacggtcaaatttggcatttgcctgcggaagtttatagtcgcttagaaagtgtgaaaattgccgataatctcgcttttgatgaagtcattcaaattttattagataacgaatatcgccaaactacaatggttgccgcacctggcgatttcaaattagaagatgatagcattgtaatacttcgccgtgcttttcctttccccgataaagcagagcctcagcgagttttgcgcttgcgttttagccataataagttatctcgcattgaagatttagtcacagtcaaaactgttgatgaatttcgtcttgcaccaaagttgattgcgatgttgcaatcagacaacgaagatcgtttagctattcctttacaaaattatccccgtttattaattgatacattaattttaacggaagatcgccgcttttatgaacataatggcattaatccagtggggattttacgcgcattaattgcgaatattcgtgcaggtcaaacggtacagggcggaagtacgctcactcaacaattagtcaaaaatttatttttatcgcgcgaacgcaccattacacgtaaagccaacgaagccttgatgtcattggttttagattggcgttacgataaaaatcgcattctcgaaacctatcttaatgaaatttatctcgggcaaaatggcgatacgcaaattcacggttttgaattagccagccaattttattttggtcgttcgattcgtgaaattagcttagatcaaattgcccttttagtggggatggtcaaaggcccttcactttataatccttggcgtaatccacaaaacgcactcgaacgtcgcaacattgttttaaggctaatgcttgaacataaaatgatcggcgatgaactttatcaattattaagtcagcgacctttaggtgtgcaaaagaaagggcaaatctcgcgtaaataccctgcatttattcaaactttacaagcagatttacgccgtgaactgggcgaacacaaaatatccagtttacttggcgcacgtattttttccacaatggatttaaaacaacaagctcaagcagcaaaagccaggggtcaa

SEQ ID NO: 648 - protein, 412 aa, Haemophilus influenzae
  Name: NTH0351
MTSQHSAKKSSKNTPKNNRTFKGFLLKFSFTALVLTIFYGGYLDWQIRSKMDGQIWHLPAEVYSRLESVKIADNLAFDEVIQILLDNEYRQTTMVAAPGDFKLEDDSIVILRRAFPFPDKAEPQRVLRLRFSHNKLSRIEDLVTVKTVDEFRLAPKLIAMLQSDNEDRLAIPLQNYPRLLIDTLILTEDRRFYEHNGINPVGILRALIANIRAGQTVQGGSTLTQQLVKNLFLSRERTITRKANEALMSLVLDWRYDKNRILETYLNEIYLGQNGDTQIHGFELASQFYFGRSIREISLDQIALLVGMVKGPSLYNPWRNPQNALERRNIVLRLMLEHKMIGDELYQLLSQRPLGVQKKGQISRKYPAFIQTLQADLRRELGEHKISSLLGARIFSTMDLKQQAQAAKARGQ

SEQ ID NO: 649 - DNA, 873 bp, Haemophilus influenzae
  Name: NTH0352
atggaaaaatatcgaaaaatttttgtgattaatccaaaacgtcaaacacctgcttaccaagtaaatgatggtgtggactatatgccaatgtctaaaacgaaaatttggctaattcaattgttaaatattgcgggaacaggccctatttttggccctattcttggtgcattatatggacctgttgcaatgctttggattgttattggttgtatttttgcgggcgcagtacacgattatttctgtggtatgttaagtattcgtcacggtggcgcaacaatgccatatttggcgggtaagtttttaggtcgtcccgttaaagtctttatcaatacattagcacttgtgttgcttttacttgtcggtgttgtgtttgtggcaagcccagctcaattaatgggtaccattacaatggatgtatttggtgcttcgcaaagtgcgttagtgcttggtgatgcagaggcagttcatcattctgttgaagctggtgggattaaagtatggggaatggataaagcaacagtggttgctctgtggacagcaattatttttgcttattatattcttgcaaccttacttccagttgataagattattggtcgaatttatccactctttggtgcgttattactctttatgtcagttggtatggtatacggattagttgtttcacattttagtgcaacagatccaattgagtttttccgtacaatcaatgctgatggcgagggtttaacttgggcgaaatttacacaaaatttccaagtgaaaggtgatgttccaatttggccacttttattcttaactatctcttgtggcgcattatcaggtttccacgcaacgcaaactccattaatgggcgcgttgtacagaaaa

SEQ ID NO: 650 - protein, 291 aa, Haemophilus influenzae
  Name: NTH0352
MEKYRKIFVINPKRQTPAYQVNDGVDYMPMSKTKIWLIQLLNIAGTGPIFGPILGALYGPVAMLWIVIGCIFAGAVHDYFCGMLSIRHGGATMPYLAGKFLGRPVKVFINTLALVLLLLVGVVFVASPAQLMGTITMDVFGASQSALVLGDAEAVHHSVEAGGIKVWGMDKATVVALWTAIIFAYYILATLLPVDKIIGRIYPLFGALLLFMSVGMVYGLVVSHFSATDPIEFFRTINADGEGLTWAKFTQNFQVKGDVPIWPLLFLTISCGALSGFHATQTPLMGALYRK

SEQ ID NO: 651 - DNA, 606 bp, Haemophilus influenzae
  n 428, 432, 445, 455, 462, 488, 490, 519, 578, 598: n is any nucleotide
  Name: NTH0353
gtgggccttgcattctatgaaaatccacaagcgttacaagatgcaatttcagcaggttctccatctaaagttgtgtatgatagttcgttacatttcttatgttttattggtggtatttttgccatattaggcgtgattgttcttcctattacttctggcgatactgcattccgtgctgcgcgtttacagatagccgaaatttttaatgttgatcaacgttcattacctaaacgtttattaattgctgtgccgttgtttgtattaggttattttatttcaaccattgatttcagcgtattatggcgttatttcacttgggcaaaccaaatgacagcaatggtaatgttatggactacagcgggatatttatatcgttatcataaattccactgggttgcgtctcttcctgcgtggtttatcacaacagnatgngcaacttatttgntctacaacanaattggnttcggcttaaattatcagctttctgngnatccttggttaccaccacccatcggttgnatccgattgctctctcccatgcctaaaccattagcgacccgagatgaagataccttaancagcaaccagcgtataaacnggacgaaa

SEQ ID NO: 652 - protein, 202 aa, Haemophilus influenzae
  Xaa 143, 144, 149, 152, 163, 164, 173, 193, 200: Xaa is any amino acid
  Name: NTH0353
VGLAFYENPQALQDAISAGSPSKVVYDSSLHFLCFIGGIFAILGVIVLPITSGDTAFRAARLQIAEIFNVDQRSLPKRLLIAVPLFVLGYFISTIDFSVLWRYFTWANQMTAMVMLWTTAGYLYRYHKFHWVASLPAWFITTXXATYLXYNXIGFGLNYQLSXXPWLPPPIGXIRLLSPMPKPLATRDEDTLXSNQRINXTK

SEQ ID NO: 653 - DNA, 681 bp, Haemophilus influenzae
  n 419, 564, 585, 596: n is any nucleotide
  Name: NTH0354
gtggataatgttcgccgtatgttgttggcaatggtggacgatttccgctgcgtgatcatcaaacttgccgaacgtattactttcttgcgtgatgcagagtatcgttgtgcagaggaagacaaagtccttgccgtcaaagaatgttcttatatttatgcccctcttgccaatcgtcttggaattggtcagctgaaatgggagttagaagattactgcttccgttatcttcatcctgaacaatatcgcgctattgctaaattattgcaggaacgtcgtcttgatcgtgaacattacattgctgatttcgtcagtgagttgagcagttatttacgtgaaaatatcaagcaagtggaagtctatggccgtccgaaacatatttacagcatttggcgcaaaatgcagaaaaagaatcttgagtncagcggtttatatgatgtaagagcggtcagaattatcgtgcaaaaattgcaagattgttacaccgcacttgggattgtgcatactcaatttaaacacttacccaaagaatttgacgattatgtcgcgaacccgaaaccgaacggntatcaatctattcatactggntgttttagggnaaaggtggcaagcccaattgaagtacaaattcgaacccaacaaatgcatgatgatgcagagttaggtatggcggccactggaaat

SEQ ID NO: 654 - protein, 227 aa, Haemophilus influenzae
  Xaa 140, 199: Xaa is any amino acid
  Name: NTH0354
VDNVRRMLLAMVDDFRCVIIKLAERITFLRDAEYRCAEEDKVLAVKECSYIYAPLANRLGIGQLKWELEDYCFRYLHPEQYRAIAKLLQERRLDREHYIADFVSELSSYLRENIKQVEVYGRPKHIYSIWRKMQKKNLEXSGLYDVRAVRIIVQKLQDCYTALGIVHTQFKHLPKEFDDYVANPKPNGYQSIHTGCFRXKVASPIEVQIRTQQMHDDAELGMAATGN

SEQ ID NO: 655 - DNA, 1101 bp, Haemophilus influenzae
  Name: NTH0355
ttgcgtaaattgttagcttggcaagatgatattacggattcaggcgaagtgctggcagagttgcgtagccaagtgtttgatgaccgtgtatatgtgtttacgccaaagggcgaagtggtggatttgccaacgggatctacaccattagattttgcttacgccattcatagtgaaattggtcatcgctgtatcggggcaaaagttgcggggcgtattgtgccatttacctatcagctacaaatgggtgatcaaattgatattattacccagaaaaatccgaacccgagccgtgactggctaaacccaaatttaggatttactcacaccgcaaaatctcgagccaaaattcaagcgtggtttaaaaaacaagatcgcgataaaaatattccagcgggtaaagaattactcgataatgaactcgcgcttttgaatttaagtattaagcaagtggaaccttatgcgttaccacgctataacttgaaaaatttggacgatctttatgcgggcattggcagtggtgatattcgtttaaataacttaatcaatttcttgcaaagtaaattgattaaagtgactgctgaagaagcagatcaagagattttacgtcatgttgctaacaaaagtgcggtcaattctcagcagaaatctgaaaagaacaatggctatgtgattgtggagggtgtggacaatcttatgcatcatattgcgcgttgctgccagccgataccaggcgatgcgattgttggctatattacaatgggacgtggtatttctattcaccgagcggattgtgaacaattcttagatttgcaagcggctcatccagaacgcgtagtggaatcaatttggggcgaaaattacgcaagtggtttccatattaatatccgtattgtggcaggcgatcgcaatggcttattgcgtgatattacgacggttctagcaaatgaaaaaattagcgtattaggggtctcaagccgtgctgataccaaaaaacagcttgctactattgatatggaaattgaacttcataatgttgaaagtttgagtaaaatattggctcgattagcaaaattagatgatgttatcgaagcgaagcgttta

SEQ ID NO: 656 - protein, 367 aa, Haemophilus influenzae
  Name: NTH0355
LRKLLAWQDDITDSGEVLAELRSQVFDDRVYVFTPKGEVVDLPTGSTPLDFAYAIHSEIGHRCIGAKVAGRIVPFTYQLQMGDQIDIITQKNPNPSRDWLNPNLGFTHTAKSRAKIQAWFKKQDRDKNIPAGKELLDNELALLNLSIKQVEPYALPRYNLKNLDDLYAGIGSGDIRLNNLINFLQSKLIKVTAEEADQEILRHVANKSAVNSQQKSEKNNGYVIVEGVDNLMHHIARCCQPIPGDAIVGYITMGRGISIHRADCEQFLDLQAAHPERVVESIWGENYASGFHINIRIVAGDRNGLLRDITTVLANEKISVLGVSSRADTKKQLATIDMEIELHNVESLSKILARLAKLDDVIEAKRL

SEQ ID NO: 657 - DNA, 195 bp, Haemophilus influenzae
  Name: NTH0356
atgtataaaacgacggggctaacccatttaatcaattccacgaaatattcattacaaggcttaaaaagtgcgtttaaaaatgaaacggcttttcgccacgaatgttttttagcctgcattttaattcctcttactttctttttaggcgaaacaaaaattgaaattattattgatgatttctttctgttttgcttg

SEQ ID NO: 658 - protein, 65 aa, Haemophilus influenzae
  Name: NTH0356
MYKTTGLTHLINSTKYSLQGLKSAFKNETAFRHECFLACILIPLTFFLGETKIEIIIDDFFLFCL

SEQ ID NO: 659 - DNA, 168 bp, Haemophilus influenzae
  n 151: n is any nucleotide
  Name: NTH0358
ttgcttgtgatggcgttagaacttttaaacagtgcggtagaggcagttgttgatcgcattggtacagaacgccacgaactttcaggacgtgcgaaagatcaaggctctgcatcggtatttattgccctttgtattgtcggtatcgtttggngcggaattttattcttc

SEQ ID NO: 660 - protein, 56 aa, Haemophilus influenzae
  Xaa 51: Xaa is any amino acid
  Name: NTH0358
LLVMALELLNSAVEAVVDRIGTERHELSGRAKDQGSASVFIALCIVGIVWXGILFF

SEQ ID NO: 661 - DNA, 825 bp, Haemophilus influenzae
  Name: NTH0359
atgaaactgattgaacaacatcaaatttttggcggttcacagcaagtttgggcgcataatgcccaaatgttgcaatgcgaaatgaaatttgccgtctatttgccaaataatccagaaaatcgaccgcttggcgtgatttattggctttctggcttaacttgtacagaacaaaatttcattaccaaatcaggctttcaacgttatgccgcagaacatcaagtgattgtggttgcccccgatactagccctcgcggagagcaagtgccgaatgatgcggcttacgatttagggcagggagcgggcttttatcttaatgcgaccgagcagccttgggcgacgaattatcaaatgtatgattatatcttgaatgaattgcctgatttgattgaagcaaatttccctactaacggcaaacgttccattatgggacattcaatgggcggacacggtgcattggtattggcactgcgaaatcgggaacgttatcaaagtgtttctgccttttcgcctattttatcgccaagccaggtgccttggggagaaaaagccttttctacctatttaggggaagatcgtgaaaaatggcagcaatatgatgccagctcgctcattcaacaaggctataaagtgcaaggtatgcgcattgagcagggcttggaagatgagtttttgcctacacaattgcgtaccgaagattttatcgaaacctgtcgagtggcaagtcagcctgtcgatgtgcgcttccataaaggctatgatcacagctattacttcatcgccagttttattggcgagcatattgcctatcatgcggaatttttgaag

SEQ ID NO: 662 - protein, 275 aa, Haemophilus influenzae
  Name: NTH0359
MKLIEQHQIFGGSQQVWAHNAQMLQCEMKFAVYLPNNPENRPLGVIYWLSGLTCTEQNFITKSGFQRYAAEHQVIVVAPDTSPRGEQVPNDAAYDLGQGAGFYLNATEQPWATNYQMYDYILNELPDLIEANFPTNGKRSIMGHSMGGHGALVLALRNRERYQSVSAFSPILSPSQVPWGEKAFSTYLGEDREKWQQYDASSLIQQGYKVQGMRIEQGLEDEFLPTQLRTEDFIETCRVASQPVDVRFHKGYDHSYYFIASFIGEHIAYHAEFLK

SEQ ID NO: 663 - DNA, 648 bp, Haemophilus influenzae
  Name: NTH0360
gtgattgaagaaggtgttgtactaggtgataacgtgatcattggtgcaaattgctttgttggtaaaaatactaagataggttcaggcactcagctctgggctaatgtcactgtttaccataacgttgagattggagctaattgcttaattcaatcaggaacagttatcggtagtgatggttttggttatgcaaatgatcgtggtcgttggattaaaattccacaagtagggcaagtaataattggtaataacgttgagattggtgcgaatacctgtattgatagaggcgcattagatgccacgattattgaagataacgttattatcgataacctttgtcaaattgcacataatgttcatattggcactggtacagcggttgcgggtggcgttattatggcaggtagcttaactgttggtcgctattgcttaattggtggtgcaagtgtgattaatggtcatatggaaatttgcgataaagtaaccattactggaatgggaatggttatgcgcccaattacagagcctggcgtatattcctctggtattccattgcaaacgaataaagaatggcgtaaaacagcagcactaacgttaggtattgatggaataaataaacgtttaaaagcgttagaaaagaaaatttct

SEQ ID NO: 664 - protein, 216 aa, Haemophilus influenzae
  Name: NTH0360
VIEEGVVLGDNVIIGANCFVGKNTKIGSGTQLWANVTVYHNVEIGANCLIQSGTVIGSDGFGYANDRGRWIKIPQVGQVIIGNNVEIGANTCIDRGALDATIIEDNVIIDNLCQIAHNVHIGTGTAVAGGVIMAGSLTVGRYCLIGGASVINGHMEICDKVTITGMGMVMRPITEPGVYSSGIPLQTNKEWRKTAALTLGIDGINKRLKALEKKIS

SEQ ID NO: 665 - DNA, 423 bp, Haemophilus influenzae
  Name: NTH0361
ttgcacaaatacttacacggtgcaaaaattggcgtattagttgcgggcgaaggttctgctgatgaactgaaaaaagtagcaatgcacgtagctgcatctaaacctgaattcgtgaacccagaagatgtatctgctgaagtggttgaacacgaacgccaaatccaaatcgatattgcgatcaactctggtaaaccaaaagaaatcgcagagaaaatggttgaaggtcgtatgaagaaattcactggtgaagtttcattaacaggtcaagcatttgtaatggatccttctgtatctgtaggggatttcttaaaatcagtaaatacttctgtttctaacttcattcgtttagaagtaggcgaaggtattgagaaaaaagaagaagattttgctgctgaagttgcaaaaatcactggcggtaacgcg

SEQ ID NO: 666 - protein, 141 aa, Haemophilus influenzae
  Name: NTH0361
LHKYLHGAKIGVLVAGEGSADELKKVAMHVAASKPEFVNPEDVSAEVVEHERQIQIDIAINSGKPKEIAEKMVEGRMKKFTGEVSLTGQAFVMDPSVSVGDFLKSVNTSVSNFIRLEVGEGIEKKEEDFAAEVAKITGGNA

SEQ ID NO: 667 - DNA, 120 bp, Haemophilus influenzae
  n 72: n is any nucleotide
  Name: NTH0363
atgttctcaccgattttagcaactaatgcagcacgtttttttcttcaaattgcgctttgtaatgcttcgatnagtggaaccctttggtttgctgctgcgaaatcagctactttcgtttgc

SEQ ID NO: 668 - protein, 40 aa, Haemophilus influenzae
  Xaa 24: Xaa is any amino acid
  Name: NTH0363
MFSPILATNAARFFLQIALCNASXSGTLWFAAAKSATFVC

SEQ ID NO: 669 - DNA, 444 bp, Haemophilus influenzae
  n 439, 440, 441, 442, 443: n is any nucleotide
  Name: NTH0364
atggatatggcaaattggcagaattatcgttctactgtgaatggtatgcctgccgtgtttaccgcaaatattgaagatgttgaaaaatatcacggtaaaggtctcgataaaatagtgcagtttactattgattatcaggctgatgatgaaacgggtttaccctcagaagttgaatacgataagttaattaaccgtgtatttaaaattttgacacaactaaccgcacttccaaatgtattttttgcggggcattttatttgtaattctcaaataaaaatacatttttattgtaagcacgaaaatcttattgtagaaactttacagcaaattgattttgttaaagatattaatgtgcaaaaggatttaatttgggatacttattttgactttttgctcgcttctccattggagattaagttaaatgcaacggaagaagtgnnnnnt

SEQ ID NO: 670 - protein, 148 aa, Haemophilus influenzae
  Xaa 147, 148: Xaa is any amino acid
  Name: NTH0364
MDMANWQNYRSTVNGMPAVFTANIEDVEKYHGKGLDKIVQFTIDYQADDETGLPSEVEYDKLINRVFKILTQLTALPNVFFAGHFICNSQIKIHFYCKHENLIVETLQQIDFVKDINVQKDLIWDTYFDFLLASPLEIKLNATEEVXX

SEQ ID NO: 671 - DNA, 273 bp, Haemophilus influenzae
  Name: NTH0365
atgtctttcttacctgaagaaagagcgtggtatcaacgtttgtatgattatggattagaagatagttttcgtaagctgaccccaccagcaaatgataaattctcgtggtttgattaccgttctaaaggttttgatgataatcgaggtttacgaattgatcatattttgataagccaaaaattagctgaacgatgtgtcgatgtgggcattgcattagatattcgagcaatggaaaaaccgtctgatcacgcaccgatttgggctgaatttaaa

SEQ ID NO: 672 - protein, 91 aa, Haemophilus influenzae
  Name: NTH0365
MSFLPEERAWYQRLYDYGLEDSFRKLTPPANDKFSWFDYRSKGFDDNRGLRIDHILISQKLAERCVDVGIALDIRAMEKPSDHAPIWAEFK

SEQ ID NO: 673 - DNA, 1296 bp, Haemophilus influenzae
  n 1255, 1260, 1279, 1291, 1292, 1293, 1294, 1295: n is any nucleotide
  Name: NTH0366
atgagaccccttgtgaccttccacagaaaaggcagtgaaaaacctgttcgtacgaaagtacgccacttggcgttaaagccactttccgctatattgctatctttgggcatggcatccattccgcaatctgttttagcgagcggtttacagggaatgagcgtcgtacacggtacagcaaccatgcaagtagacggcaataaaaccactatccgtaatagcgtcaatgctatcatcaattggaaacaatttaacatcgaccaaaatgaaatggtgcagtttttacaagaaagcagcaactctgccgttttcaaccgtgttacatctgaccaaatctcccaattaaaagggattttagattctaacggacaagtctttttaatcaacccaaatggtatcacaataggtaaagacgcaattattaacactaatggctttacggcttctacgctagatatttctaacgaaaacatcaaagcgcgtaatttcacccttgagcaaaccaaggataaagcgctcgctgaaatcgtgaatcacggtttaattaccgttggtaaagacggtagcgtaaaccttattggcggcaaagtaaaaaatgagggtgtaattagcgtaaatggcggtagcatttctttacttgcagggcaaaaaatcaccatcagcgatataataaacccaaccattacttacagcattgccgcacctgaaaatgaagcaatcaatctaggtgatatctttgctaaaggtggtaatatcaatgtccgcgctgcaaacattcgaaaccaaggtaaactttctgccgattctgtaagcaaagataaaagcggcaacattgttctttccgctaaagagggcgaagcggaaattggcggcgtgatttccgctcaaaatcaacaagccaaaggcggtaagttgatgattacaggtgataaagtcacattaaaaacaggcgcagttatcgacctttcaggtaaagaagggggagagacctaccttggcggcgacgagcgcggcgaaggtaaaaacggcattcaattagcaaagaaaacctctttagaaaaaggctcaacaattaatgtatcaggcaaagaaaaaggcgggcgcgctattgtatggggcgatattgcgttaattgacggcaatattaatgctcaaggtaaagatatcgctaaaactggtggttttgtggaaacgtcggggcattatttatctattggtaatgatgcggctgttgaggcgaaagaatggttgttggatnccggnataatgttacccatgggtnaccgagacccgnnnnnt

SEQ ID NO: 674 - protein, 432 aa, Haemophilus influenzae
  Xaa 419, 427, 431, 432: Xaa is any amino acid
  Name: NTH0366
MRPLVTFHRKGSEKPVRTKVRHLALKPLSAILLSLGMASIPQSVLASGLQGMSVVHGTATMQVDGNKTTIRNSVNAIINWKQFNIDQNEMVQFLQESSNSAVFNRVTSDQISQLKGILDSNGQVFLINPNGITIGKDAIINTNGFTASTLDISNENIKARNFTLEQTKDKALAEIVNHGLITVGKDGSVNLIGGKVKNEGVISVNGGSISLLAGQKITISDIINPTITYSIAAPENEAINLGDIFAKGGNINVRAANIRNQGKLSADSVSKDKSGNIVLSAKEGEAEIGGVISAQNQQAKGGKLMITGDKVTLKTGAVIDLSGKEGGETYLGGDERGEGKNGIQLAKKTSLEKGSTINVSGKEKGGRAIVWGDIALIDGNINAQGKDIAKTGGFVETSGHYLSIGNDAAVEAKEWLLDXGIMLPMGXRDPXX

SEQ ID NO: 675 - DNA, 552 bp, Haemophilus influenzae
  Name: NTH0367
ttgaatgcttttgcgcgtgaaattgatcctcacaccagttatctttccccaagaacagcaaaaagttttaatgaaagtataaatctttctttggaaggcattgggactactttacaatcagaagatgatgaaattagcatcaaatctcttgtacctggtgcgccagcggaacgtagtaaaaagctgcatcctggggataaaatcattggtgttgggcaagcaacaggcgatattgaagacgttgttggttggcgtttagaagatttggtagaaaaaattaaagggaaaaaaggcactaaagttcgcttagaaattgagcctgctaaagggggaaaatcacgtattattactttggttcgtgataaagtccgtattgaagatcaagctgctaaactaacctttgaaaaagtgtcaggaaaaaacattgcggtaataaaaattccaagtttttatattggattaaccgaagatgtcaaaaaactactgcttaaattagacaatcaacaagctgaggctcttattgttgatttacgtgaaatggcggtggtgcat

SEQ ID NO: 676 - protein, 184 aa, Haemophilus influenzae
  Name: NTH0367
LNAFAREIDPHTSYLSPRTAKSFNESINLSLEGIGTTLQSEDDEISIKSLVPGAPAERSKKLHPGDKIIGVGQATGDIEDVVGWRLEDLVEKIKGKKGTKVRLEIEPAKGGKSRIITLVRDKVRIEDQAAKLTFEKVSGKNIAVIKIPSFYIGLTEDVKKLLLKLDNQQAEALIVDLREMAVVH

SEQ ID NO: 677 - DNA, 612 bp, Haemophilus influenzae
  Name: NTH0368
gtggcgttaagtggtttatttattgccgatggccctgttgtgcaggttcgcgatgcttatcagcgtattcgtgttcatgaagatgatgatgctacgcaacaatataaggggttattatttgtgatgattaatcgttacagtgcttccgcatcagaaatttttgctgcagcaatgcaagattatcgtcgaggtattatcatcgggcaaaatacttttggtaaaggtacggtgcaacagagtcgttcgttaaattttatctatgatttagatcagagtccgttgggtgttttgcaatatactattcaaaaattttatcgcgttaatggtggttcaacccaattaaaaggtgttgcagccgatattaatttccctgaaattatagatgcgaaagaatatggggaagataaagaagataatgcgcttgcttgggataaaatcccatcagcgagttatacggaagtaggaaatatcgattatattgataatgcagtaaatattctaaatgaaaaacatcttgctcgtattgctaaagatcctgaatttgttgcattgaatgaagaattgaaagtgcgaaatgaacgcccgagatcgaaaatttctatcgttgaatta

SEQ ID NO: 678 - protein, 204 aa, Haemophilus influenzae
  Name: NTH0368
VALSGLFIADGPVVQVRDAYQRIRVHEDDDATQQYKGLLFVMINRYSASASEIFAAAMQDYRRGIIIGQNTFGKGTVQQSRSLNFIYDLDQSPLGVLQYTIQKFYRVNGGSTQLKGVAADINFPEIIDAKEYGEDKEDNALAWDKIPSASYTEVGNIDYIDNAVNILNEKHLARIAKDPEFVALNEELKVRNERPRSKISIVEL

SEQ ID NO: 679 - DNA, 489 bp, Haemophilus influenzae
  Name: NTH0369
atgcccaaactacgttcagcgaccagcacacaaggtcgtaatatggcaggcgcacgtgccttatggcgtgcaacaggaatgaaagaaaatgactttggtaaaccgattattgcggtggtgaactctttcacgcaattcgtaccagggcatgtgcatttaaaagatatgggacagcttgttgccgcagaaattgaaaaagcgggcggcgtagcaaaagaatttaacaccattgcggtggatgatggtatcgcgatgggacacggtgggatgctttattccttaccaagccgtgatttaatcgctgatagcgtggaatatatggtcaatgcgcactgtgctgatgcgatggtgtgtatttccaactgtgacaaaatcactccaggaatgttaatggcggcaatgcgtttaaatattccaactatcttcggttcaggcgggccgatggaagcaggtaaaactaactttctgatcattaatcccgttagaatt

SEQ ID NO: 680 - protein, 163 aa, Haemophilus influenzae
  Name: NTH0369
MPKLRSATSTQGRNMAGARALWRATGMKENDFGKPIIAVVNSFTQFVPGHVHLKDMGQLVAAEIEKAGGVAKEFNTIAVDDGIAMGHGGMLYSLPSRDLIADSVEYMVNAHCADAMVCISNCDKITPGMLMAAMRLNIPTIFGSGGPMEAGKTNFLIINPVRI

SEQ ID NO: 681 - DNA, 603 bp, Haemophilus influenzae
  Name: NTH0370
atggcgtgcttgaaagcacatcatgtcacgactcttttcggctatcccggtggcgcaattatgccaacctacgatgccctttatgacgcaggcttagatcacttactttgtcgtaatgaacaagggactgcaatggctgcgattggctatgctcgctccacgggaaaagtgggcgtctgtattgcagcatcaggctctggtgccactaatttagttattggattaggcgatgccatgatggactccattccagttgtcactattgaaccttggcgtgaacaaatcagaaatttcaaagcaaaattagatttcacttatgttgaaaatcaaggcaatcgcccgattgatccttgggcattactcaacagcctatctaatcgcaaaccaaataatgcgataatttgtactgatgtgggtcagcatcaaatgtggtcagtgcaacacattttacgcgtagcacgtcactgcggatttaccgttacaacaatggaaatgacactcattgaaacccaagtgcggttaaaaatcactgtaaaatctgaccgcactttagatctattagtgaatcagttggttaagctgccggatgttttaatggttaat

SEQ ID NO: 682 - protein, 201 aa, Haemophilus influenzae
  Name: NTH0370
MACLKAHHVTTLFGYPGGAIMPTYDALYDAGLDHLLCRNEQGTAMAAIGYARSTGKVGVCIAASGSGATNLVIGLGDAMMDSIPVVTIEPWREQIRNFKAKLDFTYVENQGNRPIDPWALLNSLSNRKPNNAIICTDVGQHQMWSVQHILRVARHCGFTVTTMEMTLIETQVRLKITVKSDRTLDLLVNQLVKLPDVLMVN

SEQ ID NO: 683 - DNA, 231 bp, Haemophilus influenzae
  Name: NTH0371
atgtgctttcaagcacgccatgataagttgtgcacctgtcattgtgtttgtttcctgttatttttattttgggataagtttagcattgtagcgaaatttcgagtcattggtagggcttggagagaaaaaaacgaaaaaaagtgcggtgaaaattggcttattttgaatattcctgttcttcccctaaaaaatttagtgaatttttaccgctctttaagcttgcttattgac

SEQ ID NO: 684 - protein, 77 aa, Haemophilus influenzae
  Name: NTH0371
MCFQARHDKLCTCHCVCFLLFLFWDKFSIVAKFRVIGRAWREKNEKKCGENWLILNIPVLPLKNLVNFYRSLSLLID

SEQ ID NO: 685 - DNA, 918 bp, Haemophilus influenzae
  Name: NTH0372
atggtgcactcagctccaaaagcacaaaagcgtgagactttttctggtcgtcgcgcatttattctggcagcaattggttctgccgttggtcttggtaatatttggcgttttccttacaccacttatgaaaacggtggtggcgcatttatcatcccttaccttattgcattattaaccgcagggattcctcttttattcctagattatgccattgggcaccgtcatcgtggtggtgcgccactttcttatcgtcgtgttagcccgcactttgaagtgtttggctggtggcaaatgatggtgaatgtcatcatcggattatattacgctgtagtgttaggctgggcagcaagctacacatatttttctttcactggtgcgtggggcgataaacccattgatttcttcatcggtgaatttttaaaaatgggcgatattaaaaacggtatcagctttgaatttgttggtatggtaaccgcaccattaattgcgatgtggattgttgccttaggcgtgctttctatgggtgttcaaaaaggaattgctaaggtctcttccgtattaatgccagtgctcgtcgtgatgtttatggtgcttgtgatttattccttattcttaccaggtgcggcaaaaggtttagatgcattatttacaccagattggacaaaattatccaacccgagtgtgtggattgccgcctatgggcaaatcttcttctctctttcaatcggctttgggattatggtgacttacgcctcttatcttaaaaaagaatccgatttgacgggtagtggcttggttgtaggttttgctaacagtagctttgaagtgttagcaggtatcggcggatttgcagcattaggttttattgcaacagcgccaggccaagaaattagcgaattaacaaaaggcggattgggt

SEQ ID NO: 686 - protein, 306 aa, Haemophilus influenzae
  Name: NTH0372
MVHSAPKAQKRETFSGRRAFILAAIGSAVGLGNIWRFPYTTYENGGGAFIIPYLIALLTAGIPLLFLDYAIGHRHRGGAPLSYRRVSPHFEVFGWWQMMVNVIIGLYYAVVLGWAASYTYFSFTGAWGDKPIDFFIGEFLKMGDIKNGISFEFVGMVTAPLIAMWIVALGVLSMGVQKGIAKVSSVLMPVLVVMFMVLVIYSLFLPGAAKGLDALFTPDWTKLSNPSVWIAAYGQIFFSLSIGFGIMVTYASYLKKESDLTGSGLVVGFANSSFEVLAGIGGFAALGFIATAPGQEISELTKGGLG

SEQ ID NO: 687 - DNA, 126 bp, Haemophilus influenzae
  n 20: n is any nucleotide
  Name: NTH0373
ttgtgcacggtaaaaggatntaattggcattcgccagatcacttccgtgttgttactcttccttatgtaaatcaacttgaggaagccattacaaaattagcaagatttttgtctgattaccgtcaa

SEQ ID NO: 688 - protein, 42 aa, Haemophilus influenzae
  Xaa 7: Xaa is any amino acid
  Name: NTH0373
LCTVKGXNWHSPDHFRVVTLPYVNQLEEAITKLARFLSDYRQ

SEQ ID NO: 689 - DNA, 921 bp, Haemophilus influenzae
  n 904: n is any nucleotide
  Name: NTH0374
atgcgattattcccaaaatccgacaaattagaacacgtatgttatgacattcgcgggcctgtgcataaagaagcactacgcttagaagaagaaggcaataaaattttaaaacttaatatcggcaacccagcccctttcggttttgaagcaccagatgaaattttagtggatgtgctacgtaatttgccatcagctcaaggctactgtgattcaaaagggttatattctgctcgtaaagccattgttcaatattaccaatcaaaagggattctcggcgcgaccgtcaatgatgtgtatattggtaacggcgtatctgagcttatcacaatggctatgcaagcactgctcaatgatggcgatgaagtactcgtgccgatgcctgattatccgctttggactgctgcggtaaccctttctggcggtaaagcagtgcattatctctgtgatgaagaagcaaattggtttcccgctattgatgatattaaagcaaaggtgaatgcgaaaactaaagcgattgttatcatcaacccgaacaacccaacgggtgctgtgtatagcaaagaattattacaagaaatagtggaaatcgcgcgtcaaaataatttgattatcttcgcagacgaaatctacgacaaaattttatatgatggcgcggtgcatcatcacattgccgcactagctcctgatttattaaccgttacgctgaatgggttatcaaaagcttatcgagttgcaggcttccgccaaggctggatgattttaaacggtccaaaacataatgcgaaaggttatattgaaggcttggatatgctggcatcaatgcgtttatgtgccaacgtaccaatgcaacatgcaattcaaaccgcacttggtggctatcaaagtattaatgaatttattttanccgggcggtcgattact

SEQ ID NO: 690 - protein, 307 aa, Haemophilus influenzae
  Xaa 302: Xaa is any amino acid
  Name: NTH0374
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEEANWFPAIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILXGRSIT

SEQ ID NO: 691 - DNA, 249 bp, Haemophilus influenzae
  Name: NTH0375
atgaaacaactttctaatgaattatatgatgcagaacaccgaataagtaatacagcttataagcgtagttacgaacgtattattgatgccattgaaaatttaactgaaagttatcccgattatccttggacctaccgagaagtagcggaattttgtggatgtgaaactgaaaccgcaattcgtattagtagagagcttaaaaaacaaggaattttagataaaaatacacgacatctacgaatatgctct

SEQ ID NO: 692 - protein, 83 aa, Haemophilus influenzae
  Name: NTH0375
MKQLSNELYDAEHRISNTAYKRSYERIIDAIENLTESYPDYPWTYREVAEFCGCETETAIRISRELKKQGILDKNTRHLRICS

SEQ ID NO: 693 - DNA, 384 bp, Haemophilus influenzae
  Name: NTH0376
atgcgccatcgtaagagtggtcgtcaactaaaccgtaatagtagtcatcgtcaagcgatgttccgtaacttagcaagtgctttagttagtcatgaaatcattaagactactttgcctaaagctaaagaattacgccgtgtagttgaaccgttaattacattagcaaaagtagatagcgttgctaaccgtcgtttagcattcgctcgtactcgcaacgttgaaactgttgcaaaattatttaatgaattaggtccacgttttgctcaacgtgcaggtggttacactcgcattttgaaatgtggtttccgtgcaggcgataatgcaccaatggcatacattgagttagttgatcgtccagaagttgctgaggcaacaactgaggaa

SEQ ID NO: 694 - protein, 128 aa, Haemophilus influenzae
  Name: NTH0376
MRHRKSGRQLNRNSSHRQAMFRNLASALVSHEIIKTTLPKAKELRRVVEPLITLAKVDSVANRRLAFARTRNVETVAKLFNELGPRFAQRAGGYTRILKCGFRAGDNAPMAYIELVDRPEVAEATTEE

SEQ ID NO: 695 - DNA, 579 bp, Haemophilus influenzae
  Name: NTH0377
atgaaaaccgcttcaattagtagggtaacgtgttcggcgtgtagaggatatgtccctgtttcatttcgtacacatacgcaagaagaacgtccaaatggtcgtttgcctgttgatgcttgtatagtcccggttgaacgaaatgcgtataatgtagaggcagctcgtgttgagcagcgtacagatttggataagctcgttattgagttagaaactaatggtgcacttgagccagaagaagcaattcgtcgtgcagcaacaatcttggcggagcaacttgatgcattcgttgatttacgtgatgttcgtcagcctgagattaaggaagaaaaaccggaatttgatccgattttattacgtcctgtagatgatttagagctgacagttcgttctgctaactgtttgaaagcagaaacaattcattatatcggtgatttagtgcaacgtactgaagtagaattattaaaaacccctaatcttggtaagaaatctcttactgaaattaaggatgttcttgcttctcgtggcttgtcacttggtatgcgccttgaaaattggccgccagcaagtattgctgaagac

SEQ ID NO: 696 - protein, 193 aa, Haemophilus influenzae
  Name: NTH0377
MKTASISRVTCSACRGYVPVSFRTHTQEERPNGRLPVDACIVPVERNAYNVEAARVEQRTDLDKLVIELETNGALEPEEAIRRAATILAEQLDAFVDLRDVRQPEIKEEKPEFDPILLRPVDDLELTVRSANCLKAETIHYIGDLVQRTEVELLKTPNLGKKSLTEIKDVLASRGLSLGMRLENWPPASIAED

SEQ ID NO: 697 - DNA, 720 bp, Haemophilus influenzae
  Name: NTH0378
gtgcaagattacttggtctttggtaatgcttatgttgagaaaactgtaaattcctttggtaaggttgtttcgttaaaatcctctcttgctaaatatatgcgtgtcggtgttgaaacaggtgtgttttatcagattgtgaatggttttgatgaatatgaatttaaaaaaggttctgtctttaacttgattaatcccgatgtgaatcaagagatttatggtgtgccagaatatttggccgcacttcaatctgcttttttaaatgaaagtgccacattgttccgctgtaaatattatctgaatggcgcgcatgcaggttcgattatttacatgactgatccaacacaaaacaaagacgacattgaagcaatcaaaacacaaatccgacaaacaaaaggcactggcaactttaagaatttgtttgtgtatattccaaacggaaagaaagatgggatgcaagttattccattgtctgatgctatcgccaaagatgatttcctaaacattaagaacgcaagccgtgatgatgtgttagctgcgcaccgtgtgccaccgcaactaatgggcattgtgcctaataatacaggcggttttggtgacgttgaaaaggcaacgcgagtgttttttatcaatgagataatcccattgcaagaacgattgaaagaaattaatagttggataggggaagaagtgatcacattctccgattacaaattgctaaat

SEQ ID NO: 698 - protein, 240 aa, Haemophilus influenzae
  Name: NTH0378
VQDYLVFGNAYVEKTVNSFGKVVSLKSSLAKYMRVGVETGVFYQIVNGFDEYEFKKGSVFNLINPDVNQEIYGVPEYLAALQSAFLNESATLFRCKYYLNGAHAGSIIYMTDPTQNKDDIEAIKTQIRQTKGTGNFKNLFVYIPNGKKDGMQVIPLSDAIAKDDFLNIKNASRDDVLAAHRVPPQLMGIVPNNTGGFGDVEKATRVFFINEIIPLQERLKEINSWIGEEVITFSDYKLLN

SEQ ID NO: 699 - DNA, 165 bp, Haemophilus influenzae
  n 156, 157, 158: n is any nucleotide
  Name: NTH0379
atgatcaaattgattaatccaatgtcacaatgttctgctggcaagttgaaaatgcctgcaggggaatcaacaatttttactattttgaaagataaactcaatgacttgttgcttgaaaaaaaattgtatttggtcataaaaaatctgcactttagnnntggtatt

SEQ ID NO: 700 - protein, 55 aa, Haemophilus influenzae
  Xaa 52, 53: Xaa is any amino acid
  Name: NTH0379
MIKLINPMSQCSAGKLKMPAGESTIFTILKDKLNDLLLEKKLYLVIKNLHFXXGI

SEQ ID NO: 701 - DNA, 99 bp, Haemophilus influenzae
  Name: NTH0380
atgcgccaagcgtttttattaatgccaacttatcgttccattgatattgactcccccactgatttgcaattagccgaaagtttaatttcaaaagaattc

SEQ ID NO: 702 - protein, 33 aa, Haemophilus influenzae
  Name: NTH0380
MRQAFLLMPTYRSIDIDSPTDLQLAESLISKEF

SEQ ID NO: 703 - DNA, 1077 bp, Haemophilus influenzae
  n 1: n is any nucleotide
  Name: NTH0382
ntgcacatttatgactcaccatttagcacatttcaatttgcaaatgaacaagatgcgaaagtggcttacgaggaattccagaaaggggcaaatttcgctgatgtcgctaaagcgaaatctttggataaaatttctggtgagaatggcggggatttaggctgggtaaatgagaatgaattaccaaaagcctttgaagatgccgcagctgcattgcaggtagggcaatatagccaaccaatcaatgtggatggcaattaccatattgtgttagtgcaagaacgtaaagcgcaaagtttggagaatgtgaaagctcaaattgcagatttagttcgtaaatctttaatggagagtcgttatttttctttagaaaaacaagcgagtgataaggcttttgaagacagtaagtctcttaatactgcagcacaagcagcaggtgttaaggttcaagagagtgattatttttctcgtcaaaatgtgccagctggattaaatttccctaatgttatttacacaatatttgaatcagatactacgaatgttggtatgaattctgaaccaattaatgtaggcgattatcacacaattattgtacgtgtgttggatcgcaaagcagagggcgtaaaaagtttagaagaggctaaaatcgatattgaaactttcttaaaacgtcagaaagctgagaatgcgcttaatgaaaaagcacaacaagcagtgaaaaaattaagtgaaaaccctgaatcaaaagtagatggcattaatttctcaagtgagcagacttttactttaagtgaaaataaagatcctattttaacaaatggtatattttcaattgctaaaccaaaatcaaatgaagctctttatcaagtggtgcataattcaaatggcgatgtggttgttgttgccttgaataaggttgaacaaggcagtttaagtgaaaaagaattgtcgcaatttggtatgcaattattgcgtagtcatcaatctgaattacaatttcagttaatacaaggattacgtgagagagcaaaaattgaggtaaatgactctttcatcaatcaagatgatgaagtgcaacaa

SEQ ID NO: 704 - protein, 359 aa, Haemophilus influenzae
  Xaa 1: Xaa is any amino acid
  Name: NTH0382
XHIYDSPFSTFQFANEQDAKVAYEEFQKGANFADVAKAKSLDKISGENGGDLGWVNENELPKAFEDAAAALQVGQYSQPINVDGNYHIVLVQERKAQSLENVKAQIADLVRKSLMESRYFSLEKQASDKAFEDSKSLNTAAQAAGVKVQESDYFSRQNVPAGLNFPNVIYTIFESDTTNVGMNSEPINVGDYHTIIVRVLDRKAEGVKSLEEAKIDIETFLKRQKAENALNEKAQQAVKKLSENPESKVDGINFSSEQTFTLSENKDPILTNGIFSIAKPKSNEALYQVVHNSNGDVVVVALNKVEQGSLSEKELSQFGMQLLRSHQSELQFQLIQGLRERAKIEVNDSFINQDDEVQQ

SEQ ID NO: 705 - DNA, 126 bp, Haemophilus influenzae
  Name: NTH0383
ttgaggtggcaatccgttctacaatcttccagcaagtgggatgaaaatttggaaaactttaaggaacatcaggcgttgttgggggcttatgggaagttgcagaaagcaaagcgagcacatcaaaaa

SEQ ID NO: 706 - protein, 42 aa, Haemophilus influenzae
  Name: NTH0383
LRWQSVLQSSSKWDENLENFKEHQALLGAYGKLQKAKRAHQK

SEQ ID NO: 707 - DNA, 306 bp, Haemophilus influenzae
  Name: NTH0384
ttgtttcatacaatttgcttaaacggaaattttctaaactcgccgcaagcggctcaaacagacgaaaattgcctgaaaattgaaagtcgcaaaggcgatttatatggggccccgaatttatcagagcattatttaaaaagtgcggttaattttaaattcattttaagaacaaaaaatattttgagttttgaccgcactttaaatcggataaagaacaaattgggttcccttcttttccacctttgtggaattgaatttgtaggaaattttcgtctgtttgagcgcagcgagtttagaaaatttccg

SEQ ID NO: 708 - protein, 102 aa, Haemophilus influenzae
  Name: NTH0384
LFHTICLNGNFLNSPQAAQTDENCLKIESRKGDLYGAPNLSEHYLKSAVNFKFILRTKNILSFDRTLNRIKNKLGSLLFHLCGIEFVGNFRLFERSEFRKFP

SEQ ID NO: 709 - DNA, 234 bp, Haemophilus influenzae
  Name: NTH0385
gtggtttttgatatcaggatttcgcctgatggcgacttactttttctttgctttgccaaagaaaaagtaggcaaaaagaaaggcaaccctgcttttccttattccctttgttccattgaatttgtttcacggaaattttctaaactcgctgcgctcaaacagacgaaaatttcctacaaattcaattccacaaaggtggaaaagaagggaacccaatttgttctttatccgatt

SEQ ID NO: 710 - protein, 78 aa, Haemophilus influenzae
  Name: NTH0385
VVFDIRISPDGDLLFLCFAKEKVGKKKGNPAFPYSLCSIEFVSRKFSKLAALKQTKISYKFNSTKVEKKGTQFVLYPI

SEQ ID NO: 711 - DNA, 333 bp, Haemophilus influenzae
  Name: NTH0386
ttgatcaaaaaaggaataccaatgacggattcaatccaatcatctatcacccctgtcaatatcgaagaagaacttaaatcttcctaccttgactacgcgatgtcggttatcgttgggcgtgcattacctgacgttcgagatggtttaaaaccagttcaccgccgcgtactgttctcaatggatcgcgaaggcaataccgccaataaaaaatacgtaaaatcagcgcgtgttgtgggtgatgtaatcggtaaatatcacccgcatggtgactcagccgtgtacgataccatcgtttgtatggcacaaccattctcacttcgctatatgtttggt

SEQ ID NO: 712 - protein, 111 aa, Haemophilus influenzae
  Name: NTH0386
LIKKGIPMTDSIQSSITPVNIEEELKSSYLDYAMSVIVGRALPDVRDGLKPVHRRVLFSMDREGNTANKKYVKSARVVGDVIGKYHPHGDSAVYDTIVCMAQPFSLRYMFG

SEQ ID NO: 713 - DNA, 156 bp, Haemophilus influenzae
  Name: NTH0387
ttggttgatggggcagggaactttggttcaattgatggggatgcgccagctgcaatgcgttatacccgaagtgcgtatgcaaaaaatacgcaagcattgctcactgatttggataagaaaccgtcatattctcgccaaactttgatggcgaattat

SEQ ID NO: 714 - protein, 52 aa, Haemophilus influenzae
  Name: NTH0387
LVDGAGNFGSIDGDAPAAMRYTRSAYAKNTQALLTDLDKKPSYSRQTLMANY

SEQ ID NO: 715 - DNA, 726 bp, Haemophilus influenzae
  Name: NTH0388
atggctgcggattctgtcaaatcacttatcaaagcacgccgtattagtatgggttggatggtgctttgcttagcaggcgcaattggcattggcttattcgctattccgtatttctttgccaatccagctattgcaggcacagtcaataatgaaccagagcaagtatttattgaattagctaaacttttatttaatccttggatcgcgggcatattactttccgctattttagccgctgtaatgagtacattaagtgctcaattattaatttcttcaagctcaatcacagaagatttctacaaaggttttattcgccctaaggcttcagaaaaagagctcgtatggcttggcagaataatggtgttagttattgccgcacttgctatctggatcgcacaagatgaaaacagcaaagtattaaaacttgtagaatttgcttgggctggttttggtagtgcgtttggccctgtggtacttttctctcttttctggaaacgaatgacatcatcgggcgcaatggccggtatgcttgtaggcgcagtgacagtatttgcttggaaagaagttgttccagctgatactgattggtttaaagtatatgaaatgatcccaggctttgctttcgccagccttgcaattattgttatttcattactttccaataaaccagaacaagatattcttaatacctttgataaagcagaaaaggcttataaggaagcaaaa

SEQ ID NO: 716 - protein, 242 aa, Haemophilus influenzae
  Name: NTH0388
MAADSVKSLIKARRISMGWMVLCLAGAIGIGLFAIPYFFANPAIAGTVNNEPEQVFIELAKLLFNPWIAGILLSAILAAVMSTLSAQLLISSSSITEDFYKGFIRPKASEKELVWLGRIMVLVIAALAIWIAQDENSKVLKLVEFAWAGFGSAFGPVVLFSLFWKRMTSSGAMAGMLVGAVTVFAWKEVVPADTDWFKVYEMIPGFAFASLAIIVISLLSNKPEQDILNTFDKAEKAYKEAK

SEQ ID NO: 717 - DNA, 621 bp, Haemophilus influenzae
  Name: NTH0389
atgatcgactttcgccctttttatcaacaaattgctactacaaatttatcggactggttagaaaccttaccactccaattgaaagaatgggaaactcaaactcatggcgattatgcgaaatggagcaaaattgttgattttctaccagatttacatgctgatgaaatcgatctaaaaagtgcggtgaaatctgaccgcacttttcccctttcagaaggtgaaaaacaacgaattatccatcatttaaaacaattaatgccgtggcgaaaaggaccttatcatcttttcggcattcatgtagattgtgaatggcgttcagattttaaatgggatcgtgttcttcctcatttagctccactgcaaggtcgcactattttagatgtgggctgtggcagcggttatcatatgtggagaatggtaggtgaaggcgcaaaaatggtggtagggattgatcctaccgagcttttcctttgccaatttgaagctgtacgcaaactgcttaataatgatcgtcgagcaaatcttatcccactttgtattgagcaaatgcacccattagcgggatttgacactgtattttcaatgggcgtactttatcatcggaaatcccattatatcatt

SEQ ID NO: 718 - protein, 207 aa, Haemophilus influenzae
  Name: NTH0389
MIDFRPFYQQIATTNLSDWLETLPLQLKEWETQTHGDYAKWSKIVDFLPDLHADEIDLKSAVKSDRTFPLSEGEKQRIIHHLKQLMPWRKGPYHLFGIHVDCEWRSDFKWDRVLPHLAPLQGRTILDVGCGSGYHMWRMVGEGAKMVVGIDPTELFLCQFEAVRKLLNNDRRANLIPLCIEQMHPLAGFDTVFSMGVLYHRKSHYII

SEQ ID NO: 719 - DNA, 252 bp, Haemophilus influenzae
  Name: NTH0390
atgatgactgataagctaaatttaaatgtattagacgctgcattttattcgttagagcaaaccgtagtacaaatttcagacagaaattggtttgatatgcaaccctctattgtacaagataccttaattgcaggtgcaattcagaaatttgaatttgtttatgagttaagtttaaaaatgatgaaacgccaacttcaacaagatgcaattaataccgatgatattggggcttatggatttaaggatattttg

SEQ ID NO: 720 - protein, 84 aa, Haemophilus influenzae
  Name: NTH0390
MMTDKLNLNVLDAAFYSLEQTVVQISDRNWFDMQPSIVQDTLIAGAIQKFEFVYELSLKMMKRQLQQDAINTDDIGAYGFKDIL

SEQ ID NO: 721 - DNA, 768 bp, Haemophilus influenzae
  Name: NTH0391
atgagtaactttggggtcatcaagcgcgatggttctcgtgcggagtttgagattcaacgtatcattaatgccattaaaaaagccgcaagtgcggtcaatatttccgatgaattttattgccaccaaattgggcaagaagtagggaatgaaattttcacccgtcatcaaggcgagattgatattaatcagattcaaaaagtcgttgaagataaattgatggcaagtcgttatcctgagattgctcgtgcgtatatcgaatatcgtcatgatcgtgatttagcgcgagaaaaacgtagccagctaacaaaagaaattgaaggtttgattgaacaaagcaacgtagaattacttaatgaaaacgccaataaagacgcgaaagtgattccaacgcaacgtgatttgcttgctggaattgtggcaaaacattatgccaagcaccatattcttccacgcgatgtggtagaggctcacgaaaaaggtgaaattcattatcacgatttagattacgcgccgttctttccaatgtttaactgtatgttagttgatttagaagggatgctttctcgtggtttcaaaatgggcaatgcggaaatcgaaccccctaaatctatcggcaccgcaacggcagtgacagcacaaattatcgcccaagttgccagccatatttacggcggcacaaccattaatcgtattgatgaagtgctttgccccttatgtgcaaatcagttacgaaaaacatctcaaacatgcccaagaatggaacgtgcc

SEQ ID NO: 722 - protein, 256 aa, Haemophilus influenzae
  Name: NTH0391
MSNFGVIKRDGSRAEFEIQRIINAIKKAASAVNISDEFYCHQIGQEVGNEIFTRHQGEIDINQIQKVVEDKLMASRYPEIARAYIEYRHDRDLAREKRSQLTKEIEGLIEQSNVELLNENANKDAKVIPTQRDLLAGIVAKHYAKHHILPRDVVEAHEKGEIHYHDLDYAPFFPMFNCMLVDLEGMLSRGFKMGNAEIEPPKSIGTATAVTAQIIAQVASHIYGGTTINRIDEVLCPLCANQLRKTSQTCPRMERA

SEQ ID NO: 723 - DNA, 261 bp, Haemophilus influenzae
  n 256, 257, 258, 259, 260: n is any nucleotide
  Name: NTH0392
gtgcctgatgttgaaggttatgccaaagcattgattgaaaaagaatgtttcgatgccttccaatccttagaatatgaagttaatacactacatacttcaaatgggcaaacaccatttgtgacctttggtttttgggtaggtacaagctggcatcccgcttattcagcaagctttttaaaaaacggattcgtggcctcggaaaaacataaaagcctggattccaaaactgttttcccatcaaaaaggtttaaccaannnnnt

SEQ ID NO: 724 - protein, 87 aa, Haemophilus influenzae
  Xaa 86, 87: Xaa is any amino acid
  Name: NTH0392
VPDVEGYAKALIEKECFDAFQSLEYEVNTLHTSNGQTPFVTFGFWVGTSWHPAYSASFLKNGFVASEKHKSLDSKTVFPSKRFNQXX

SEQ ID NO: 725 - DNA, 633 bp, Haemophilus influenzae
  Name: NTH0393
atgtctgttgcggatatggatattccagcccctcagataatgatagatgaattagaaaaatttaatcgtttaggaatttatggttatactgaattaccagccgactattacaagataatcagtgattatattttcgaacaatatcattattctgttctctctgaaaaaattgtattttgcccaagaataatccaagccgtatctatttatatacgagcatttacaaaagaaaatgatggaatatgtattctatcaccttcatatagtccaatattaaacacgataaaattaaatgacagaaaattatatcaatgtcctttggtttatgaaaatagaaagtatcatattgattttcatttattagaggaatgttttaaacattctaaagtatttgttttaatttctcctcataatccaactggaacgatttggaataaagaagtccttattaaaattataaacttagctaaaaaacataatgtatttatcatttccgatgatgtccacgcagactttacactaacaaatgactcccactatttaatatcatcattagatgaatgggtagcaaatcactcaatgatctgtttatccccagcaaaaacttttaatattccctggattggaaatagc

SEQ ID NO: 726 - protein, 211 aa, Haemophilus influenzae
  Name: NTH0393
MSVADMDIPAPQIMIDELEKFNRLGIYGYTELPADYYKIISDYIFEQYHYSVLSEKIVFCPRIIQAVSIYIRAFTKENDGICILSPSYSPILNTIKLNDRKLYQCPLVYENRKYHIDFHLLEECFKHSKVFVLISPHNPTGTIWNKEVLIKIINLAKKHNVFIISDDVHADFTLTNDSHYLISSLDEWVANHSMICLSPAKTFNIPWIGNS

SEQ ID NO: 727 - DNA, 351 bp, Haemophilus influenzae
  n 338, 339, 340, 341, 342: n is any nucleotide
  Name: NTH0394
atgactactccaaaaattctcgttgttgaagatgaaattgtcactcgaaatacgcttaaagggatttttgaagcggaaggatatgatgtgtttgaagcagaaaatggtgttgaaatgcatcatatattggcaaatcataatattaatttggttgtgatggatattaatttaccaggcaaaaacggcttattattggcaagagaactccgtgaagaattaagcttacctcttatttttttaactggtcgagataatgaagtggataaaattttaggtctggaaattggtgccgacgattatttaaccaaaccgggtaccgagtcgatatcgtatacagnnnnnttaattaat

SEQ ID NO: 728 - protein, 117 aa, Haemophilus influenzae
  Xaa 113, 114: Xaa is any amino acid
  Name: NTH0394
MTTPKILVVEDEIVTRNTLKGIFEAEGYDVFEAENGVEMHHILANHNINLVVMDINLPGKNGLLLARELREELSLPLIFLTGRDNEVDKILGLEIGADDYLTKPGTESISYTXXLIN

SEQ ID NO: 729 - DNA, 93 bp, Haemophilus influenzae
  Name: NTH0396
ttggcgtatgctatcaaagctatcattctatctgtgcaacattattgtaacaataaaaaagtgcgggattttttacctgattttccttttttg

SEQ ID NO: 730 - protein, 31 aa, Haemophilus influenzae
  Name: NTH0396
LAYAIKAIILSVQHYCNNKKVRDFLPDFPFL

SEQ ID NO: 731 - DNA, 1332 bp, Haemophilus influenzae
  Name: NTH0397
ttgtatcaagataaaattagtgctgagttagtcggtaaatcaaattctctctctttacatacccaacaggcggcggaattacatcaagatccttattttggcgaagtaaaagtttttactcactcaattgatggcatatttaggggcacatttaataatgctgatgataaggttgaaatcacttatcaaggatgtaccgaaggtttttgctatccgcctgaaactaaagtattacgaattggggatttagccgtttctcaagagcaaattgtcgaaaaaacagttgaaaaaaataccgcacttttatctgaacaagatcgtttagctgatggtttattccatagtaaatggacaatttttggtttctttttattaggattgggactggcttttacgccttgcgtattgccaatgttaccgttgctttctgctattgttatcggtcagcaacaacgtccaaatatgatgcgagcgtttagtttagcttttctttatgttcaaggcatggcactgacttacaccttgttagggctcgcggtagcggctatcggtttgccgtttcaaatcgccttgcaacatccttatgtgatgatagggctttctattttatttgttgctcttgccctttcaatgtttgggttatttactattcaattgccaaatagcttacaaaataaactcaatacatggagccaaaaacaaacctcgggtgcttttggcggagcctttgcaatgggaatgattgctgggctggtggcatcaccttgcacatctgcgccactttctggtgctttactttatgtggcgcaaagtggcgatttattcacaggcgcagcaaccctttatttgctcgcacttggtatgggcgtaccgctaatgttaatcacattgtttggtaataaaattttgccaaaatcaggtgagtggatgaacacagtgaaacaaacattcggctttgtgatgttagcgttacctgtatttttactttctcgtattttgcctgaagtatgggaacctcgcttatgggctgggttagcgacagtattttttatttggtttgcgttgcagatgtctaagaacggttttggttatgctattaaaattattagttttgcgttggctatggttactgtacaacccctgcaaaattggatttggcaaactcaaactacaacacacagtgcggtagaaaatatgccttgttctcaagttaaatttaagcaaattaaaaatactgaagaacttgaccgcactttaaccggaaatccgcatccaattgctatgttcaatttatacgcggattggggggttgcttgtaaagaatttgaaagc

SEQ ID NO: 732 - protein, 444 aa, Haemophilus influenzae
  Name: NTH0397
LYQDKISAELVGKSNSLSLHTQQAAELHQDPYFGEVKVFTHSIDGIFRGTFNNADDKVEITYQGCTEGFCYPPETKVLRIGDLAVSQEQIVEKTVEKNTALLSEQDRLADGLFHSKWTIFGFFLLGLGLAFTPCVLPMLPLLSAIVIGQQQRPNMMRAFSLAFLYVQGMALTYTLLGLAVAAIGLPFQIALQHPYVMIGLSILFVALALSMFGLFTIQLPNSLQNKLNTWSQKQTSGAFGGAFAMGMIAGLVASPCTSAPLSGALLYVAQSGDLFTGAATLYLLALGMGVPLMLITLFGNKILPKSGEWMNTVKQTFGFVMLALPVFLLSRILPEVWEPRLWAGLATVFFIWFALQMSKNGFGYAIKIISFALAMVTVQPLQNWIWQTQTTTHSAVENMPCSQVKFKQIKNTEELDRTLTGNPHPIAMFNLYADWGVACKEFES

SEQ ID NO: 733 - DNA, 1086 bp, Haemophilus influenzae
  n 1081, 1082, 1083, 1084, 1085: n is any nucleotide
  Name: NTH0399
gtggcaaaaattcccgcaccagaaggcgatcctaatgcgccattacaagcattgattattgattcttggttcgataactatttgggcgtggtatctttagtgcgtattaaaaatggggtattacgtaaaggcgataaaattaaagtgatgtccacagggcaaacttacaacgtagatcgtttagggatttttacgccaaaacaagaagatacgactgttttagaatgtggcgaagtgggttgggttgtttgtgcgattaaagatattctaggtgcgccagtgggcgataccttaacccatcaacataattctgcaactgaagtattaccaggctttaaaaaagtaaaaccacaggtttatgctgggctttttcctgtaagttctgatgattatgaagcgtttcgtgatgcgcttggtaaattaagtttaaacgatgcatcacttttctatgaaccagaaacttcgaccgcacttggttttggtttccgttgtggtttccttggacttctgcatatggaaatcattcaagagcgtctagagcgtgagtatgatttagatcttatcacaactgccccaacggtaatttacgaagtgcaattaacgaatggcgaggttgtttatgtggatagtcctgcaaaattgcctccacttaataatattgctgaaattcgcgagccaatcgcagaatgtaatatgctggtgccgcaagaatatttaggtaacgttattaccctttgcgttgaaaaacgtggcgtgcaaaccaatatggtatatcacggtaatcagattgcgctgacttatgaaattccaatgggcgaagtggttttagatttctttgatcgtttaaaatcaacctcgcgtggttatgcttcgttagattacggttttaaacgtttccaagcggcagatatggttcgcgtggatattatgattaacagcgaacgagtagatgcgttggctttaatcgttcataaagataattcacaatatcgtggccgtgaattggttgaaaaaatgcgtgagttaattcctcgtcagcaatttgatatcgctattcaagcagcgatggaaaggggtctcnnnnnt

SEQ ID NO: 734 - protein, 362 aa, Haemophilus influenzae
  Xaa 361, 362: Xaa is any amino acid
  Name: NTH0399
VAKIPAPEGDPNAPLQALIIDSWFDNYLGVVSLVRIKNGVLRKGDKIKVMSTGQTYNVDRLGIFTPKQEDTTVLECGEVGWVVCAIKDILGAPVGDTLTHQHNSATEVLPGFKKVKPQVYAGLFPVSSDDYEAFRDALGKLSLNDASLFYEPETSTALGFGFRCGFLGLLHMEIIQERLEREYDLDLITTAPTVIYEVQLTNGEVVYVDSPAKLPPLNNIAEIREPIAECNMLVPQEYLGNVITLCVEKRGVQTNMVYHGNQIALTYEIPMGEVVLDFFDRLKSTSRGYASLDYGFKRFQAADMVRVDIMINSERVDALALIVHKDNSQYRGRELVEKMRELIPRQQFDIAIQAAMERGLXX

SEQ ID NO: 735 - DNA, 1311 bp, Haemophilus influenzae
  n 1298, 1299, 1300, 1301, 1302: n is any nucleotide
  Name: NTH0400
ttgtcgagccgcctcacttatgtaatgacggtcgcaggcgcaacggtcggtttcggtgcaacttggcgtttcccttatcttgtgggtgaaaatggtggcggtgcttacgttctacttttctgtatcgcaatgattgtaatcggtatcccaatgattttagttgaaaacgtgataggtcgccgtttacgtgtaaattccattgatgcgttcggcgataaaattctcgacaaaggaaaaggcatttctaaatattggaaaatattaggttatatgggcttactcggcgcatttggcattatggcgtattatatggtgcttggtggttgggttatttcttatatcattagcctaatcagcggtacattagacatttcaacccccatcacaaaagacattgccaaaaatttctacgatcttcatatcggcaatagcccttatgaaattatattctacaccctcttatttgttatcgtgaattacattatcttggcaaaaggtatcattggtggaattgaacgttcagtaaaatatttaatgccattactatttatcttcttaattggaatggtaattcgcaacgtaacattaccgggcgcaatggaaggcattacattctatttaaaacctgatttcagcaaaattaccccacaattatttatcttcgttttagggcaagtcttcttcgcattaagccttggttttggtgtattaattaccctttccagttacttaaataaagaagaaaacttaatccatactgcagttattacaggtttcaccaatacaattattgctgtacttgctggctttatgattttcccctcacttttcacttttgggattgaaccaaacgcagggccaactttagtattccaaagtttacctatcgtattttctcacttatgggcaggtaaattctttgcgattatcttcttcggcttattattaattgctgcgctgactacttccatcacaatttatgaagtaatcattacagcattacaagaaaagctcagaatgcgccgtggcaaagccattgtcttaacccttagtggcatttttctattaggcaatatccctgcaattttaggcgataatctatggaaaaacgtaaccattttcggcaaaagcatttttgatttctacgattacgccagtggaaatattctctttatgctgaccgctcttggctgtgctattttcgttggtttcgtgttaaaagatgaagccaaaaaagaactttcttcaacaaaatattcaactttcatcaaaatttggtttaactacgtgaaatttgnnnnnttaattaat

SEQ ID NO: 736 - protein, 437 aa, Haemophilus influenzae
  Xaa 433, 434: Xaa is any amino acid
  Name: NTH0400
LSSRLTYVMTVAGATVGFGATWRFPYLVGENGGGAYVLLFCIAMIVIGIPMILVENVIGRRLRVNSIDAFGDKILDKGKGISKYWKILGYMGLLGAFGIMAYYMVLGGWVISYIISLISGTLDISTPITKDIAKNFYDLHIGNSPYEIIFYTLLFVIVNYIILAKGIIGGIERSVKYLMPLLFIFLIGMVIRNVTLPGAMEGITFYLKPDFSKITPQLFIFVLGQVFFALSLGFGVLITLSSYLNKEENLIHTAVITGFTNTIIAVLAGFMIFPSLFTFGIEPNAGPTLVFQSLPIVFSHLWAGKFFAIIFFGLLLIAALTTSITIYEVIITALQEKLRMRRGKAIVLTLSGIFLLGNIPAILGDNLWKNVTIFGKSIFDFYDYASGNILFMLTALGCAIFVGFVLKDEAKKELSSTKYSTFIKIWFNYVKFXXLIN

SEQ ID NO: 737 - DNA, 618 bp, Haemophilus influenzae
  Name: NTH0401
gtgattttcaaaaaagaaatcgaagcattaattaatcgctttataccaaaactgcaatttgtgatgaaactcatcggtattgcagaacgtattgcaagtccagtcgaagttattcttttcatattggctgcagtgcttggtgcatacacagggttcttactttctgcattgattagctatccaatgttgaataacccagtattacccgcattatttttagcctctggcacatcatctggtattgctgcaaccttcttaattatcttaattgcaggaaaactaaaaggtgattctcacgaatcgcacttcatccacaaatttgaagtgccaattatggtgacagaacttggtttgattgtgtgtttcttcgttggattacattttggtggcggacaaaaaacagttgccttacataatgccttatctggtttttggggagcgatattctgggttggagtattgattatcggtatcttgatcccattaatcgccaatatgtttgtaaatgaccgtttaaaatacaatcgtaactttattatcttggtgtcaatttttgacttaattggggtattctgtttacgtttctttgttttatatgcgggacaactcactgtagcc

SEQ ID NO: 738 - protein, 206 aa, Haemophilus influenzae
  Name: NTH0401
VIFKKEIEALINRFIPKLQFVMKLIGIAERIASPVEVILFILAAVLGAYTGFLLSALISYPMLNNPVLPALFLASGTSSGIAATFLIILIAGKLKGDSHESHFIHKFEVPIMVTELGLIVCFFVGLHFGGGQKTVALHNALSGFWGAIFWVGVLIIGILIPLIANMFVNDRLKYNRNFIILVSIFDLIGVFCLRFFVLYAGQLTVA

SEQ ID NO: 739 - DNA, 414 bp, Haemophilus influenzae
  n 401, 402, 403, 404, 405: n is any nucleotide
  Name: NTH0402
atgttagatcagcaactccttattggaactgtatttttagctgggcttgcttcttttctttcgccttgtattttcccgattattccaatttattttggtattttgagtaaaggtggtaaaaaagtcctgaatacttttttatttattttagggctttcccttacatttgtcagtttaggctttagttttggctttttagggaatattttatttagtaacactacccgcattatcgctggcgttatcgtgattattttgggtattcatcaacttggcatttttaaaattggtttgttggaacgcacgaaattggtggaaataaaaacatcaggaaaatcgaccgcacttgaggcatttgtgcttggtttaacctttagttctggttggacgccttgtatggnnnnnttaattaat

SEQ ID NO: 740 - protein, 138 aa, Haemophilus influenzae
  Xaa 134, 135: Xaa is any amino acid
  Name: NTH0402
MLDQQLLIGTVFLAGLASFLSPCIFPIIPIYFGILSKGGKKVLNTFLFILGLSLTFVSLGFSFGFLGNILFSNTTRIIAGVIVIILGIHQLGIFKIGLLERTKLVEIKTSGKSTALEAFVLGLTFSSGWTPCMXXLIN

SEQ ID NO: 741 - DNA, 252 bp, Haemophilus influenzae
  Name: NTH0403
ttgtggctggccaattttacgaaaccgatcattaaagatgtggtgcattatgaaaccgacaatagcttcaatatgcaacgtaccgaagtgttaagtcgtgcgggcaatgcccatttaggacacgtttttgacgacggcccgaaagataaaggcggtttgcgttattgcattaacagtgcatcaattaaatttattccgttagctgaaatggaaaaggcaggatacggatatttgattcaatccattaaaaaa

SEQ ID NO: 742 - protein, 84 aa, Haemophilus influenzae
  Name: NTH0403
LWLANFTKPIIKDVVHYETDNSFNMQRTEVLSRAGNAHLGHVFDDGPKDKGGLRYCINSASIKFIPLAEMEKAGYGYLIQSIKK

SEQ ID NO: 743 - DNA, 897 bp, Haemophilus influenzae
  Name: NTH0405
atgaaactatcaaaaacatttctatttattaccgcactttgcagtgctacaccaactttagcaatacaaaattcaacatcatcatctggagaacaaaaaatggcaatggaaaatacacaaaacatccgagaaatttatcttgctggtggttgtttctggggtatggaagcatatatggagcgtattcacggtgtgaaagatgcgatttctggctatgccaatggtaatacggggaaaaccagttatcatatgattgggctacccgatcacgcagaaacggtaaaagttacttacgatgcaaaccaaatttcgttagataaattgcttaaatattattttaaagtgattgatccaacgagtgtaaacaaacaaggtaacgaccgtggtagacaatatcgcacagggatttattatcaagatggggcagataaagcggtgatcgaacaagctctcgcccagcttcaaaccaaatataaaaaaccagtgcaagttgaggtacaaccgattaaaaattacatcgtagcggaagaatatcatcaagattatttgaagaaaaatccaaatggttattgccatattgatattaccaaagcagatgaacctgtgattgatgaaaaagattatccgaaaccgagtgatgcagaacttaaagcgaaattgacaccgttgcaatattccgttactcaaaataaacatactgaacgctcttttagtaacgaatattgggataatttccaaccgggtatttatgttgatgtcaccacaggagagcctgttttctcttcaaatgataaatttgaatcaggttgtggctggccaattttacgaaaccgatcattaaagatgtggtgcattatgaaaccgacaatagcttcaatatgcaacgtaccgaagtgt

SEQ ID NO: 744 - protein, 299 aa, Haemophilus influenzae
  Name: NTH0405
MKLSKTFLFITALCSATPTLAIQNSTSSSGEQKMAMENTQNIREIYLAGGCFWGMEAYMERIHGVKDAISGYANGNTGKTSYHMIGLPDHAETVKVTYDANQISLDKLLKYYFKVIDPTSVNKQGNDRGRQYRTGIYYQDGADKAVIEQALAQLQTKYKKPVQVEVQPIKNYIVAEEYHQDYLKKNPNGYCHIDITKADEPVIDEKDYPKPSDAELKAKLTPLQYSVTQNKHTERSFSNEYWDNFQPGIYVDVTTGEPVFSSNDKFESGCGWPILRNRSLKMWCIMKPTIASICNVPKC

SEQ ID NO: 745 - DNA, 453 bp, Haemophilus influenzae
  n 444, 445, 446, 447, 448: n is any nucleotide
  Name: NTH0407
atgcccaatctccccctcttttctaaggtaaaaatctatatgcaatcacattccattccttcactttatcacaaagcgattagttttatggtatcagcgtacttttccattaccttgatgaatgtatttgtcaaaacggcttctcaaacaatccctgcaagtgaaaccttattttcacgctttttaatcggcttgcttttcttacttccttttgtgattaaagatcgcgattttaaagtggatactcgtcaatggaaatttttaatcctgcgtaatgccgcgggtgtatcgaatatgttgattaacttttatgtcgtgaagttcttaccgctttccatcgctgtcttattgatgaatacctctgccctatttatcccgattttattgctttttttccatcaaaaaacaccgcttaatgtgcttttatgtagcttaatcggtttnnnnnttaat

SEQ ID NO: 746 - protein, 151 aa, Haemophilus influenzae
  Xaa 148, 149, 150: Xaa is any amino acid
  Name: NTH0407
MPNLPLFSKVKIYMQSHSIPSLYHKAISFMVSAYFSITLMNVFVKTASQTIPASETLFSRFLIGLLFLLPFVIKDRDFKVDTRQWKFLILRNAAGVSNMLINFYVVKFLPLSIAVLLMNTSALFIPILLLFFHQKTPLNVLLCSLIGXXXN

SEQ ID NO: 747 - DNA, 249 bp, Haemophilus influenzae
  Name: NTH0408
gtgctaggatcggcgaaaaataggagggtatcaatgaacgaaaatgcaccttttattcgtgaaattattgaccgcacatcgcaaataaaaggcgaacgtgtgaagggtgacaatgccaaagaaatcaaggcaaatgttcaaaccattttaaagcacaacttagagcccacaataatgctgacgcaactatttaatttggcgaatcatcatctttacgccaacagcctgctttgggattacagacagaat

SEQ ID NO: 748 - protein, 83 aa, Haemophilus influenzae
  Name: NTH0408
VLGSAKNRRVSMNENAPFIREIIDRTSQIKGERVKGDNAKEIKANVQTILKHNLEPTIMLTQLFNLANHHLYANSLLWDYRQN

SEQ ID NO: 749 - DNA, 1314 bp, Haemophilus influenzae
  Name: NTH0411
atggctagggaatttcaaaccagaatgactactttatcagcaaaatggcaattatttaaaaatcgtttattcaacgtaaatagttctgtaggagccagtttaaaagattcgatgactagcttaatggacggggttggcaatttgcttgataaaatcgagacatggattgatgaacatcctaaattaacctctactatagcaaaaacagcagttgcaatcgggggaagtttaagtctattaggtgcattaagccttgctttaagttttatactttacccagccgcacggctatttttaggcttatccaaattaaacgtaattattcctaaattttcaggacatttatcatctgcagggcggctaatattaagaggattactttctccgctaaaattaattgcactggctatcagtccactagggatagctttattgtccgttgctgcattaatttataaattctggcaacctattaaagccttttttggcggtttttgggagggtttaaaatcaggtctcgcccccgtccttgaaaaattccaaccgctaggcaccgcatttggtgttgtcgtcggttggattgaaaaagcggtgaaatggtttactgatttattgtctccagtacaaagtaccaaagaagatttagatgctgcagtcagtgcaggggaaagattcggaaatggaatggcgaaagcgattgagtttattctgaccccattaacaagattaatggatggtatcaagtggatttctgaaaatatgccaagttgggagggaattaaaaatagtgtatctagtgcatgggaaagaacaaaaaacacttcgagcaacgcttggcaatcaacaaaagaaacggcaggaagtgcttgggaatcatttaaggatttcactggctttggttcaaatggcaaaaaattaccgagtcaaaattggtcaggcggctacactggaaacggtggcaaatatgaacccatgggcattgtccacggtggcgaatacgtgatgaccaaagaagccacatcacgccttggtgtaaatacgctcaacgcccttaattacggcaaacgagcacttattgcgggcggattggggatcagcgttgcaactgccgcccctgtgcaagttgatactcgtgcaccaatttttgctcgtccaatgatgacgcaaaccagccaaccaatgagcgtaaatatcaccatcaatgccgcacaaggcatggacgaacgagccattgcacaacaagtggcaaaacaaatacaacgcattgaaaaccaacgccaagccagagcaagaagttcaatgtgggacagagca

SEQ ID NO: 750 - protein, 438 aa, Haemophilus influenzae
  Name: NTH0411
MAREFQTRMTTLSAKWQLFKNRLFNVNSSVGASLKDSMTSLMDGVGNLLDKIETWIDEHPKLTSTIAKTAVAIGGSLSLLGALSLALSFILYPAARLFLGLSKLNVIIPKFSGHLSSAGRLILRGLLSPLKLIALAISPLGIALLSVAALIYKFWQPIKAFFGGFWEGLKSGLAPVLEKFQPLGTAFGVVVGWIEKAVKWFTDLLSPVQSTKEDLDAAVSAGERFGNGMAKAIEFILTPLTRLMDGIKWISENMPSWEGIKNSVSSAWERTKNTSSNAWQSTKETAGSAWESFKDFTGFGSNGKKLPSQNWSGGYTGNGGKYEPMGIVHGGEYVMTKEATSRLGVNTLNALNYGKRALIAGGLGISVATAAPVQVDTRAPIFARPMMTQTSQPMSVNITINAAQGMDERAIAQQVAKQIQRIENQRQARARSSMWDRA

SEQ ID NO: 751 - DNA, 1026 bp, Haemophilus influenzae
  Name: NTH0412
gtgacgaaccaaaatttagatggtctgacgttaattcaaattcctggatttagtgatgaagaagtcgtatgttcacgtttaaaacgcgatgatatggaaattgttccaaaggcaagtactgaaattcgtatcaacgatattttgcaattagtgggcgatgataattcgcttgccaaaatgcgtttaattatcggatacgaagttgatgcaccaactgttgcctatagtggcgaaattcgttctgagcgtgtggtggtaacgaatgaaaaagtattaggcaaaaagatccgtgccttaggcattcatcaaaaatatggggttgtgatttcacgtttaaatcgtgcagggattgagttagttccaacgggaaataccacactgcaatttggcgatgtgctacatatggtcggacgcagtgatgtactaaatcaggctatttcagtcattggtaatgcacaacaaaaattgcttcaagtgcaaatgttacctgtgtttatcggcattggtttaggagtactcgttggttcgattccattctatattccaggtttccctgttgcgttaaaattagggcttgctggcgggccattggtggttgcgttaatcttagcgagaattggcacgattggtaaactttactggtttatgccgcctagtgctaacttggcgttacgcgaaattgggattgttcttttcttggctgtggtcggtttaaaatcaggcggaagtttctttgatactttagtgaatggttcgggacttgaatggatgggatacggtatttttatcacctttattccattaatgattaccggtattttggctcgtctatatggcaaactgaattaccttacaatctgtggtttacttgcaggttcaatgacggatcctcccgctttagcatttgctaatgaaattaaagaagataacggtgctgcagcactttcttatgccactgtgtatccgttagtgatgttcttgcgaataatgtcgccacagttattggcagtgttattatgggcagca

SEQ ID NO: 752 - protein, 342 aa, Haemophilus influenzae
  Name: NTH0412
VTNQNLDGLTLIQIPGFSDEEVVCSRLKRDDMEIVPKASTEIRINDILQLVGDDNSLAKMRLIIGYEVDAPTVAYSGEIRSERVVVTNEKVLGKKIRALGIHQKYGVVISRLNRAGIELVPTGNTTLQFGDVLHMVGRSDVLNQAISVIGNAQQKLLQVQMLPVFIGIGLGVLVGSIPFYIPGFPVALKLGLAGGPLVVALILARIGTIGKLYWFMPPSANLALREIGIVLFLAVVGLKSGGSFFDTLVNGSGLEWMGYGIFITFIPLMITGILARLYGKLNYLTICGLLAGSMTDPPALAFANEIKEDNGAAALSYATVYPLVMFLRIMSPQLLAVLLWAA

SEQ ID NO: 753 - DNA, 114 bp, Haemophilus influenzae
  n 95: n is any nucleotide
  Name: NTH0413
ttgctaagtgagaacaaaatggcgttagttgaatttttgatggaaaccttagatgggttaaagggaacagatattgtacattttgatgtacgtgngaaaatcatcgattacgga

SEQ ID NO: 754 - protein, 38 aa, Haemophilus influenzae
  Xaa 32: Xaa is any amino acid
  Name: NTH0413
LLSENKMALVEFLMETLDGLKGTDIVHFDVRXKIIDYG

SEQ ID NO: 755 - DNA, 240 bp, Haemophilus influenzae
  n 10: n is any nucleotide
  Name: NTH0414
atgtacgtgngaaaatcatcgattacggataatatgattatttgcacgggtacatcgagccgccaagtttctgcaatggcagataatttaattacagaatgtaaaaaagcaggttttgaaacttttggtgaagagggtaaaaatactgcagattggattgtagtggatcttggtcaagctatcgtacatatcatgcaacgtgacgcccgtgaaatgtatcaattagagaaactttgggcg

SEQ ID NO: 756 - protein, 80 aa, Haemophilus influenzae
  Xaa 4: Xaa is any amino acid
  Name: NTH0414
MYVXKSSITDNMIICTGTSSRQVSAMADNLITECKKAGFETFGEEGKNTADWIVVDLGQAIVHIMQRDAREMYQLEKLWA

SEQ ID NO: 757 - DNA, 378 bp, Haemophilus influenzae
  Name: NTH0416
gtgaaaatcacgttaattgctgttggaacaaaaatgccttcttgggttacaacgggttttgaggaatatcaacgccgtttcccaaaagatatgccttttgaactgattgaaatcccagcaggtaagcgtggaaaaaatgctgatattaaacgtattttagagcaagaagggaaggcgatgttagctgcctgtggaaaaggcaaagttgtgacgttagatattcctggtaaaccttggacgacaccggatctagccgatcatttacaagcgtgtaaaattatggctccacgctttgtttgttgtttgtcgcgccttatggttttctccccgaaagtaaatgccccgccggaattatattttcccccttccccaaggaca

SEQ ID NO: 758 - protein, 126 aa, Haemophilus influenzae
  Name: NTH0416
VKITLIAVGTKMPSWVTTGFEEYQRRFPKDMPFELIEIPAGKRGKNADIKRILEQEGKAMLAACGKGKVVTLDIPGKPWTTPDLADHLQACKIMAPRFVCCLSRLMVFSPKVNAPPELYFPPSPRT

SEQ ID NO: 759 - DNA, 516 bp, Haemophilus influenzae
  n 507, 508, 509, 510, 511: n is any nucleotide
  Name: NTH0417
ttgctaccgccccatgtccctctgttctccgtcccctgttcctcccctaccctccctcctcatatccctttacgccttctccccccctcccccccttttgctttccccccttctctaaccgcttcccccggctttctctctctttgccccctttccttcgtcccgtatccctcgcgtggccctccttttctttttttgtccgccgtcctcctttcgtacctcctttttccccccaatccatcggcctttcgtctgtcgtcccacctttttttttccctccgggcactccgtttgcgtgttttatttgccccgcgcgcgtctcttacccccgtcgaactccctttcgtgtcaccccgccggcgccctgttgccctcccggttcgtctgctttccccgtttgttgcgcttctccgccgcttttgtcatgtttcttcttctcgcctctctccccctttgcccgcgtccggtctttattcgttccggccgcttcgttattcgttggcgtgnnnnnttaat

SEQ ID NO: 760 - protein, 172 aa, Haemophilus influenzae
  Xaa 169, 170, 171: Xaa is any amino acid
  Name: NTH0417
LLPPHVPLFSVPCSSPTLPPHIPLRLLPPSPPFAFPPSLTASPGFLSLCPLSFVPYPSRGPPFLFLSAVLLSYLLFPPNPSAFRLSSHLFFSLRALRLRVLFAPRASLTPVELPFVSPRRRPVALPVRLLSPFVALLRRFCHVSSSRLSPPLPASGLYSFRPLRYSLAXXXN

SEQ ID NO: 761 - DNA, 891 bp, Haemophilus influenzae
  Name: NTH0418
ttgttaatcattgttggaactaatgttgtttatacaaaggagttgagaatgttagacgttgttgatctttctcgcttgcagtttgctttaactgcgttgtatcacttcattttcgtgccgctaacattgggtttatcctttattcttgtaattatggaaactatttatgtggcgacaggtaaagaagtttataaagatatgacaaaattttggggaaagttatttggtattaactttgcccttggggtgaccaccggtattattatggaattccaatttggtactaactggtcttattattctcattacgtgggggatatttttggtgcgccacttgctattgaagcgttacttgccttcttcttagaatccacttttgtggggttatttttcttcggttgggatcgtttatcaaaaggaaaacacttattagcaacttattgtgtggctttcggttctaatttatctgctatgtggattttggttgcaaatggctggatgcaagcaccaacaggttcaaaatttaattttgaaactgtacgtatggaaatgactaacttcttagatctttggttaaaccctgttgcacaaagtaaattcttacatactctttctgcaggttatgtgacaggcgcattttttgttttagccattagctcatactttttactaaaaggccccccccttgaattcgcaaaacgttctttctccgtagctgctacttttgcattcatcgcctcgctttcacagcttcctctccccgctccccctccgtcttgctaccgccccatgtccctctgttctccgtcccctgttcctcccctaccctccctcctcatatccctttacgccttctccccccctcccccccttttgctttccccccttctc

SEQ ID NO: 762 - protein, 297 aa, Haemophilus influenzae
  Name: NTH0418
LLIIVGTNVVYTKELRMLDVVDLSRLQFALTALYHFIFVPLTLGLSFILVIMETIYVATGKEVYKDMTKFWGKLFGINFALGVTTGIIMEFQFGTNWSYYSHYVGDIFGAPLAIEALLAFFLESTFVGLFFFGWDRLSKGKHLLATYCVAFGSNLSAMWILVANGWMQAPTGSKFNFETVRMEMTNFLDLWLNPVAQSKFLHTLSAGYVTGAFFVLAISSYFLLKGPPLEFAKRSFSVAATFAFIASLSQLPLPAPPPSCYRPMSLCSPSPVPPLPSLLISLYAFSPPPPLLLSPLL

SEQ ID NO: 763 - DNA, 177 bp, Haemophilus influenzae
  Name: NTH0419
atgattatagctaatcatcttacagacaaaatcaaccaaaagtgcggtcaaaaatcgaagataattagctatcaaagacgggatggtagtttacctgatttgcgcaatgaactcaatgctagttttggcttaatcctttttatccttggaaaggatcaacaattacattacaaatgt

SEQ ID NO: 764 - protein, 59 aa, Haemophilus influenzae
  Name: NTH0419
MIIANHLTDKINQKCGQKSKIISYQRRDGSLPDLRNELNASFGLILFILGKDQQLHYKC

SEQ ID NO: 765 - DNA, 93 bp, Haemophilus influenzae
  Name: NTH0420
ttgatagctaattatcttcgatttttgaccgcacttttggttgattttgtctgtaagatgattagctataatcatttatattccaatacagat

SEQ ID NO: 766 - protein, 31 aa, Haemophilus influenzae
  Name: NTH0420
LIANYLRFLTALLVDFVCKMISYNHLYSNTD

SEQ ID NO: 767 - DNA, 861 bp, Haemophilus influenzae
  n 174: n is any nucleotide
  Name: NTH0421
atggctacaaattatattttcgtcactggcggtgtggtttcatcgttaggtaaaggcattgcggcagcatcattggcggcaattttagaagcacgtggtttaaacgtaaccattatgaagttagatccatatattaatgtggatcctggtacgatgagcccaacccaacacggngaagttttcgttactcaagatggtgcagaaacagatttagatttaggtcattatgagcgtttcatccgcacgaaaatgaccaaacgtaataacttcactacaggtaaaatttattctgaagtattacgtaaagagcgtcgtggcgattatcttggtgcaacaattcaagtgattccacatatcacgaatgaaattaaagatcgcgtcattgctggtgctcaaggtcacgacgttgtgattgttgaagtgggcggcactgttggggatattgaatcacttccattcttagaagcattacgtcaattagccgttcaagttggtcgtgaacatacgttatttatgcatttaaccttggtgccttacatcccaacggcgggtgaagtaaaaactaaaccaacccagcattcggtaaaagaattgctttctattggtattcaacctgatgtgttgatttgccgttcagatcgtatgattccaccaaatgaacgtgcgaaaattgctttattttgtaatgttgcagaacgtgcagtcatttcattaaaagatgtgaattcaatttatcaaatccccgcattattaaaatctcaaggtttagatgattttgtctgtgaacgtttccgtttaacttgccctgaagcagatcttactgaatgggagcaagtgctttacaagctagccaatccagtg

SEQ ID NO: 768 - protein, 287 aa, Haemophilus influenzae
  Name: NTH0421
MATNYIFVTGGVVSSLGKGIAAASLAAILEARGLNVTIMKLDPYINVDPGTMSPTQHGEVFVTQDGAETDLDLGHYERFIRTKMTKRNNFTTGKIYSEVLRKERRGDYLGATIQVIPHITNEIKDRVIAGAQGHDVVIVEVGGTVGDIESLPFLEALRQLAVQVGREHTLFMHLTLVPYIPTAGEVKTKPTQHSVKELLSIGIQPDVLICRSDRMIPPNERAKIALFCNVAERAVISLKDVNSIYQIPALLKSQGLDDFVCERFRLTCPEADLTEWEQVLYKLANPV

SEQ ID NO: 769 - DNA, 165 bp, Haemophilus influenzae
  n 160, 161, 162, 163, 164: n is any nucleotide
  Name: NTH0422
gtgcagttttggagaaaacagatgtcagaaattcaacattttagccaacaagatatagaaatattgggcgaacaaactttgtatgaaggttttttcacgcttaaacgaatccaatttaaacataaacttttgcgggtaccgagtcgatattcgataacannnnnt

SEQ ID NO: 770 - protein, 55 aa, Haemophilus influenzae
  Xaa 54, 55: Xaa is any amino acid
  Name: NTH0422
VQFWRKQMSEIQHFSQQDIEILGEQTLYEGFFTLKRIQFKHKLLRVPSRYSITXX

SEQ ID NO: 771 - DNA, 1155 bp, Haemophilus influenzae
  Name: NTH0423
gtggaaacgggtaaatgggggatgatgacaggggaggaagagaaggtggaagaaggggggggaaaaggggaagaagggggagggaaaaaaagagaagaggggaacggggggggaaaaggggaaaaagaaggaaagaagggtgacgaactgaagaaggcggtggaaagagtgaatgcggagagagggaagggggaagcaggaagggaggccaaaaagcaacaagagaaaaggaagggaaaggaaaagggaggggaggggaaggggaaaacaaggggagggcggaaaaggaggagagaaagaagatggagagcgaggagagagaagctaaaagtggtcataagtcccgatgcggttcaaggcaaagaggcagctcgagaaattgtgcgaatgagtaaacatgataatgcgcgacaagaagtagatgtattaagtgtggggcgtggtggtggttcattagaagatctttggtgttttaatgaagaagaagtggcgcgagcgatttttcgttcaaccttacatattatcagtgcggtgggacacgaaacagatgtgacgattgccgattttgttgcagatcttcgtgcgccgaccccttctgctgcggctgaattagttagtcgtaatcaagatgaattattgcagcaacttcgccatcaacagcaacgtttagatatggcatttgatcgtttatttacgcgaaaaagccagcgtttgaaacagcttgccttacgattgcaaaatcaacatccacagaatcagctacgtgctcaacaagcgaagaatgaacagcttacacatcgcttgcaacttgcaatattgcgtcagtttgaaaatacacaacaaaaattcaccgcactttctgttcgtttaaaacaaaatccattgccatatcgcatacaacgttatcaacaaggcttagagcagttaaaagtgcggttaaatttttgcgtaaatcgccaagtgacggaacgtcaaaataaactggcaacattatgcggaaaactggatggcttaagcccattaaaagtcttggcgagaggttattccattgcggaaaatccgcaaggtaaagccattgttagcgtgaaagatgtcaatcaaggggacttcattacaactcaagtggctgatggaaaaattgtgagtaaggttttg

SEQ ID NO: 772 - protein, 385 aa, Haemophilus influenzae
  Name: NTH0423
VETGKWGMMTGEEEKVEEGGGKGEEGGGKKREEGNGGGKGEKEGKKGDELKKAVERVNAERGKGEAGREAKKQQEKRKGKEKGGEGKGKTRGGRKRRRERRWRARREKLKVVISPDAVQGKEAAREIVRMSKHDNARQEVDVLSVGRGGGSLEDLWCFNEEEVARAIFRSTLHIISAVGHETDVTIADFVADLRAPTPSAAAELVSRNQDELLQQLRHQQQRLDMAFDRLFTRKSQRLKQLALRLQNQHPQNQLRAQQAKNEQLTHRLQLAILRQFENTQQKFTALSVRLKQNPLPYRIQRYQQGLEQLKVRLNFCVNRQVTERQNKLATLCGKLDGLSPLKVLARGYSIAENPQGKAIVSVKDVNQGDFITTQVADGKIVSKVL

SEQ ID NO: 773 - DNA, 255 bp, Haemophilus influenzae
  Name: NTH0424
ttgaaaattcatggaaattgctcgggcgcggatttattcatttcagcattcggtaaattaactaattctttcccttcaaaaatggcagagcctcccacttcacccttggctgccaataaacccattaaagcaaaggctgtttgtgacttgcctgatccactttcgcctacaatgcccagcgtgcttcctgcattcagcgtgaagtttaagtcattcactgctgtaacgacgccatctggtgttttgaagcgaacg

SEQ ID NO: 774 - protein, 85 aa, Haemophilus influenzae
  Name: NTH0424
LKIHGNCSGADLFISAFGKLTNSFPSKMAEPPTSPLAANKPIKAKAVCDLPDPLSPTMPSVLPAFSVKFKSFTAVTTPSGVLKRT

SEQ ID NO: 775 - DNA, 276 bp, Haemophilus influenzae
  Name: NTH0425
atgaatcctttattagatgtaaaaaatctctacgttcgcttcaaaacaccagatggcgtcgttacagcagtgaatgacttaaacttcacgctgaatgcaggaagcacgctgggcattgtaggcgaaagtggatcaggcaagtcacaaacagcctttgctttaatgggtttattggcagccaagggtgaagtgggaggctctgccatttttgaagggaaagaattagttaatttaccgaatgctgaaatgaataaatccgcgcccgagcaatttcca

SEQ ID NO: 776 - protein, 92 aa, Haemophilus influenzae
  Name: NTH0425
MNPLLDVKNLYVRFKTPDGVVTAVNDLNFTLNAGSTLGIVGESGSGKSQTAFALMGLLAAKGEVGGSAIFEGKELVNLPNAEMNKSAPEQFP

SEQ ID NO: 777 - DNA, 933 bp, Haemophilus influenzae
  Name: NTH0426
atgacagattatcgtactcagccgattaatcagaaaaatgcggattttgtggaacaagtggctgaccgtattgaagaaatgcaactggaaggccgcagcctatggcaagatgcgaaacgccgttttttccgcaacaaagcggccgttgtcagtctgattattttggcgtttattattatatttatcaccgtagcgccttggttcttcccatttacctatgaagataccgattggaatatgatgagctccgcaccaacaatggaaggctatcacttcttcggtaccgatgcctcaggtcgagacttgttggtacgtactgctatcggtggacgtatttcattattggtcggtattgctggtgctttcatttccgtgactatcggcacaatttatggggctatttccggttatgtaggcggtaaaacagatatgctgatgatgcgctttttggaaattcttagctcatttccatttatgtttttcgtgattttgttggtgaccctttttggccaaaacattttcttaatttttatcgctatcggggccattgcctggcttggtcttgcacgtattgtacgcggacaaaccctcagcctaaaaaataaagaattcgtcgaagccgccatcgtttgtggcgtacctcgtcgccaaatcattttgaaacacattattccgaatgtattaggcttagtggcagtttatgcctcgcttgaagtgcctgggctcattctatttgaatcattcttaagcttcttaggattaggtacacaagagccgatgagtagttggggcgcactcttaagtgatggtgctgcacaaatggaagtgtcgccttggttattaattttcccggcatttttcctttgccttaccctattttgttttaactttatcggtgacgggttgcgtgatgcgctcgatccgaaagataga

SEQ ID NO: 778 - protein, 311 aa, Haemophilus influenzae
  Name: NTH0426
MTDYRTQPINQKNADFVEQVADRIEEMQLEGRSLWQDAKRRFFRNKAAVVSLIILAFIIIFITVAPWFFPFTYEDTDWNMMSSAPTMEGYHFFGTDASGRDLLVRTAIGGRISLLVGIAGAFISVTIGTIYGAISGYVGGKTDMLMMRFLEILSSFPFMFFVILLVTLFGQNIFLIFIAIGAIAWLGLARIVRGQTLSLKNKEFVEAAIVCGVPRRQIILKHIIPNVLGLVAVYASLEVPGLILFESFLSFLGLGTQEPMSSWGALLSDGAAQMEVSPWLLIFPAFFLCLTLFCFNFIGDGLRDALDPKDR

SEQ ID NO: 779 - DNA, 696 bp, Haemophilus influenzae
  n 25, 60: n is any nucleotide
  Name: NTH0427
ttggtccttcttttaaatataaagncccatccagtcaatgatttaatcgcgtcagctttncctgtttccataaatttgggaatggtggccttcgcctttgcagtcgtgctaggagtaacagcaggtacgctcgccgctctcaatcaaaatagccgttgggattatattttgatgagtttctcgatgcttggggtcattatgccaagcttcgtatttgcacctgttttagtgctaattttcgccatttatctaggatggctgccagctggcggttggaacggcggtaccgccatgtacatgatcttacctgtagcctccttaactatcgcttatgttgcagggattgcgcgtatcatgcgtggttcgatgattgaagtgttacattccaactttattcgaaccgccaaagctaaaggactttccatgtcgagaatcattttaaaacatgctttgcgtcccgcacttttacccgtgataacctatttaggacctgctttcgtagggattattactggctcaatggtcatcgaaagcgtatttggtttacctggcatggggttattatttgtaaacggcgcattgaaccgcgattactctttagttttgagcctcaccattttagtgggggcattaaccattttatttaatgcgattgtggatattttatacgccatcatcgatccaaaaattcgttat

SEQ ID NO: 780 - protein, 232 aa, Haemophilus influenzae
  Xaa 9, 20: Xaa is any amino acid
  Name: NTH0427
LVLLLNIKXHPVNDLIASAXPVSINLGMVAFAFAVVLGVTAGTLAALNQNSRWDYILMSFSMLGVIMPSFVFAPVLVLIFAIYLGWLPAGGWNGGTAMYMILPVASLTIAYVAGIARIMRGSMIEVLHSNFIRTAKAKGLSMSRIILKHALRPALLPVITYLGPAFVGIITGSMVIESVFGLPGMGLLFVNGALNRDYSLVLSLTILVGALTILFNAIVDILYAIIDPKIRY

SEQ ID NO: 781 - DNA, 948 bp, Haemophilus influenzae
  Name: NTH0428
atgacaatttatgcagacaattcttattctatcggaaatacgccgcttgtgcgtttaaaacactttggccataacggcaatgtggtggtaaaaattgaaggtcgtaacccaagctacagcgtaaaatgccgtattggggcgaatatggtgtggcaagcagaaaaagatggcacgctcacaaaagggaaagagattgtagatgcaacgagtggtaacacgggcattgctttggcttatgttgcggcggctagaggttataaaatcacgctcactatgccagaaacaatgagtcttgaaagaaaacgcttattgtgcggattgggtgtaaaattagtgcttaccgaaggtgcaaaaggaatgaaaggtgctattgcgaaagcagaagaaattgttgcttctgatccaagccgctatgtcatgcttaaacaatttgaaaatccagccaacccacaaattcatcgagaaacaacagggcctgaaatttggaaagatacggatggcaaagtcgatgttgttgttgctggcgtaggaacaggtggttcgattacgggtatttctcgcgcgattaaattagattttggtaaacaaatcacttctgttgccgttgagccagtggaatctccggtcattagtcaaactttagcgggtgaagaagtaaaaccaggtccacacaaaattcaaggtatcggtgcgggtttcattcccaaaaatttagatttatctattattgatcgcgtagaaactgttgatagtgataccgcacttgccacagctcgtcgcttaatggcggaagaaggcattcttgcaggtatttcatctggtgcagctgtcgcggctgcagatcgcttagctaaattaccagaatttgccgataaactcattgttgttattttgccttcagcttctgaacgctacttaagcacagcactgtttgaagggattgaggga

SEQ ID NO: 782 - protein, 316 aa, Haemophilus influenzae
  Name: NTH0428
MTIYADNSYSIGNTPLVRLKHFGHNGNVVVKIEGRNPSYSVKCRIGANMVWQAEKDGTLTKGKEIVDATSGNTGIALAYVAAARGYKITLTMPETMSLERKRLLCGLGVKLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 783 - DNA, 90 bp, Haemophilus influenzae
  n 81, 82, 83, 84, 85: n is any nucleotide
  Name: NTH0429
gtggtgaaacacatctttgttctgctgtataaagagagtagagaacaatatcttgcaattaaaaaatttattttagaaacnnnnnttaat

SEQ ID NO: 784 - protein, 30 aa, Haemophilus influenzae
  Xaa 28, 29: Xaa is any amino acid
  Name: NTH0429
VVKHIFVLLYKESREQYLAIKKFILETXXN

SEQ ID NO: 785 - DNA, 858 bp, Haemophilus influenzae
  Name: NTH0430
atgattttctctaaaaataagtatccacctttacatgaattcacggcattaatgaatagagtcgataattttcttaatcatgatgcagaaaatagaattgcatactataagaaacgtagtggtattgatttagaaaaagatgtatatgaggctatttgttattgtgctcaaaatactcctttcgaagacactattagtttagtatcagggaaacattttccagacattgtagctagtcaatattatggtattgaagtaaaaagtacacaaggagataaatggacttcaattggcagttctattcttgagtctacacgaattccaaatatagaaaaaattttcttaacatttggtaaattaggtggaaatattaaattcctatccaaaccatatgagtcgtgtttatgtgatatagctgtaacccattaccctagatataaaatagatatgttattagaaaagggggagagcatatttgaaaaaatggagaccacatatgattctctccgagaattagataatccaataactcctgtagctaaatactataaatctctattaatagaaggtgaaagtttatggtggacttcaaacaatgttttagatgatattgcccctcccaaagttagacactggaaggtaatagaaaaatatgagcgagatatgttaattgctcaagcatatgctttcttccctgaaacgatcttaggaaatcctagaaataaatatgataaattcgcactatggctagtgactaaacatggagtaataaacactagtttaagagatgagttttctgcaggagggcaacaaaaaataactgatacttgtggtgaaacacatctttgttctgctgta

SEQ ID NO: 786 - protein, 286 aa, Haemophilus influenzae
  Name: NTH0430
MIFSKNKYPPLHEFTALMNRVDNFLNHDAENRIAYYKKRSGIDLEKDVYEAICYCAQNTPFEDTISLVSGKHFPDIVASQYYGIEVKSTQGDKWTSIGSSILESTRIPNIEKIFLTFGKLGGNIKFLSKPYESCLCDIAVTHYPRYKIDMLLEKGESIFEKMETTYDSLRELDNPITPVAKYYKSLLIEGESLWWTSNNVLDDIAPPKVRHWKVIEKYERDMLIAQAYAFFPETILGNPRNKYDKFALWLVTKHGVINTSLRDEFSAGGQQKITDTCGETHLCSAV

SEQ ID NO: 787 - DNA, 348 bp, Haemophilus influenzae
  Name: NTH0431
atgggaaaccattgtcaagggcaggttgaaattaaacttaattctgttggcccaacaatccgatctgaacatcatggtaatattgaatatcgtagactaagcatagagcatggagggaaatatattaacgaattatctaaaggcatgctcgaacgtcgtcttactataagagaatgtgctagattacaaacgtttcctgatagataccaatttattttacctaaaacagcagaaaacgtttctgtttcagctagtaatgcctataaaattattggcaatgcggtaccatgtgtattagcttataatattgctaaaaatatagaaaaaaaatggaatctttattttaaa

SEQ ID NO: 788 - protein, 116 aa, Haemophilus influenzae
  Name: NTH0431
MGNHCQGQVEIKLNSVGPTIRSEHHGNIEYRRLSIEHGGKYINELSKGMLERRLTIRECARLQTFPDRYQFILPKTAENVSVSASNAYKIIGNAVPCVLAYNIAKNIEKKWNLYFK

SEQ ID NO: 789 - DNA, 636 bp, Haemophilus influenzae
  Name: NTH0432
gtggtaaaaggcatttttgcgatcggtcgtgcgatgtttatggcggtagcaagtaacccaattttgcttgcgattagtgcggtgattggcttggttatcttgcttgttgtgtattgggatgaagtgaaagcctttgccattgctgcgtgggaagccatttccacaaaagcggcggagatttggcaaagtatcatcactggtgcaagcgagatgtgggataacatcacaaataaagcagcggaaagctgggataatgtaaagaaagatgctggcgaaaaatggaatagcgttacgacgatgtttaaaaatgcgtggcaaaaatctatcgataccgtggtgggctggtttaattcacttattccgagctggattagagatttgttttctgacggggcgaaagcagaagttaagctgagcggcgaagccttaactacaccagtaagcggccacgtatcgccacagcggttaggctatggcggtcgtcctatttttgcacctaatcagaatatgacgcaaaccaataacttcaatattcaaggttccgctaatcctagcggtgtggctaatgcggtatcagacaaattaagccgtggttcatctacatcgtttggaatgggggcgattgaatatgctggg

SEQ ID NO: 790 - protein, 212 aa, Haemophilus influenzae
  Name: NTH0432
VVKGIFAIGRAMFMAVASNPILLAISAVIGLVILLVVYWDEVKAFAIAAWEAISTKAAEIWQSIITGASEMWDNITNKAAESWDNVKKDAGEKWNSVTTMFKNAWQKSIDTVVGWFNSLIPSWIRDLFSDGAKAEVKLSGEALTTPVSGHVSPQRLGYGGRPIFAPNQNMTQTNNFNIQGSANPSGVANAVSDKLSRGSSTSFGMGAIEYAG

SEQ ID NO: 791 - DNA, 570 bp, Haemophilus influenzae
  Name: NTH0433
atgtcaaacttaaccattctcaacaattctattcgttcatacgaaaatcttttctctttaaacgatttacacgttgctagcggtcgaaaagagaaacaccgcccaaatcaatttatccgcttagaaaccactcaagaattaattaaagaaattcaagacgaagatctaaatgcgcagatctgcgcatttaaaactattcgcggcactcaaggcggcacttacgcttgcgaagaacttgttttagcctacgcaatgtggattagcccaaaattccatttgatcgtattacgtgcgttcttagcaatgcaccgtaacgagccaaaacaacttacactaccgcttgtcagtgatgaacttaaacaggcaatggcaaaaatggtaacttacgcatcacaatatgccaacttccagcaagccattacaggcgcacaactggaagatcaaaaacgccttgtggagttctttttttccagcattccaaatggagatagctatctgtttgtgttcaacaaaaacattcagcaagatatacaacaggcaagcgatttactgcataagctaatcacacaa

SEQ ID NO: 792 - protein, 190 aa, Haemophilus influenzae
  Name: NTH0433
MSNLTILNNSIRSYENLFSLNDLHVASGRKEKHRPNQFIRLETTQELIKEIQDEDLNAQICAFKTIRGTQGGTYACEELVLAYAMWISPKFHLIVLRAFLAMHRNEPKQLTLPLVSDELKQAMAKMVTYASQYANFQQAITGAQLEDQKRLVEFFFSSIPNGDSYLFVFNKNIQQDIQQASDLLHKLITQ

SEQ ID NO: 793 - DNA, 414 bp, Haemophilus influenzae
  Name: NTH0434
atgagcatagtaaaccttttattttcagcccttgcgggcaagcgtacgacaattggtgtattggaattggacgcacttttaaccgaaaacacatcactttctagccaaatcacggaatatcccattgaagacggtacggtaatttccgatcacattacacgggaaagtgagcggttaagccttagtggtgtgattactggcacaggaacattgtttaatgttggcttagggaaatataaattgattgcagcaaaagagacgttgcgagaattacacgctaagcgtgaattagtgacgattgttaccggtcttgatgtgtatgaagattttgctattgaaagccttgagattgagcgcaacagtgatgacggcgagcggttaaatattagtgcggaatttcgaaaaatcaaaaag

SEQ ID NO: 794 - protein, 138 aa, Haemophilus influenzae
  Name: NTH0434
MSIVNLLFSALAGKRTTIGVLELDALLTENTSLSSQITEYPIEDGTVISDHITRESERLSLSGVITGTGTLFNVGLGKYKLIAAKETLRELHAKRELVTIVTGLDVYEDFAIESLEIERNSDDGERLNISAEFRKIKK

SEQ ID NO: 795 - DNA, 90 bp, Haemophilus influenzae
  Name: NTH0435
ttgataagtggtgagatgggtaaaattgccaaaattattggtgtctttcttttatcccagtccattcgcgaaactcgaaatttttgggca

SEQ ID NO: 796 - protein, 30 aa, Haemophilus influenzae
  Name: NTH0435
LISGEMGKIAKIIGVFLLSQSIRETRNFWA

SEQ ID NO: 797 - DNA, 1023 bp, Haemophilus influenzae
  n 1014, 1015, 1016, 1017, 1018: n is any nucleotide
  Name: NTH0436
ttgaacaaagaagaaacaatgagttatccattagaagaagttaataaacgtcgcacttttgcgattatttcccaccctgatgcgggtaaaacaacgattactgaaaaagtacttttatacggcaatgcaattcaaactgcaggttctgtaaaaggcaaaggctcggcggctcacgcgaaatctgactggatggaaatggaaaaacaacgtgggatttcgattaccacttctgtgatgcaatttccttataataattgtttagtgaatttgcttgatacccccggacacgaagatttctctgaagatacttaccgcactttaaccgctgtggatagctgtttgatggttattgactctgccaaaggggtggaggaacgtacgattaagttgatggaagtcacacgtttacgtgatacgcccattattacgtttatgaataaactcgaccgtgatattcgtgatccgatggaattgttggacgaggtggaaaatgtgttgaaaattcgttgtgcgccaattacttggccaattggctgtgggaagttgtttaagggcgtttatcatcttgcaaaagatgaaacctatttatatcaatcagggcagggttcaaccattcaggcagtgcgtgttgttaaaggcttgaataatcctgaattagatgttgctgttggcgatgatttagcacaacagcttcgtgatgaattggaattggtgcaaggcgcaagtaatgaatttgagcaagatgcctttattaagggcgagcttacccctgtatttttcgggacagcattaggtaattttggggtggatcattttcttgatggcttaacacaatgggcgccgaaaccgcaatctcgtcaagcggatacaagaacggtggaaagtgcggaagaaaaattcagtggttttgtgtttaaaattcaagccaatatggatccgaaacaccgtgacagagtggcgtttatgcgtgtggtttcgggcaaatatgaaaaagggatgaaacttaaacacgtnnnnnttaat

SEQ ID NO: 798 - protein, 341 aa, Haemophilus influenzae
  Xaa 339, 340: Xaa is any amino acid
  Name: NTH0436
LNKEETMSYPLEEVNKRRTFAIISHPDAGKTTITEKVLLYGNAIQTAGSVKGKGSAAHAKSDWMEMEKQRGISITTSVMQFPYNNCLVNLLDTPGHEDFSEDTYRTLTAVDSCLMVIDSAKGVEERTIKLMEVTRLRDTPIITFMNKLDRDIRDPMELLDEVENVLKIRCAPITWPIGCGKLFKGVYHLAKDETYLYQSGQGSTIQAVRVVKGLNNPELDVAVGDDLAQQLRDELELVQGASNEFEQDAFIKGELTPVFFGTALGNFGVDHFLDGLTQWAPKPQSRQADTRTVESAEEKFSGFVFKIQANMDPKHRDRVAFMRVVSGKYEKGMKLKHVXXN

SEQ ID NO: 799 - DNA, 885 bp, Haemophilus influenzae
  Name: NTH0437
gtgcggttggttttcttagaaatattggtctgctttgtacaaagacaaattttcgcttatactacgcaagttttttacgctaacaacataggaaaaattatgggtttcttaacaggtaaacgcattttagtcacaggtcttgcaagcaatcgttccatcgcttacgggatcgcaaaatcaatgaaagaacaaggtgcagaacttgctttcacttatttaaacgataaattacaaccgcgcgtagaagaatttgccaaagaatttggttctgatatcgtgcttcctttagatgtggcaaccgatgaaagcatccaaaactgctttgcagaattaagtaagcgttgggataaatttgatggttttattcacgcaatcgcatttgcaccaggtgatcaattagacggcgattacgtaaatgcggcaactcgtgaaggctatcgtatcgctcatgatattagcgcatacagctttgttgcaatggcacaagcggcacgtccttacttaaatccaaatgccgcattattaacgctttcttatttaggtgcagaacgtgcaattcctaactacaacgtaatgtgcctagcaaaagcctctcttgaagctgcaacgcgcgtgatggctgctgatttagggaaagaaggtattcgtgtgaatgcaatctctgcaggcccaatccgcaccttagccgcatcaggcattaaaaacttcaaaaaaatgctttccacctttgagaaaacggctgcattacgtcgcactgtcactatcgaagatgtgggtaactcagcggcatttttatgctctgatttagcatcgggcattacaggcgaaatcgttcacgttgatgcaggtttcagcatcactgcaatgggcgaattaggcgaagaa

SEQ ID NO: 800 - protein, 295 aa, Haemophilus influenzae
  Name: NTH0437
VRLVFLEILVCFVQRQIFAYTTQVFYANNIGKIMGFLTGKRILVTGLASNRSIAYGIAKSMKEQGAELAFTYLNDKLQPRVEEFAKEFGSDIVLPLDVATDESIQNCFAELSKRWDKFDGFIHAIAFAPGDQLDGDYVNAATREGYRIAHDISAYSFVAMAQAARPYLNPNAALLTLSYLGAERAIPNYNVMCLAKASLEAATRVMAADLGKEGIRVNAISAGPIRTLAASGIKNFKKMLSTFEKTAALRRTVTIEDVGNSAAFLCSDLASGITGEIVHVDAGFSITAMGELGEE

SEQ ID NO: 801 - DNA, 192 bp, Haemophilus influenzae
  n 121: n is any nucleotide
  Name: NTH0438
atgtggtggattggttgttgcaataagtctaaaaacgttgaaaattttcaccgcacttttgtgtttaacgcttatgccgacgcgcgtttcccaacgcgtgccctagaaattaaagtgcggngagtttttgaggtgtttttattgaagttaggcacacgctgggaagagtgcgccatcgtgggggcagtactg

SEQ ID NO: 802 - protein, 64 aa, Haemophilus influenzae
  Xaa 41: Xaa is any amino acid
  Name: NTH0438
MWWIGCCNKSKNVENFHRTFVFNAYADARFPTRALEIKVRXVFEVFLLKLGTRWEECAIVGAVL

SEQ ID NO: 803 - DNA, 1152 bp, Haemophilus influenzae
  n 16, 26: n is any nucleotide
  Name: NTH0440
atgccctgcaggtcgnactctatagnatccccctcgggtgttcgtcgttccggtaaatcggtgctactcatgcaataccgtgattaccttcaacaacaaggcattgcttccgaaaatattctttatctcaattttgaatcttttgaatatcaatgggtgaaagacgctcaagattttcaacagctgattcaagaaaaaatgccgtcttctcaaaagaaaatctactttctgattgatgaaattcagtttgtggaaggttggcaaaaaatcgtcaatgggcttcgcgtgagttttaacgctgacattgtgattacaggttccaatgctaacttgctttccggcgagcttgcgacgttgttaagcggtcggtatgtagaaatcaaaatttatccgctttctttcaaagaatttttgcacgccaaaaatgtggatagccaatcaagattggtcgataaactctattcggaatatgaaaaatatggcggtttccccagcgttgtgatggctgatgagcctttaaaagaaacgattttatcgggtatttttgattccatcgtgctaaatgatattgcccaccgagctggagtgaaagacacgcatattcttaaaagtgtaattctctttttagcggataacgtagggcagttggtgaatccaagcaaaattagcaacacgctcacgtccgaacgtgttcccacttcaaatcacaccataagcaaatatcttgatttgttagaaaatgcctttcttttttataaagcaaaacaatacgatattcgcggaaaaggctatttaaaaaccaatgccaaatattttattgtggataacggtttaagacgacacgctatcggcaaaaaaggtgcgaattatgccaatcgcctagaaaatattgtctttattgaattgcttagacgaggttataccgttgatgtgggtaaactcgacagcaaagaaattgattttatcgcccgaaaagctgatgaaattttatatgtacaagtcgcttttgaaatccctgaaaatacccacgaaacagataatcttttgcatattaaagataactataaaaagattttaattacggggaaatattacgaacaaacagagattgatgggattgaagtgatttatgtggtggattggttgttgcaa

SEQ ID NO: 804 - protein, 384 aa, Haemophilus influenzae
  Xaa 6, 9: Xaa is any amino acid
  Name: NTH0440
MPCRSXSIXSPSGVRRSGKSVLLMQYRDYLQQQGIASENILYLNFESFEYQWVKDAQDFQQLIQEKMPSSQKKIYFLIDEIQFVEGWQKIVNGLRVSFNADIVITGSNANLLSGELATLLSGRYVEIKIYPLSFKEFLHAKNVDSQSRLVDKLYSEYEKYGGFPSVVMADEPLKETILSGIFDSIVLNDIAHRAGVKDTHILKSVILFLADNVGQLVNPSKISNTLTSERVPTSNHTISKYLDLLENAFLFYKAKQYDIRGKGYLKTNAKYFIVDNGLRRHAIGKKGANYANRLENIVFIELLRRGYTVDVGKLDSKEIDFIARKADEILYVQVAFEIPENTHETDNLLHIKDNYKKILITGKYYEQTEIDGIEVIYVVDWLLQ

SEQ ID NO: 805 - DNA, 198 bp, Haemophilus influenzae
  Name: NTH0441
gtggcagatgaactctttgctcgaggagaagcgaatattggcgtgactaaagtaggcgacaaacaatcactgaaaatgactaccctaagcccgattgcaacattggaaaatgttaaagcgttattaactcaagtactaacagaagcaaatcgcattaaagatgacatcaaaaatggcacttacacaccacccattgat

SEQ ID NO: 806 - protein, 66 aa, Haemophilus influenzae
  Name: NTH0441
VADELFARGEANIGVTKVGDKQSLKMTTLSPIATLENVKALLTQVLTEANRIKDDIKNGTYTPPID

SEQ ID NO: 807 - DNA, 666 bp, Haemophilus influenzae
  n 653, 654, 655, 656, 657: n is any nucleotide
  Name: NTH0442
ttgaaaatcatgccagaacttcctgaagtcgaaactgcactacgtggtattagcccttatcttaagaattttacgattgagaaagttgtcgtgcgcaagcctaaattgcgctgggctgtatcagaagaattaataacgctaaaaaatgtaaaaattgtcgatctcactcgtcgagcaaaatatttgattattcacacggaaaaaggctatatcatcgggcatttaggtatgtctggatctgttcgaatcgtgccacaggatagtgcaatagataaacatgatcatattgatattgtagtgaataatggcaagttattacgctataacgatcctcgccgtttcggtgcttggttgtggacggagaatctagatgactttcatcttttcttaaagttaggccctgaaccactttctgatgaatttaatgcagaatatttattcaaaaaatctcgtcaaaaatctaccgcacttaaaactttcttgatggataacgctgtggtagtgggcgttggaaatatttatgcgaatgaaagtttgtttatttgtgggattcatccccttaaactcgctaaaaatttgacgcgcaatcaatgtttctctttagtgaaccgattaaaggaggtttgggaaaaacccatattcaagtgggacannnnnttaattaat

SEQ ID NO: 808 - protein, 222 aa, Haemophilus influenzae
  Xaa 218, 219: Xaa is any amino acid
  Name: NTH0442
LKIMPELPEVETALRGISPYLKNFTIEKVVVRKPKLRWAVSEELITLKNVKIVDLTRRAKYLIIHTEKGYIIGHLGMSGSVRIVPQDSAIDKHDHIDIVVNNGKLLRYNDPRRFGAWLWTENLDDFHLFLKLGPEPLSDEFNAEYLFKKSRQKSTALKTFLMDNAVVVGVGNIYANESLFICGIHPLKLAKNLTRNQCFSLVNRLKEVWEKPIFKWDXXLIN

SEQ ID NO: 809 - DNA, 480 bp, Haemophilus influenzae
  Name: NTH0443
ttgatgaagtaccagaaaaaaaccgatgggaaagcgggcttttatcatttagaagatttttctggcgatattgagcaagtagagcttacctatttgattcgtgattttgacgaacagaatttcgcacaaagaaaagcttttattaaaaatcaggtggaaaaatttaatgctaaaaaaggtttgaaaaagcctatagagttagaaattcaagatagctaccaaaatatgtatgatgtggtaaaaaacgttcctcaatcaattgaacttgctgatcgcgcaatgaaagcggtgggaattaaaccaaatcataagccgattcgaggcggtacagatggggcatttttagcctctaaaggtttagcatgcccaaatatttttactggcggctataatttccatagtaaacacgagttggtttctttacaaggcatggaaaatactgtccaagtaattatcgaaatgctgaaatgtaaagatttg

SEQ ID NO: 810 - protein, 160 aa, Haemophilus influenzae
  Name: NTH0443
LMKYQKKTDGKAGFYHLEDFSGDIEQVELTYLIRDFDEQNFAQRKAFIKNQVEKFNAKKGLKKPIELEIQDSYQNMYDVVKNVPQSIELADRAMKAVGIKPNHKPIRGGTDGAFLASKGLACPNIFTGGYNFHSKHELVSLQGMENTVQVIIEMLKCKDL

SEQ ID NO: 811 - DNA, 534 bp, Haemophilus influenzae
  Name: NTH0444
ttgactgcactgaggagagtttttatggctatcgcattgatttttgactgtggtgcaacaaatttacgcaccattgcgataaatgaaaaaggacaaattcttgcctctcatcaccttgctaataatacaaaacaaggaatcgaatcatctgattatcatatttgggatattgaagaaatctggcaaaaattaatctcttgtgcaactcaaaccttcaatcaattaatacaacaaggcattgatttaaaagatattgtaggaatatctgttaccactttcggcgtggatggcgcaccttttgataaaaatgatcaacaactttatccgattatttcatggaaatgcccacggaccataccagtaatggaaaatctatctaatcaattagatatcaaatctctttatcaacgtaacggcattggtcaatacagttttaatactttatttaaattacattggttaaaaacacacaagccagatgttttccaaaaaatggctaaattcgtttttatttcgccaatgctcactcaacgc

SEQ ID NO: 812 - protein, 178 aa, Haemophilus influenzae
  Name: NTH0444
LTALRRVFMAIALIFDCGATNLRTIAINEKGQILASHHLANNTKQGIESSDYHIWDIEEIWQKLISCATQTFNQLIQQGIDLKDIVGISVTTFGVDGAPFDKNDQQLYPIISWKCPRTIPVMENLSNQLDIKSLYQRNGIGQYSFNTLFKLHWLKTHKPDVFQKMAKFVFISPMLTQR

SEQ ID NO: 813 - DNA, 969 bp, Haemophilus influenzae
  Name: NTH0447
gtgaaaatgaccattatcactcgtgatttgatggtaggaaatccaaaattagcaacattaaattatgcagaagaagccttaggccataatgccattgcagcaggttttcaagggcagcgtcattggactgatcatttgccaaacggagattttatggaggctatgctcaattcaacttatgactggaatggcgtgcgtccaccttatattcttgccacggaaaatgatagtttaaatgcaataggaatgttatttgggcatcaattaactggcaaagctcaaattttcgcagatgtgcgtacttattggagtcaagattcggttgagcgtgttactggatggcgacctgaaagtggattcattcatttaatcaattcaggttcagctgcacttgatggaacaggagagcatcaagatgctcaaggcaatccaaccttaaaaccggcatgggatgtcaccgaagaagaagcaaaacgttgcttagaaaatacgcgttggtgtcctgctgttcacgaatattttcgtgggggcggtttatcttctcaattcctaaccaaaggtggcataccgtttacaatgcaccgcattaaccttattaaaggtctaggtcccgttctacaaattgctgaaggatggtcaatcgacctacctcaagatgtacataataaattaaatcaacgtactaatgaaacttggccaacaacatggtttgttccacgtttaactggaaaaggtgcatttactgatgtgtattcagtcatggcaaattggggagcaaatcactgtgtagcgactcacggtcatgtgggggctgatctaatcactcttgcttcaatgttacgcattccagtctgtatgcataatgtatcagagaaaaatattttccgccctagcgcttggaatggatttggtcaagacaaggaagggcaagattatcgagcttgccaaaactttggtccgctttataaa

SEQ ID NO: 814 - protein, 323 aa, Haemophilus influenzae
  Name: NTH0447
VKMTIITRDLMVGNPKLATLNYAEEALGHNAIAAGFQGQRHWTDHLPNGDFMEAMLNSTYDWNGVRPPYILATENDSLNAIGMLFGHQLTGKAQIFADVRTYWSQDSVERVTGWRPESGFIHLINSGSAALDGTGEHQDAQGNPTLKPAWDVTEEEAKRCLENTRWCPAVHEYFRGGGLSSQFLTKGGIPFTMHRINLIKGLGPVLQIAEGWSIDLPQDVHNKLNQRTNETWPTTWFVPRLTGKGAFTDVYSVMANWGANHCVATHGHVGADLITLASMLRIPVCMHNVSEKNIFRPSAWNGFGQDKEGQDYRACQNFGPLYK

SEQ ID NO: 815 - DNA, 357 bp, Haemophilus influenzae
  n 1, 103, 104, 182: n is any nucleotide
  Name: NTH0448
ntgccctgctggtcatttcaattaggactccaaggctttccatttcggtacagaggtcaagagcttgatgccccaccctatcctgagatgaaagaaaaatatnngcgtttgctcgtgctgggctgctgtgcaagtattcgaggaaatccttattatctatgggtcagtttccatgggaatgncaggctctatgtaaatcagcttttcttccaagaatatttaggtatgcgtaatgaatatgtggatatgatggaaattaaacgccgtttagaccgcaaaatttatgatcaagaagaagttgatttagccttgagttgggttaaacaatattgcaaagaaggggttgatgtaatagcc

SEQ ID NO: 816 - protein, 119 aa, Haemophilus influenzae
  Xaa 1, 35, 61: Xaa is any amino acid
  Name: NTH0448
XPCWSFQLGLQGFPFRYRGQELDAPPYPEMKEKYXRLLVLGCCASIRGNPYYLWVSFHGNXRLYVNQLFFQEYLGMRNEYVDMMEIKRRLDRKIYDQEEVDLALSWVKQYCKEGVDVIA

SEQ ID NO: 817 - DNA, 579 bp, Haemophilus influenzae
  n 574, 575, 576, 577, 578: n is any nucleotide
  Name: NTH0449
atgagtagcttttttgtcgcagggacagatacgaatgtggggaaaacaacagcagcgcgcgcaatgattcaagccttgcaagagcagggagtgcaagttgtcggctataaacctattgcttgttgtggagaagagagtatttatcctatcgcacaatcagaaaatacatctgattatgatcatttcgtaaatgctgatgtattaacgctgatgcattcaacaaaagaaaatgtgtcttatcaggatattaatagttatacttttagccactgtgcacccatgctcacgcaagataaaatgcgaattaaattagataaaattaattatgatttaacgcatttgaatcaaacttatcaatctgttgtggtggaaggatcttttggtttaatgacaccaatggcagaaggaaaaagttttgcagattggattactcaacgaaaaatgccagtagtacttgtagttggaattaaagatggttgtgtaaatcacgctttattaacggtaaaggttatccaacagttgggtgtgccgttattaggttggatagcaaatcgaattaatccattattaagcnnnnnt

SEQ ID NO: 818 - protein, 193 aa, Haemophilus influenzae
  Xaa 192, 193: Xaa is any amino acid
  Name: NTH0449
MSSFFVAGTDTNVGKTTAARAMIQALQEQGVQVVGYKPIACCGEESIYPIAQSENTSDYDHFVNADVLTLMHSTKENVSYQDINSYTFSHCAPMLTQDKMRIKLDKINYDLTHLNQTYQSVVVEGSFGLMTPMAEGKSFADWITQRKMPVVLVVGIKDGCVNHALLTVKVIQQLGVPLLGWIANRINPLLSXX

SEQ ID NO: 819 - DNA, 321 bp, Haemophilus influenzae
  Name: NTH0450
atgataaattgtaatccgcacgtaaaatgtgcggatttttatttcgggaaattaaatatgctatgtgccatttataaaagtaaaaagaagttaggaagttacctttatgttgctaatagagaggatttttctttagttcccagcgttttactcgaacattttggtaaaccagaattagtgatgatgtttaatctgcttgggcgtaaagcactatacaatgtagattgtaatgaagtattggaaacaattaaacgccaaggattttacttacaaatagcaaaacaagatgatggtttatttaatagcttgagtgagatcaaa

SEQ ID NO: 820 - protein, 107 aa, Haemophilus influenzae
  Name: NTH0450
MINCNPHVKCADFYFGKLNMLCAIYKSKKKLGSYLYVANREDFSLVPSVLLEHFGKPELVMMFNLLGRKALYNVDCNEVLETIKRQGFYLQIAKQDDGLFNSLSEIK

SEQ ID NO: 821 - DNA, 264 bp, Haemophilus influenzae
  Name: NTH0451
ttggtctttctaaaattaatcgaattgtgctcgttttttgcgcaacgtccccaggttcaagaacgcttaactgagcaacttttgacagcatttcaaaccattcttgaaaccgatgatgtggcggtatatgtgaaagcgacccatttttgcgtgaaagcacgtggtattagagatacaaatagttatactgtcacatctgcttatggtggcgtattcttagaagatagagatactcgtaaagaatttttagccacagttcaaaaa

SEQ ID NO: 822 - protein, 88 aa, Haemophilus influenzae
  Name: NTH0451
LVFLKLIELCSFFAQRPQVQERLTEQLLTAFQTILETDDVAVYVKATHFCVKARGIRDTNSYTVTSAYGGVFLEDRDTRKEFLATVQK

SEQ ID NO: 823 - DNA, 339 bp, Haemophilus influenzae
  n 34: n is any nucleotide
  Name: NTH0453
atgcatgaagtaatgaagctgatcggattagttntgcgggatgatagtttagaaccaccgccaaatcgtttagctaaaatgtttattgatgagatttttagtggaatggattatgccaattttcctaaaatgtcgagaatcaaaaatcagatgaaagtcaccgaaatggcgcaagtgaatgacatcactttagcaagcacttgtgaacatcattttgtgacgattgatggtaaagtttgtgtagcgtactatccaaaagattgggtgattggtctttctaaaattaatcgaattgtgctcgttttttgcgcaacgtccccaggttcaagaacgcttaac

SEQ ID NO: 824 - protein, 113 aa, Haemophilus influenzae
  Xaa 12: Xaa is any amino acid
  Name: NTH0453
MHEVMKLIGLVXRDDSLEPPPNRLAKMFIDEIFSGMDYANFPKMSRIKNQMKVTEMAQVNDITLASTCEHHFVTIDGKVCVAYYPKDWVIGLSKINRIVLVFCATSPGSRTLN

SEQ ID NO: 825 - DNA, 234 bp, Haemophilus influenzae
  Name: NTH0454
ttgcggctttttaatttaaagctaattcattcaaatggcatttttctcttttcaccatccaatatccttgctagaatagccgcttattttctaggaaagcctattatgagcaaatcttccctggatgctctgaatgtaagaaatgccttgattgaaaaaggtattgagacacctatgattgatccagcacaggctaaagatgaacgtcgaagaaagcattgcgaaacacatgca

SEQ ID NO: 826 - protein, 78 aa, Haemophilus influenzae
  Name: NTH0454
LRLFNLKLIHSNGIFLFSPSNILARIAAYFLGKPIMSKSSLDALNVRNALIEKGIETPMIDPAQAKDERRRKHCETHA

SEQ ID NO: 827 - DNA, 132 bp, Haemophilus influenzae
  n 37: n is any nucleotide
  Name: NTH0455
ttgctcaatcgaaattggcgtaatatcagaataatcnccgcattaaaatttgttgtgcaagttttcggttttctgccgatttttctgaataatcaagcaattctttcatgccttgtgaaaattgccgtcctg

SEQ ID NO: 828 - protein, 44 aa, Haemophilus influenzae
  Xaa 13: Xaa is any amino acid
  Name: NTH0455
LLNRNWRNIRIIXALKFVVQVFGFLPIFLNNQAILSCLVKIAVL

SEQ ID NO: 829 - DNA, 636 bp, Haemophilus influenzae
  n 18: n is any nucleotide
  Name: NTH0456
ttgtgcgtaatacgcccnaaacaaattgcgtggcatacaagtttgctggtggatttcgttgaggcattattagtgaaaattagtaatcgcttttcacttggcggcacagaagtgtttatttattgccaagaccaaccgcacttatttaataaagtggtgagtaccattggcgcaaaaaaattcagtatccacgatgcacagattattacgacacaagatggttatgtttttgatagctttatcatcacagaacttaacggagaattggttgaatttgatcgtcgccgagaattagagcaagccctaacattagcccttcaaagtgaaaaattgcccgcactttctattgtgcctaatcgccagcttcaacattttactgtacaaaccgacgtgcgttttttacaggaaaacaaaaaagaacatactcaaatggaactggttgccttggataaagcagggttattagcccaagtgagccagatttttactgagttaaatctaaatttattaaatgcgaaaattaccaccgtaggcgaaaaagccgaggatttttttattttgacgaaccaatttgggcaagctctggattctcaacaaagagaaatattacgtaacgtgctgtatcgaaatattgga

SEQ ID NO: 830 - protein, 212 aa, Haemophilus influenzae
  Name: NTH0456
LCVIRPKQIAWHTSLLVDFVEALLVKISNRFSLGGTEVFIYCQDQPHLFNKVVSTIGAKKFSIHDAQIITTQDGYVFDSFIITELNGELVEFDRRRELEQALTLALQSEKLPALSIVPNRQLQHFTVQTDVRFLQENKKEHTQMELVALDKAGLLAQVSQIFTELNLNLLNAKITTVGEKAEDFFILTNQFGQALDSQQREILRNVLYRNIG

SEQ ID NO: 831 - DNA, 864 bp, Haemophilus influenzae
  n 864: n is any nucleotide
  Name: NTH0457
atgctgagtatttttgttacttttcttggcgcgtttttaacattgattgtgatgcgaccacttgccaattggattggattagtcgataaaccaaactatcgtaaacgtcatcaaggcacaattccactaatcggtggcgtatcgctttttgttggtaatctttgctattatctgatggaatgggatcaacttcgattaccgtatctttatttgttcagtatttttgttttattggcgattgggattttagatgatcgctttgatattagcccttttttaagagcaggcattcaagcaatattggcgattttaatgatcgatcttgggaatatttatcttgatcatcttggtcaaattttagggcctttccaattaacgcttggttcaattggtttgattattaccgtctttgccactattgcgattattaatgcctttaatatgattgatggtattgatggattgcttgggggactctcttgtgtttcttttgcggcgattggtattttaatgtatcgagatgggcaaatggatatggcgcattggagttttgctttaatcgtatcgattttaccttatttgatgctcaatctagggattccatttggaccaaaatataaggtgtttatgggggatgccgggagtacattaattggctttaccattatttggattttgttattaagtacgcaaggaaaagggcatcctatgaatccagtaaccgcactttggattattgcgattcctttgattgatatggttgcgattatttatcgccgtgtacgtaaaggtaaaagcccattccgtccagatcgtttacatgttcatcatttaatggtaagagcgggtttaactggggtctcn

SEQ ID NO: 832 - protein, 288 aa, Haemophilus influenzae
  Name: NTH0457
MLSIFVTFLGAFLTLIVMRPLANWIGLVDKPNYRKRHQGTIPLIGGVSLFVGNLCYYLMEWDQLRLPYLYLFSIFVLLAIGILDDRFDISPFLRAGIQAILAILMIDLGNIYLDHLGQILGPFQLTLGSIGLIITVFATIAIINAFNMIDGIDGLLGGLSCVSFAAIGILMYRDGQMDMAHWSFALIVSILPYLMLNLGIPFGPKYKVFMGDAGSTLIGFTIIWILLLSTQGKGHPMNPVTALWIIAIPLIDMVAIIYRRVRKGKSPFRPDRLHVHHLMVRAGLTGVS

SEQ ID NO: 833 - DNA, 879 bp, Haemophilus influenzae
  Name: NTH0458
gtgcggtcaaaaatgaagataattttagccaatccacgaggattctgtgccggtgtagaccgtgctattagtattgttgaactcgccttagaaattcatggcgcaccgatttatgttcgtcatgaagtggtgcataaccgatttgttgtgaacggattgcgtgatcgtggtgcgatcttcgtggaagaattaagcgaggtacctgatggtgcgatcgtgattttttctgcgcacggcgtatctcaagccgttcgacaagaagcgaaagaccgcaatctcaaagtatttgatgcaacctgtcctttggtgaccaaagtgcatatgcaagttgctcgtgcaagtcgaaagggaacaaaagcgattttgattggacataaaggacaccctgaagttgaaggcacaatggggcagtatagtaatgaagatggcggaattttcttgattgaaaaagtagaagatattgcacgtttgccaatgcaagacaatgatgatttaacctttatgacgcaaaccactttatcgctagatgatacagcagaaactattgctgcattaaaggaaaaatatcccgctattcaagggccacataaaaacgatatttgttatgcgacaaccaatcgtcaagaagcggtgcgagaattggctaaattatcagatttagtgttggttgtggggtctaaaaactcatcaaattcaaatcgtttaaatgaattggcgtctcgaatggggattaaatcacagcttcttgatgatccttccgatattcaagatgattggtttaatgatgtaaaaaccatagggattacagctggcgcgtctgcaccagaagaattagttcaatcgattatttcccgcttaaaaaagtttggtgcggatata

SEQ ID NO: 834 - protein, 293 aa, Haemophilus influenzae
  Name: NTH0458
VRSKMKIILANPRGFCAGVDRAISIVELALEIHGAPIYVRHEVVHNRFVVNGLRDRGAIFVEELSEVPDGAIVIFSAHGVSQAVRQEAKDRNLKVFDATCPLVTKVHMQVARASRKGTKAILIGHKGHPEVEGTMGQYSNEDGGIFLIEKVEDIARLPMQDNDDLTFMTQTTLSLDDTAETIAALKEKYPAIQGPHKNDICYATTNRQEAVRELAKLSDLVLVVGSKNSSNSNRLNELASRMGIKSQLLDDPSDIQDDWFNDVKTIGITAGASAPEELVQSIISRLKKFGADI

SEQ ID NO: 835 - DNA, 171 bp, Haemophilus influenzae
  Name: NTH0459
atggttttcgtcgtggatttctttgatttctattgggatatttaccattatccagtatttaatatcgccgatattgccatttgtattggcgcagggttattagcattagatgcgtttaagagcgaaaagaaaaaagtacaagataaacaagtagaaaagtgcggtcaaaaa

SEQ ID NO: 836 - protein, 57 aa, Haemophilus influenzae
  Name: NTH0459
MVFVVDFFDFYWDIYHYPVFNIADIAICIGAGLLALDAFKSEKKKVQDKQVEKCGQK

SEQ ID NO: 837 - DNA, 366 bp, Haemophilus influenzae
  Name: NTH0460
atgtccaaaaaatcagggctttcatttttatggttaagtgcggtcgctttcgtggttgatttgcttacaaaatacattgcggtacaaaaatttgatttgtatgaaagtgttaatgtgctgcctgtttttaacctgacttatgttcgaaattatggcgcagcatttagtttcttagcggatcatagtggttggcaacaatatttctttattttgttggcattggctatttcaggaatgttggtctattttttagcaaaaaataatgccgaacaaaaaatccaaaattctgcttatgcactgactattggtggggcgttagcgaatatggtagatcgcacttacaatggttttcgtcgtggatttctt

SEQ ID NO: 838 - protein, 122 aa, Haemophilus influenzae
  Name: NTH0460
MSKKSGLSFLWLSAVAFVVDLLTKYIAVQKFDLYESVNVLPVFNLTYVRNYGAAFSFLADHSGWQQYFFILLALAISGMLVYFLAKNNAEQKIQNSAYALTIGGALANMVDRTYNGFRRGFL

SEQ ID NO: 839 - DNA, 1299 bp, Haemophilus influenzae
  Name: NTH0461
ttggggattatcgcttctgtttatgaagcgaatattaatgaaaccttagaatattacacaaccattcctttttggatatttttatttcaagttagttatatcattttatttgttgctttaatgaaattaagtttttatgttaaacaacaagcatttaaatggctaaatatggttgttatcagcctattattagttttttcttataaccaattttctaattggaactacgcctataaattccgtttttatccagttcttttttattctgaatttgatcgaatgaatgatctatatttagaacaacgagattttctaaatcaatccgttaatgcgccgtctcaatgggatattcaatcttttacgccaaaatataaaaattatattttaattattggtgaaagtatgcgaaaagattatatgtcgttatatggctttccactgaaaaccacgccatttttagagcgtgtgaaaagcacagtttttgaaaattattattctgcagcaccgaatacgcaaccgtctttacaacacaccctatatcgagcagataaaggagaaacggtttatacggataatattatttctttagccaaaaaagcgggcgtgaaaacttattggatttctaatcaaggcaaaattggggaatttgatacgatggcctctcgtattggtcaaagtgcagatgaaacgatttttatgaagccgttaggttataactctaaaaaagtttatgacgatgaaatgttgcctgtattagataaagccttaaaagaaaatattacgaatccaaaattaattgtgattcatttaatgggctcacatccagccttttgtgagcgtcttccgtacgaagttaaaaattattttattaatcaatctatgtcttgttatttagaatcgattaaatatacggatcagtttttagaaaaattaaattcgcagttagtatcgcaaaatgaaccctattcggtgatttacttttctgatcatgggcttgctcattatgaggattctgaaggtttatcattgcatccaaataatctttataaacaaaattatgaaattcctttcgttatgttttcgagtgatagtaaaaagctagaaaaaataaaaacgccacaatcggcatttaattttgtttatggttttgctgattggatgggaattaaggaaaaacatttacaaggcgtggatttcttccatcctgaaaaacaggaaattaaagtatttgattggaataacgttgtaaatgttaaagagttggctgatgatccagcaaaattaccagaagccgttcag

SEQ ID NO: 840 - protein, 433 aa, Haemophilus influenzae
  Name: NTH0461
LGIIASVYEANINETLEYYTTIPFWIFLFQVSYIILFVALMKLSFYVKQQAFKWLNMVVISLLLVFSYNQFSNWNYAYKFRFYPVLFYSEFDRMNDLYLEQRDFLNQSVNAPSQWDIQSFTPKYKNYILIIGESMRKDYMSLYGFPLKTTPFLERVKSTVFENYYSAAPNTQPSLQHTLYRADKGETVYTDNIISLAKKAGVKTYWISNQGKIGEFDTMASRIGQSADETIFMKPLGYNSKKVYDDEMLPVLDKALKENITNPKLIVIHLMGSHPAFCERLPYEVKNYFINQSMSCYLESIKYTDQFLEKLNSQLVSQNEPYSVIYFSDHGLAHYEDSEGLSLHPNNLYKQNYEIPFVMFSSDSKKLEKIKTPQSAFNFVYGFADWMGIKEKHLQGVDFFHPEKQEIKVFDWNNVVNVKELADDPAKLPEAVQ

SEQ ID NO: 841 - DNA, 321 bp, Haemophilus influenzae
  Name: NTH0462
ttggtatcgtcgtactcacttcctgtacaaaacttcggttattacggcattatgatttggttacctaatttcttatcaaaacaacttggattcagtttaactaaatctgggctttggaccgccgttaccgtctgcggcatgatggctggcatttggattttcggacaactcgccgaccgaatcggacgcaaaccaagtttcttacttttccaattaggcgcagtgataagtatcgtggtttactcacaacttaccgatcctgacatcatgcttcttgctggggcaattttagggatggtttgggaacggaatgctgggcgg

SEQ ID NO: 842 - protein, 107 aa, Haemophilus influenzae
  Name: NTH0462
LVSSYSLPVQNFGYYGIMIWLPNFLSKQLGFSLTKSGLWTAVTVCGMMAGIWIFGQLADRIGRKPSFLLFQLGAVISIVVYSQLTDPDIMLLAGAILGMVWERNAGR

SEQ ID NO: 843 - DNA, 477 bp, Haemophilus influenzae
  Name: NTH0463
gtgtttactggtttatgtgcgattgcacaaggttattgggatttactgatttatcgcacaattgctggtattggcttaggcggtgaatttggaattgggatggctctagcagcagaagcatggcctgcacgccaccgagcgaaagcagcatcttatgttgcattgggttggcaagttggtgtgttaggtgctgcgttgcttacaccattattgctcccgcatattggctggcgtggaatgttcttagtgggtatcttccctgcatttgtcgcttggttcttacgttctcatctgcacgaacctgaaattttcactaaaaaacaaaccgcactttcaacgcaatccagctttactgataaattacgttcattccagcttctgattaaagacaaagccacgagcaaaattagtcttggtatcgtcgtactcacttcctgtacaaaacttcggttattacggcattatgatttggttacc

SEQ ID NO: 844 - protein, 159 aa, Haemophilus influenzae
  Name: NTH0463
VFTGLCAIAQGYWDLLIYRTIAGIGLGGEFGIGMALAAEAWPARHRAKAASYVALGWQVGVLGAALLTPLLLPHIGWRGMFLVGIFPAFVAWFLRSHLHEPEIFTKKQTALSTQSSFTDKLRSFQLLIKDKATSKISLGIVVLTSCTKLRLLRHYDLVT

SEQ ID NO: 845 - DNA, 1047 bp, Haemophilus influenzae
  n 8, 1038, 1039, 1040, 1041, 1042: n is any nucleotide
  Name: NTH0464
gtgaaagntcagtacttcgtgccaatctatgatgctaaaataaaaagtgcttgcagaaatgacccagaaattaccgcacttttaaaaccagttcacgaagctacacgtaagtttgtttctcaacctattggtaaagccacagacaatatgtacagctatcttgcattagtgcaagatgatccaaccatccaaatagtgaaccaagcacaaaaagcgtatgtagaaaaagttgcaccaaatgttgcagcaatggctggcttacctattttaagtgcaggagcgccatttaaagctggtggtcgtaaaaatgaccctacaggttataccgaagtaaataaaggtgaattaactttccgtaatgcggcagacttatatctctatccaaatacattagtcgttgttaaagcaacaggcgaacaattaaaagaatggttagaatgtagtgctggtatgtttaaacaaattgaccctacaagtgataaaccacaatcattaatcgactgggaaggtttccgcacttataactttgatgtgattgatggtgtcaattatgaatatgatctaactaaacctgcacgttatgatggtgaatgtaaattgattaacccagaatcgcatcgtgtagtgaatctcacttatcaaggcaaaccggttgatccaaaagcagaattcttgattgcaacgaataactatcgtgcttacggtaataaattcccaggcactggcgatcaacatattgtttacgcatcaccagatgaaaaccgtcaaattttagctgattacattaaagtaaccagtgaaaaagaaggttctgtaaaccctagcgcggataaaaactggcgttttgtgcctatctcaggtaacgataaattagatgtccgttttgaaacctcaccaagcgaacaagcagctcaattcatcaaagaaaaagcacagtatccaatgaaacaagtgggtacagatgaagttggatttgctgtataccaaattgatttatctaagtataaagggtaccgagtccgatattcgtataccatnnnnnttaat

SEQ ID NO: 846 - protein, 349 aa, Haemophilus influenzae
  Xaa 3, 346, 347, 348: Xaa is any amino acid
  Name: NTH0464
VKXQYFVPIYDAKIKSACRNDPEITALLKPVHEATRKFVSQPIGKATDNMYSYLALVQDDPTIQIVNQAQKAYVEKVAPNVAAMAGLPILSAGAPFKAGGRKNDPTGYTEVNKGELTFRNAADLYLYPNTLVVVKATGEQLKEWLECSAGMFKQIDPTSDKPQSLIDWEGFRTYNFDVIDGVNYEYDLTKPARYDGECKLINPESHRVVNLTYQGKPVDPKAEFLIATNNYRAYGNKFPGTGDQHIVYASPDENRQILADYIKVTSEKEGSVNPSADKNWRFVPISGNDKLDVRFETSPSEQAAQFIKEKAQYPMKQVGTDEVGFAVYQIDLSKYKGYRVRYSYTXXXN

SEQ ID NO: 847 - DNA, 219 bp, Haemophilus influenzae
  Name: NTH0465
ttggtggtggcaatgttaattgcaccaggaattaccgcacttacgcttaccaaatcttttgataaaatgttatgggttgctattgcaagttccattgcatcaagcctaattggcgtaatattgagctatcattttgatgcctcaacaggtgcttgtatcattcttctgcaagctgcattttttgttatagcattagcttatagcaaaattagaacaaga

SEQ ID NO: 848 - protein, 73 aa, Haemophilus influenzae
  Name: NTH0465
LVVAMLIAPGITALTLTKSFDKMLWVAIASSIASSLIGVILSYHFDASTGACIILLQAAFFVIALAYSKIRTR

SEQ ID NO: 849 - DNA, 645 bp, Haemophilus influenzae
  Name: NTH0467
atgattgaacaactcattcaacaagcccagccttattggcaacaatatattgaacacgaatttgtgcaacagctcgcaaaaggtacgctgccaaaagcttgttttcagcattatttaaagcaagattatctctatctttttcattacagccgagcttttgccttgggcgtgtataaagcaaaaaatttcgctgaaatggaaatacctcgcaaaaccttagagatactctgccaagaaattcaactacatttaaattattgccgtgagtggggaattagtgagcaagagatttttgctactcaagaaagtcccgcttgtattgcttatacccgctatttgcttgattgcggcatgacgggcagtttggctgagctttatgcagctgtgactccttgtgctttgggttatgctcaagttgctcgttacattactcagcattatcctcgcttaccgaacaacccttatcaaacgtggattgacacttatgcgagcgaggaatttcaacaagccgcccaagaaaccgttgattttcttaccgcactttgtaaaccgctaaactcaagccagcttaccgagattcaacagatttttaccaccgccactagaatggaaattgcgttttggcaaatggggttggatttggct

SEQ ID NO: 850 - protein, 215 aa, Haemophilus influenzae
  Name: NTH0467
MIEQLIQQAQPYWQQYIEHEFVQQLAKGTLPKACFQHYLKQDYLYLFHYSRAFALGVYKAKNFAEMEIPRKTLEILCQEIQLHLNYCREWGISEQEIFATQESPACIAYTRYLLDCGMTGSLAELYAAVTPCALGYAQVARYITQHYPRLPNNPYQTWIDTYASEEFQQAAQETVDFLTALCKPLNSSQLTEIQQIFTTATRMEIAFWQMGLDLA

SEQ ID NO: 851 - DNA, 942 bp, Haemophilus influenzae
  Name: NTH0468
atgaagacaatcatccgttatttcagctttgtaatggggctaatgctcacgcttcctagctttgcaaaagagaaaatcagcgtaatgctagattggtatgtaaaccccgatcatgcagccatcattgtggctcaacaaaaaggcttttttgaaaaaaataacttggaggttgaaattatcgaacctgctgatcctgcattaccgccgaaattagcggcggcaggaaaagttgatttagccgtgagttatcagcctcagctttatcaacaagtggcagaaggcttacctttagtacgagtggggtcactgatttcaaatccattaaatagcgtagtggtactaaaaaagagcaatttggaaacccttgctgatttaaaaggtaaaaaagtggggtattctgtcagcggttttgaagatggattgcttgacaccatgcttcattctattggtttaagcaataaagatgtggaattagtgaatgtaaattggtcgctttcgccttctcttttaactggacaagtggatgctgtgattggtgcatttcgtaattttgaactcaatcagcttgctttagaaaagcaagaaggcgtcgcattcttccctgagcaatatggcgtgcctgcttatgatgaattgattttagttgccaataaaaacagcgtaacagataaaaaaacatccgcctttttgaccgcacttgaacaagccacaagctatctgcaagctcaccccaatgaagcgtggcaagcctttgtcagctataaaccgaacgaactcaacacgccattaaatcaactggcgtggaaagacacgctccccttcttagccaataaacctcgtcaattagacgctaaacgttatcaacaaatggcagaatttatgcaacaaaaaggcttaattccaaaagccttagcgttgaaagaatatgcggtagaaattgaa

SEQ ID NO: 852 - protein, 314 aa, Haemophilus influenzae
  Name: NTH0468
MKTIIRYFSFVMGLMLTLPSFAKEKISVMLDWYVNPDHAAIIVAQQKGFFEKNNLEVEIIEPADPALPPKLAAAGKVDLAVSYQPQLYQQVAEGLPLVRVGSLISNPLNSVVVLKKSNLETLADLKGKKVGYSVSGFEDGLLDTMLHSIGLSNKDVELVNVNWSLSPSLLTGQVDAVIGAFRNFELNQLALEKQEGVAFFPEQYGVPAYDELILVANKNSVTDKKTSAFLTALEQATSYLQAHPNEAWQAFVSYKPNELNTPLNQLAWKDTLPFLANKPRQLDAKRYQQMAEFMQQKGLIPKALALKEYAVEIE

SEQ ID NO: 853 - DNA, 228 bp, Haemophilus influenzae
  Name: NTH0469
ttgcctgcttttgcttcgggcttgcgaattgccgtttcggtcgccccgattggtgcggtggtaggtgaatgggtcggttcatctgaaggcttggggtatttgatgattcacgccaatgcccgaatgcaagtcgatttaatgtttgccgccttactgattttagtgtcaatttcactctgtttatatttcagcattgattggctattacaccgttttatttggtctgtt

SEQ ID NO: 854 - protein, 76 aa, Haemophilus influenzae
  Name: NTH0469
LPAFASGLRIAVSVAPIGAVVGEWVGSSEGLGYLMIHANARMQVDLMFAALLILVSISLCLYFSIDWLLHRFIWSV

SEQ ID NO: 855 - DNA, 984 bp, Haemophilus influenzae
  Name: NTH0470
gtgaatgcgattgtggacgctaaacgtcgccacaacacatcactcaatcactcagcgacacacttattgcacgctgccttacgtcaaattctaggtttacacgttgtgcaaaaaggttcgcttgtttcagataaagccttacgttttgactttgcgcaaccagaagccattaccaaagagcaattgagtgaaattgaaacattagtaaaccaaaaaatccgcgctaactttccagttcaaacggatattatggatattgattccgcaaaagcgaaaggagcaatggctctctttggcgaaaaatatggcgataaggttcgtgtattaacgatgggcgatttctcaattgagctgtgtggcggtattcacgcaaaacgcacaggcgatattggtttatttaaaattattactgaaaacgcagtggctgcaggcattcgtcgtattgaagctgtaacaggtcaaaatgccattgactggttacataatcaacaacgcattctgacccaaagcgcagacttattaaaatcagacgtaaataccttagtggaaaaaatccaacaacttcaagacaaaacgaagaaagtggaaaaagaattacaaggtctaaaagaaaaagccgcaatgcaggctggttctgattttgtaaaaagtgcggtcaaaatcaacggtgtttctgttattgcacaacaattagatggtatagaaacaaaatcattacgcgtaatggtcgatgatttaaaaaatcaactcggatcaggcgtaattgcatttgcatcaatattagatgaaaaagttaatctcgtcgttggagtgacaaatgatttaaccgccaaaataaaagctggagaacttgttaatttaatggctcaacaagttggaggaaaaggcggtggccgtccagatatggcaatggcaggaggttcccaaccagaaaatgtggcacaagcaattaaagtggcacaagactggttaaacaaaaatctg

SEQ ID NO: 856 - protein, 328 aa, Haemophilus influenzae
  Name: NTH0470
VNAIVDAKRRHNTSLNHSATHLLHAALRQILGLHVVQKGSLVSDKALRFDFAQPEAITKEQLSEIETLVNQKIRANFPVQTDIMDIDSAKAKGAMALFGEKYGDKVRVLTMGDFSIELCGGIHAKRTGDIGLFKIITENAVAAGIRRIEAVTGQNAIDWLHNQQRILTQSADLLKSDVNTLVEKIQQLQDKTKKVEKELQGLKEKAAMQAGSDFVKSAVKINGVSVIAQQLDGIETKSLRVMVDDLKNQLGSGVIAFASILDEKVNLVVGVTNDLTAKIKAGELVNLMAQQVGGKGGGRPDMAMAGGSQPENVAQAIKVAQDWLNKNL

SEQ ID NO: 857 - DNA, 366 bp, Haemophilus influenzae
  Name: NTH0472
gtgcccactctaattgaagtaatggctgaagctggaaaagatgtaaaagcaaaacaaacaaatgttgaaaaactattacgtctagaagaagaacaatttgctcgtactctagagcgtggcttgagcttattagatgaagcactttctcaagtgaaagatggcattctttcaggtgaagttgcattcaaactttatgatacttatggtttcccattggatttaacggctgatgtatgccgtgagcgtaacattactattgatgaacaagcgtttgaccgtgaaatggaagcacaacgtactcgtgctcaagcagcgagcccagtttggtgtggactacaacagcgttattcgtgtagatggcgaaac

SEQ ID NO: 858 - protein, 122 aa, Haemophilus influenzae
  Name: NTH0472
VPTLIEVMAEAGKDVKAKQTNVEKLLRLEEEQFARTLERGLSLLDEALSQVKDGILSGEVAFKLYDTYGFPLDLTADVCRERNITIDEQAFDREMEAQRTRAQAASPVWCGLQQRYSCRWRN

SEQ ID NO: 859 - DNA, 267 bp, Haemophilus influenzae
  Name: NTH0473
atggtacaaattttagtgggtgcaaccatcactgcaagtattggcacaacttgggcaggcgtaattaatccaccacgccacaacgaagtgaaaacttggacttatgaaggcgaaagtgcggtcaaattattgaaaggtcaagaaatgggttggttccaacttggttcaacagtaattaatttattccaagccaatcaagtgcgtttggctgatcatttaagcgtaaatgaacctgttcgcatgggcgaaatcttggcatataaaaaa

SEQ ID NO: 860 - protein, 89 aa, Haemophilus influenzae
  Name: NTH0473
MVQILVGATITASIGTTWAGVINPPRHNEVKTWTYEGESAVKLLKGQEMGWFQLGSTVINLFQANQVRLADHLSVNEPVRMGEILAYKK

SEQ ID NO: 861 - DNA, 783 bp, Haemophilus influenzae
  Name: NTH0474
gtggaaacacatttattagtgcgtcgccatgcgccaatgcgtaatcaggatccattaatcgtagaaacattagtggaagtgcttgcgcaagatggaattcaattacataccaattctaccccatctgaaattgtaaaaaatgcagatggttcacttactgtaaaatgtgatggtcaatctgatgttaccgtagattgcgttatttgggcggcaggtcgtgttccaacgacagataaaattggcttagaaaatgcaggtgtagaaacaaatgaacacggctatgtcaaagtagataaatatcaaaatactaatgtgaaaggcatttatgcggtaggcgatattatcgaaaacggtattgaattaacaccagttgcagttgcagcaggtcgccgcctttcagagcgtttatttaataataaaccgactgaatatttagattacagtttagttccaaccgttgtatttagccatccgcctatcggcactgtaggtttaactgaaccgcaagcgattgagcagtacggcgcagaaaatgttaaagtatataaatcttctttcacagcgatgtacactgcggtaactcaacatcgccaaccgtgcaaaatgaaattagtttgtgtgggtaaagatgaaaaagttatgggtttacatggtattggtttcggtgtagatgaaatgattcaaggatttgcagtagcaatcaaaatgggcgcaacaaaagctgattttgacaatacggtggcaattcatccaacaggttcagaggaatttgtaacaatgcgt

SEQ ID NO: 862 - protein, 261 aa, Haemophilus influenzae
  Name: NTH0474
VETHLLVRRHAPMRNQDPLIVETLVEVLAQDGIQLHTNSTPSEIVKNADGSLTVKCDGQSDVTVDCVIWAAGRVPTTDKIGLENAGVETNEHGYVKVDKYQNTNVKGIYAVGDIIENGIELTPVAVAAGRRLSERLFNNKPTEYLDYSLVPTVVFSHPPIGTVGLTEPQAIEQYGAENVKVYKSSFTAMYTAVTQHRQPCKMKLVCVGKDEKVMGLHGIGFGVDEMIQGFAVAIKMGATKADFDNTVAIHPTGSEEFVTMR

SEQ ID NO: 863 - DNA, 723 bp, Haemophilus influenzae
  Name: NTH0475
atgttcaaaaggctgtcattatatacgttattactttgtcttgtaccattttttatttggggtatttcctatcaatggcatggtaatagccaattaactcaagctgattattggctttatttgctcactgaaacgggtagcgtaccttatgcgttgattacctgtgtgttatttacgcttttgtttgcgtttttatttaaaaatccaaaacaatggctattaggcgtaattgtgatggggatttcagttattgcaactcaagcggcaaaaacaggggcaaaagcattatttgaagaacctcgtccgtttaccgtttatctagctgagcaaactcattcaacgcctgaaaacttttataaaaatgaccgcactttgcgtgctgaaatagctaagaatttttattcgatggatgctatcacaccagcttggttagttcatcattatgagaatgaaacggggtattcgttcctttctggacatacgatttatgcggcaacttggctaatgcttgctgttggctttacccaattattgggtaaccgttcttttaaagcaaaattgctggtggtgggtattgcagtgtggggcttattgatgttgattagccgtgtgcgattaggcatgcattacccaatagatttattggtggcgacattactggcatggttgattaatggcattatttttgcctttttaaagaaaaaggcgatcttcgtcatgaaa

SEQ ID NO: 864 - protein, 241 aa, Haemophilus influenzae
  Name: NTH0475
MFKRLSLYTLLLCLVPFFIWGISYQWHGNSQLTQADYWLYLLTETGSVPYALITCVLFTLLFAFLFKNPKQWLLGVIVMGISVIATQAAKTGAKALFEEPRPFTVYLAEQTHSTPENFYKNDRTLRAEIAKNFYSMDAITPAWLVHHYENETGYSFLSGHTIYAATWLMLAVGFTQLLGNRSFKAKLLVVGIAVWGLLMLISRVRLGMHYPIDLLVATLLAWLINGIIFAFLKKKAIFVMK

SEQ ID NO: 865 - DNA, 357 bp, Haemophilus influenzae
  Name: NTH0476
ttgataataaaaaataacgcgcgcattctaacagaaatgactacgaataaggatcactttatggcaaaaattcagctagttgcgcaagccaatttacccactgaatacggtattttcaaaatggtgggatttgaattcccagatacaaaaaaagaacatgtagccttagtgatgggcgatatttctaatgctgatgaacctgtattagcacgtatccattctgaatgtttaactggcgatgcgcttcacagcttaaaatgcgattgtgggttccaactggcgacagcattaaaacaaattcaagaagaaggtcgcggagtccttatttatcatcgtgaaaaggccgcggaattggct

SEQ ID NO: 866 - protein, 119 aa, Haemophilus influenzae
  Name: NTH0476
LIIKNNARILTEMTTNKDHFMAKIQLVAQANLPTEYGIFKMVGFEFPDTKKEHVALVMGDISNADEPVLARIHSECLTGDALHSLKCDCGFQLATALKQIQEEGRGVLIYHREKAAELA

SEQ ID NO: 867 - DNA, 459 bp, Haemophilus influenzae
  Name: NTH0477
ttgctctatcctgaccataaacttaactacaatcgtgttattagcgtggtggaacaatcctcaatttttacaccatttcaatggattgatgcgttgcttgttggaaaggcaaatcgtgctaaacgtattttaaaaggtttacaagctgaagatgtgcaacctgttattttattacgcacactacagcgagaattatttacgttgcttgaactaacaaaaccacagcaacgtattgtgacaacggaaaaacttccaattcaacaaattaagactgaatttgaccgtctaaaaatctggcaaaatcgccgaccgctctttttaagtgcgattcaacgtttaacttaccagactctctacgaaattatccaagaactcgctaatattgaacgtctaactaaacaagaatttagtgatgaagtgtggatcaaactcgctgatttatctgtaaaaatttgtttg

SEQ ID NO: 868 - protein, 153 aa, Haemophilus influenzae
  Name: NTH0477
LLYPDHKLNYNRVISVVEQSSIFTPFQWIDALLVGKANRAKRILKGLQAEDVQPVILLRTLQRELFTLLELTKPQQRIVTTEKLPIQQIKTEFDRLKIWQNRRPLFLSAIQRLTYQTLYEIIQELANIERLTKQEFSDEVWIKLADLSVKICL

SEQ ID NO: 869 - DNA, 102 bp, Haemophilus influenzae
  Name: NTH0478
ttggtcactggttcaagtccggtaggggggaccatttttccagcaaaaaatttcttttttatcaaaaatcttatttcaatattgtctattttatttgccttg

SEQ ID NO: 870 - protein, 34 aa, Haemophilus influenzae
  Name: NTH0478
LVTGSSPVGGTIFPAKNFFFIKNLISILSILFAL

SEQ ID NO: 871 - DNA, 1107 bp, Haemophilus influenzae
  Name: NTH0479
gtgtccaacaacaactggcacatgaaagcaaaactgaccggcattgaacaacttgcaggcgaaattgcaaaacaaatcggcgcagatgaagcgaaagcaaaacgtgcgggtttactgtcaaaatgtgatttgatgaccaacatggtattcgaattcactgatacgcaaggcgtaatgggtatgcattatgctcgtcacgacggtgaagatgaagaagtggcagtggcgttaaacgaacaatatatgccacgctttgcgggtgatgaattacctaagtctttagtggcaagtgcggtcgctttagcggataaatttgacaccttaacgggtatcttcggcatcggccaagcaccaaaaggtagcgcagacccatttgcattacgtcgtgcggcattaggtgcattacgtattatcgttgagaaaaatttgcctcttgatctgaatgacattattagcaaagcatttgatttatataaagaacttgataacgaaagactacgtaatgcacctattgccaaaacaagaggtggatttagtgaatacccagaaggttatgtttcattctttacacgtggtgatgatttagttccaaaacaaaaaatccttgatgaggtagtagacttcatgctcggtcgtttccgtgcatggtatcaagatgaaggcattgcggtggatgtaattcaagcggtattggcacgtcgtccaactcgccctgctgattttgatgcgcgcgtgcgtgcggtttcacacttccgtactttagattcagcggaagcgttagcagcagcaaataaacgtgttagcaacatcttagcgaaagcaggtgcggcaattggcgagatcaatttaaccgcttgcgtagagccagcagaaaaagcccttgctgaagcggtactggcattacgcactgaagtacaaccgcttatcgcacaaggcgattacaccgcagtattggataaattagcaaacttacgtgcgccagtagacagtttctttgataacgtgatggtaaatgctgaagatccagcactacgccaaaaccgattagcgattttaaatacgttacaagggttattcttacaagtagctgatatttcagtgcttcaa

SEQ ID NO: 872 - protein, 369 aa, Haemophilus influenzae
  Name: NTH0479
VSNNNWHMKAKLTGIEQLAGEIAKQIGADEAKAKRAGLLSKCDLMTNMVFEFTDTQGVMGMHYARHDGEDEEVAVALNEQYMPRFAGDELPKSLVASAVALADKFDTLTGIFGIGQAPKGSADPFALRRAALGALRIIVEKNLPLDLNDIISKAFDLYKELDNERLRNAPIAKTRGGFSEYPEGYVSFFTRGDDLVPKQKILDEVVDFMLGRFRAWYQDEGIAVDVIQAVLARRPTRPADFDARVRAVSHFRTLDSAEALAAANKRVSNILAKAGAAIGEINLTACVEPAEKALAEAVLALRTEVQPLIAQGDYTAVLDKLANLRAPVDSFFDNVMVNAEDPALRQNRLAILNTLQGLFLQVADISVLQ

SEQ ID NO: 873 - DNA, 915 bp, Haemophilus influenzae
  Name: NTH0480
atgattaaacaaagaacattaaaacaaagtattaaagtaacaggcgttggcttacatagcggtaataaagtgacattaaccttacgcccagctatgccaaacacaggtgttgtttattatcgtacagatttaaaccctgcggtggcatttcctgccgatcctaattcagtgcgtgatacaatgctctgcacagcactaattaatgatcaaggtgttcgcatttctaccgttgagcatttaaatgcagctttggcagggcttggtattgataatatcattattgaagttgatgcccctgaaattcctattatggatggcagtgctagtccgtttatctatttgttgttagatgcgggaattgaagaacaaaatgcagcgaaaaaatttattcgcattaaagaatatgtacgagttgaagatggcgataaatgggctgaatttaaaccttataatggtttccgtttagatttcactattgattttgaccatcctgctattggcaaagatgtacgtaactatgaaatgaatttttctgcccaagcatttgttcatcaaattagccgagcaagaacttttggctttatgaaagatattgaatatcttcaatctcaaggtttagcattaggtggtagccttgataatgcgattgttcttgatgattatagaatcttaaatgaagatggcttacgctttaaagatgaacttgttcgtcataaaatgttagacgcaattggcgatctttatatggctggttataacattatcggtgattttaaagcctataaatcaggtcacggtttaaataacaagttacttcgtgctgttttagcaaatcaagaagcgtgggaatttgtaacctttgaagataaagagcaagtgccacaagggtatgtagctccagcgcaagtgcttatt

SEQ ID NO: 874 - protein, 305 aa, Haemophilus influenzae
  Name: NTH0480
MIKQRTLKQSIKVTGVGLHSGNKVTLTLRPAMPNTGVVYYRTDLNPAVAFPADPNSVRDTMLCTALINDQGVRISTVEHLNAALAGLGIDNIIIEVDAPEIPIMDGSASPFIYLLLDAGIEEQNAAKKFIRIKEYVRVEDGDKWAEFKPYNGFRLDFTIDFDHPAIGKDVRNYEMNFSAQAFVHQISRARTFGFMKDIEYLQSQGLALGGSLDNAIVLDDYRILNEDGLRFKDELVRHKMLDAIGDLYMAGYNIIGDFKAYKSGHGLNNKLLRAVLANQEAWEFVTFEDKEQVPQGYVAPAQVLI

SEQ ID NO: 875 - DNA, 348 bp, Haemophilus influenzae
  Name: NTH0481
atggcattagaattatctgacattcgccaacaaattacgcaaatagatcgtagtttattaaaattactttctgagcgtcatcgtttagctttcgatgtagtgagaagtaaagagatctcgcaaaaatctttacgtgatgtagagcgagaacagcaacttttacaagaactagtgcaatttgcagaaaatgaaaattatcagcttgaagcacaatatatcacttcaattttccaaaaaatcattgaagaactcgtattgaccccagcagtctacttgcagaataaacttaatgaacaacgtaatcaaaatttacatattgcttttttaggtaaaacgtggttcttattc

SEQ ID NO: 876 - protein, 116 aa, Haemophilus influenzae
  Name: NTH0481
MALELSDIRQQITQIDRSLLKLLSERHRLAFDVVRSKEISQKSLRDVEREQQLLQELVQFAENENYQLEAQYITSIFQKIIEELVLTPAVYLQNKLNEQRNQNLHIAFLGKTWFLF

SEQ ID NO: 877 - DNA, 1779 bp, Haemophilus influenzae
  n 1510, 1774, 1775, 1776, 1777, 1778: n is any nucleotide
  Name: NTH0482
atgttcgttatcaaacccgctgggattgagacacatattgcacaagcacgtttacagctcgattttggttgtttgctttcacgtgaagtttgtttacgagacttcaccttaaataaaccgaccattgcgattaatactgcattattgcctccatcggcacctgataattcaaagtctggctcaatgaagcgtatttccttgccaattagtatcaatgcagaaaatttggtggtgcaagatttatctgtaaacattgatcagactaatattacgcttggaaattttaaaagtgcggtaagtttaaataatgaaaaaggcttaactattgcgccgactgaaattaacgatatttcagtgattgcaaaaaaattgcccgaaggtaaacctgagctgaaagccaaacagccgaataaacctgtagattgggctgcgattgagcaatctttaacgcctgcttttttaggcaatgtatcagacataattcttccttttgatttacatattcctgaaatttcaggcaaaaactggcagtatcaagcagtgaatgaaaaagacgaaacgcttcaatctgttgaaatgtctagtttaattgcacaggcggataccgtcgataaccaactgcaattacaaaaattagcggtagaaagctcgttgggtaatctttcttcacaaggtaaattacaactcgatggcgatatgccgctagatttaactttaaaatcccatttggagccgttgaaatccgctggaaaagaaattctgccagagagtgatgtggatcttacgctttcgggatcattgaaaaaatccaccgcactttctgtgaaaacaaaaggcgtattagatgctgaactgaatggcaacgtgcaattagcacaagataaaatgcccttaaacctcacattaaacgtggcaaaaggacaatacacttttgtaaacacaatgacgccactcaaaattaatgatgtgacgcttaaactcacgggggatttactgaattatcacgccgaatttaagggcaatgtggcaggaatgaattatattcccgcatctcaagtagactttaatgccgacggcaaactttatgaaataaccgtaaataaattggggatagcttcattagacggtaaaagtgaatttgtgggtaatgcaaattggaaaaatggtgcaaactgggatattcaagccgatttagaaaaaatgaatattggtttttttgttccagttatgcctgccatattatcgggtaaattacattctcgcggttttgcggactctcaaggttggcaagtggaagtgcctacagctgatttaaatggaatattgtctgcaaaaccaattagcttgaaaggttctgcaacgcttaatcaaaatgtacttctaaccgtgcctgatttacagattagatatggcgaaaattatcttaaagccagtggcgtattagatgatcattctgattttgtgctagatatagatgcaccaaatttacgtggtttatggtcagatttanaagggcgagtagcgatttctggtcaaattacgacacctaatcttgatcttgatttaacttcatccaatttacatttacaaggttttcagttagctaaagcaagtataaaaggtcatataaacaataccccactctcgagtggaaattggatattaaatcagaaacacttctttatggcgaaaatattaaactccatttacttgatccttgatttatccgggcgaggaacaaatcccaaatttttcctaaatctcaagccgagcnnnnnt

SEQ ID NO: 878 - protein, 593 aa, Haemophilus influenzae
  Xaa 504, 592, 593: Xaa is any amino acid
  Name: NTH0482
MFVIKPAGIETHIAQARLQLDFGCLLSREVCLRDFTLNKPTIAINTALLPPSAPDNSKSGSMKRISLPISINAENLVVQDLSVNIDQTNITLGNFKSAVSLNNEKGLTIAPTEINDISVIAKKLPEGKPELKAKQPNKPVDWAAIEQSLTPAFLGNVSDIILPFDLHIPEISGKNWQYQAVNEKDETLQSVEMSSLIAQADTVDNQLQLQKLAVESSLGNLSSQGKLQLDGDMPLDLTLKSHLEPLKSAGKEILPESDVDLTLSGSLKKSTALSVKTKGVLDAELNGNVQLAQDKMPLNLTLNVAKGQYTFVNTMTPLKINDVTLKLTGDLLNYHAEFKGNVAGMNYIPASQVDFNADGKLYEITVNKLGIASLDGKSEFVGNANWKNGANWDIQADLEKMNIGFFVPVMPAILSGKLHSRGFADSQGWQVEVPTADLNGILSAKPISLKGSATLNQNVLLTVPDLQIRYGENYLKASGVLDDHSDFVLDIDAPNLRGLWSDLXGRVAISGQITTPNLDLDLTSSNLHLQGFQLAKASIKGHINNTPLSSGNWILNQKHFFMAKILNSIYLILDLSGRGTNPKFFLNLKPSXX

SEQ ID NO: 879 - DNA, 813 bp, Haemophilus influenzae
  Name: NTH0483
atgaacagcaaattatccctttccaccaaactttcctccagcggtaaaacccagcttgctgaatactttgcgacgccaccgtttaaagtgataacgttgccaagttacgatgatgcgtgggcgaatggcttgaatgcgatgcagatgtcctcctcccctggggtgctggcgggcgatctgttagagattgatatttcgttggcaaaattgaccgcactttctttaaatacgcaggcatttactcgggtgcaggcgatgaatgaaggcgacagtgcgatgcaaacaacccatattttgcttgcggaaaacagtcgtttattctatttgccgcatccgttggtgttacataaagattccgtttttaagcagcaaacccagattgaaatgggcgaacaaagcgagctgatttacggtgaaatcgtggcgattgggcgggtgttgaatgatgaacgttttgccttccgccagttttcttcccatttgaagatttatactttgaaagacgatggcaaaaaacgaccgcttgtcagtgattgtatccagtggctgccgtctaaaatgaatcttaccgctttgagtcagatggaaaattattcccatcaaggttcgctgacttatctaaatttggcgaaaaataatgcggaaatcaaacaacaggtgcaagccttgcagcaacaaagtacggaagaaaaagatctactgataggcatatcacaactcaatgaatatggtttaatggtgcgggtactcgggtgtcgtgcagagcaaattcagaaattatttgagaaaattggtaggctattgaaatctgtg

SEQ ID NO: 880 - protein, 271 aa, Haemophilus influenzae
  Name: NTH0483
MNSKLSLSTKLSSSGKTQLAEYFATPPFKVITLPSYDDAWANGLNAMQMSSSPGVLAGDLLEIDISLAKLTALSLNTQAFTRVQAMNEGDSAMQTTHILLAENSRLFYLPHPLVLHKDSVFKQQTQIEMGEQSELIYGEIVAIGRVLNDERFAFRQFSSHLKIYTLKDDGKKRPLVSDCIQWLPSKMNLTALSQMENYSHQGSLTYLNLAKNNAEIKQQVQALQQQSTEEKDLLIGISQLNEYGLMVRVLGCRAEQIQKLFEKIGRLLKSV

SEQ ID NO: 881 - DNA, 99 bp, Haemophilus influenzae
  n 66: n is any nucleotide
  Name: NTH0484
atgcgtgttgaagaatgtggaagaacctgcatctttggttcgttaatcgtaggggcaaattacatntgcccaattattggtgaaatatcggggctaatg

SEQ ID NO: 882 - protein, 33 aa, Haemophilus influenzae
  Xaa 22: Xaa is any amino acid
  Name: NTH0484
MRVEECGRTCIFGSLIVGANYXCPIIGEISGLM

SEQ ID NO: 883 - DNA, 765 bp, Haemophilus influenzae
  Name: NTH0485
atgaaaaaactcactttgttactaagcgcggcttttatcttttcaccaatgacggcatctgccgatgtgttaatgaaatgggcgcgcaaaccgttacctattgacttacaaatcgaaaaagaacgtattctattcgtagataaaaatgtaaaagtaggttatccacctgaattagatagcaagcttcgcattcaatcaactggcggtgcggtttatttaaaagcaactgcagatttcccaaaaacacgcttgcagcttatggatgttgcaactggagaaataatcttacttgatgtgcaagcgaagcattctgttgccaatgcaagtgagccaattcgctttgtttatgaaaataaagttgaaaaacaaacaactgcttatggccaagatgcaaatgcatataacgaaccaatgccaaatgcgcgtccggcactccccgctccagctgcattaacacgttatgccgcacaaatgttttatgcgcctttacgttcagttgagcctttggaaggtgtgcgccaagtttcacatcgccttcctacaccgcttaaaacgctcttacctgcattgcctgtgcgagctactccattactcagctggcaacttgatgagtatgttgtcactgcggttcgcttgcaaaaccaggggcaatctcgcattgatttagatcctcgagagcttcaaggtcgattctatgcagcaatatttcagcataattggctgggggggcatgatacacctgaagatccacatcgttatattttg

SEQ ID NO: 884 - protein, 255 aa, Haemophilus influenzae
  Name: NTH0485
MKKLTLLLSAAFIFSPMTASADVLMKWARKPLPIDLQIEKERILFVDKNVKVGYPPELDSKLRIQSTGGAVYLKATADFPKTRLQLMDVATGEIILLDVQAKHSVANASEPIRFVYENKVEKQTTAYGQDANAYNEPMPNARPALPAPAALTRYAAQMFYAPLRSVEPLEGVRQVSHRLPTPLKTLLPALPVRATPLLSWQLDEYVVTAVRLQNQGQSRIDLDPRELQGRFYAAIFQHNWLGGHDTPEDPHRYIL

SEQ ID NO: 885 - DNA, 111 bp, Haemophilus influenzae
  Name: NTH0486
gtgcgcatggaaacagatttacagaacaatccttggggattgggatttaactgctacagctcaattccattacgtttagaagcaaaagaatttagagaaggggataaccaa

SEQ ID NO: 886 - protein, 37 aa, Haemophilus influenzae
  Name: NTH0486
VRMETDLQNNPWGLGFNCYSSIPLRLEAKEFREGDNQ

SEQ ID NO: 887 - DNA, 102 bp, Haemophilus influenzae
  n 5: n is any nucleotide
  Name: NTH0487
gtggnacgtggatttaaagacagtagcgttattgtgcatagtccagatagctggacggttaatcttgatttaagtgtagatgagtattcaaagatgaccagt

SEQ ID NO: 888 - protein, 34 aa, Haemophilus influenzae
  Xaa 2: Xaa is any amino acid
  Name: NTH0487
VXRGFKDSSVIVHSPDSWTVNLDLSVDEYSKMTS

SEQ ID NO: 889 - DNA, 93 bp, Haemophilus influenzae
  Name: NTH0488
gtggaaaggccaaaaatcacgcggttaggctttgcttatccaacctcccagcagttaaaccgctggatggagatggcgaggaagaatccaaaa

SEQ ID NO: 890 - protein, 31 aa, Haemophilus influenzae
  Name: NTH0488
VERPKITRLGFAYPTSQQLNRWMEMARKNPK

SEQ ID NO: 891 - DNA, 378 bp, Haemophilus influenzae
  n 19, 41, 313: n is any nucleotide
  Name: NTH0489
ttgtgggaatggttggggnctaagccccttattttcccgcnccaagtgattaatattttaacccgccgaatttccgggggggaagtcacggcccctggtggaaaggccaaaaatcacgcggttaggctttgcttatccaacctcccagcagttaaaccgctggatggagatggcgaggaagaatccaaaataaatatgaaagaaataaagccttatttcgccaagttgccaagaattttgaagaaagcctactatgccgtttatctaacggtgaattacgtgaacgtgcacgtggtgtttatgaaattgtggnacgtggatttaaagacagtagcgttattgtgcatagtccagatagctggacggttaatcttgatt

SEQ ID NO: 892 - protein, 126 aa, Haemophilus influenzae
  Xaa 7, 14, 105: Xaa is any amino acid
  Name: NTH0489
LWEWLGXKPLIFPXQVINILTRRISGGEVTAPGGKAKNHAVRLCLSNLPAVKPLDGDGEEESKINMKEIKPYFAKLPRILKKAYYAVYLTVNYVNVHVVFMKLWXVDLKTVALLCIVQIAGRLILI

SEQ ID NO: 893 - DNA, 537 bp, Haemophilus influenzae
  Name: NTH0490
atgatttcagtatgtttattaattggtcaatatttagatgtacaaacaaaaggtactgcactccaattaccaactttcgtatggtgtttattcactggtgttattgtccgcaatattttaagcaacattttccgtttccaagtagcagaatccgctattgacgtattaggtagcgtaggcttatccatctttttagcaattgctttaatgtcattaagactttgggaacttgcaggtttagcaattgatgtattaattgttcttgctattcaagtcgcatttatggctgcctttgcaatcttcattacttatcgagcaatgggtaaagattacgatgccgtcgtattaagtgctggacactgtggttttggtttaggcgcaaccccaacagcaatcgctaatatgcaagctgttaccagccgttttggaccatcacacaaagcatttttaatcgttccaatggtgggtgcattctttatcgacttaatcaacgcagcattattgaaagtctcatttgcagttgtaaatatgctcgcg

SEQ ID NO: 894 - protein, 179 aa, Haemophilus influenzae
  Name: NTH0490
MISVCLLIGQYLDVQTKGTALQLPTFVWCLFTGVIVRNILSNIFRFQVAESAIDVLGSVGLSIFLAIALMSLRLWELAGLAIDVLIVLAIQVAFMAAFAIFITYRAMGKDYDAVVLSAGHCGFGLGATPTAIANMQAVTSRFGPSHKAFLIVPMVGAFFIDLINAALLKVSFAVVNMLA

SEQ ID NO: 895 - DNA, 285 bp, Haemophilus influenzae
  n 67: n is any nucleotide
  Name: NTH0492
atgcaacgaatcggacaagatggcgagtttcgagcgaattgtcatcgtggtggaaaaactgaaaaanttatactaagcgatgacgagaaacagatagccattagagcaacaaaagccatcggtttagatgtggctggtgtggatttaattcgttcaaaaaatggattattggttttagaagtaaatgcaagcccaggcttagaaatgattgaaaaaacaagtggggttgatattgcagctgaaataattgattatattgaaataaatgcctttatcaatttaaga

SEQ ID NO: 896 - protein, 95 aa, Haemophilus influenzae
  Xaa 23: Xaa is any amino acid
  Name: NTH0492
MQRIGQDGEFRANCHRGGKTEKXILSDDEKQIAIRATKAIGLDVAGVDLIRSKNGLLVLEVNASPGLEMIEKTSGVDIAAEIIDYIEINAFINLR

SEQ ID NO: 897 - DNA, 369 bp, Haemophilus influenzae
  Name: NTH0493
gtgattattcaaaaattactcacctttgttcattcaactctttctttgattattacaacgattctttgcggtctaacaatgattggggttacttgtaatgggcaaatttctattctaattccaggagaaatgcttaaaaatgcgtatgtagaaaaaggattacatccaaaaaatctaagtcgaacagcagaagactccgcaacaattattgaacctattttgccatggactgccgcaggtgcatatatggcaggcacattaggtgttgcaacattgtcttatttaccttgggcaattttatgttggagcggtattatctttgctattatttatggtgcaagtggaataggtattgcgaagctaaaaaaa

SEQ ID NO: 898 - protein, 123 aa, Haemophilus influenzae
  Name: NTH0493
VIIQKLLTFVHSTLSLIITTILCGLTMIGVTCNGQISILIPGEMLKNAYVEKGLHPKNLSRTAEDSATIIEPILPWTAAGAYMAGTLGVATLSYLPWAILCWSGIIFAIIYGASGIGIAKLKK

SEQ ID NO: 899 - DNA, 978 bp, Haemophilus influenzae
  n 946: n is any nucleotide
  Name: NTH0494
atgacggaacaatactacaaaattgccctcttatttaatgcaaacaaagtatatgatcggcaggtggtggagggtattggacaatatattcaggcatcgcaatgtatgtgggatatttttgtagaagatgaatttatctatcatactgatactattaatcaactttctattgatggcattattgcagactttgatgatccaaaaactgttgaattattgcaacacactcttattcctactatagcagttggtggatcttataaacaagctgatttttatccgcactttccttatgtagcaacagataatatggcattggttgaaatggctttatctcatttacaggagaaaggactgtcacagtttgcattttatggtttgcaagtaaatactcataagcattggtctatagaacgaagagatgcttttgtagagttgatggagaaaaatcattaccctatttacctatatgagggtgtgcaggttcatgctcaaaattggttggaagagcaacaaaagctaattgtctggttaaaatctcttccttctcatactggtattattgctgttacggatgcgcgtgctcgtcatttattgcaggcttgtgaatacagtaaaattgctgtacctgaagagctttgtgtggttggtattgataatgaagaattgatccaatatttatcgcgtatgtccctttcctccgtagaacaaggcacgagagagattggttatcaagctgcgaaattattacacaaattactcaatggtcaaaaagtttcacatacccctattttaattccaccgattaccgttcactctcgaaattctacagattatcgatcattaacagatccgcttgtcattcaagcaatgcattatattcgtcatcgtgcctgtcatcgaattaaagtagaacaagttttagatcatcttgaaacctcacgtnctatactgaacgggtaccgagtccgaattcga

SEQ ID NO: 900 - protein, 326 aa, Haemophilus influenzae
  Xaa 316: Xaa is any amino acid
  Name: NTH0494
MTEQYYKIALLFNANKVYDRQVVEGIGQYIQASQCMWDIFVEDEFIYHTDTINQLSIDGIIADFDDPKTVELLQHTLIPTIAVGGSYKQADFYPHFPYVATDNMALVEMALSHLQEKGLSQFAFYGLQVNTHKHWSIERRDAFVELMEKNHYPIYLYEGVQVHAQNWLEEQQKLIVWLKSLPSHTGIIAVTDARARHLLQACEYSKIAVPEELCVVGIDNEELIQYLSRMSLSSVEQGTREIGYQAAKLLHKLLNGQKVSHTPILIPPITVHSRNSTDYRSLTDPLVIQAMHYIRHRACHRIKVEQVLDHLETSRXILNGYRVRIR

SEQ ID NO: 901 - DNA, 432 bp, Haemophilus influenzae
  n 423, 424, 425, 426, 427: n is any nucleotide
  Name: NTH0495
atgaaattttcagtcctaatgtccttatatattaaggaaaatcctcaattcttgcgggagtgttttgaaagtcttgttgcacaaactcgtcaagcagatgaaattgtattggtttttgatggcgtagtaacgccagaattagaatctgttgtgacagaatttgaaacaaaattgccattaaaattagtcaaattgccgcaaaatcgaggattaggcaaagccttgaatgaaggtttattgcattgtacttatgactgggttttccgtatggataccgatgatatttgcgtgcctgatcgttttgaaaagcaagtagcgtttattgaacagcaccctgaaagcatcatttttggcggacaaattgctgaatttggtaaaaatgtaaatgatattgtggcatatcgtaatgtgccaacttctgtnnnnnttaat

SEQ ID NO: 902 - protein, 144 aa, Haemophilus influenzae
  Xaa 142, 143: Xaa is any amino acid
  Name: NTH0495
MKFSVLMSLYIKENPQFLRECFESLVAQTRQADEIVLVFDGVVTPELESVVTEFETKLPLKLVKLPQNRGLGKALNEGLLHCTYDWVFRMDTDDICVPDRFEKQVAFIEQHPESIIFGGQIAEFGKNVNDIVAYRNVPTSVXXN

SEQ ID NO: 903 - DNA, 771 bp, Haemophilus influenzae
  Name: NTH0496
ttgctccaaagagaagtagttgttgaacaaagttattcttttccagttacagtgattcgtaacgaaaccaatcaaggtgcagcggaaagtcgtaatgttggtgcgcgtacatcaaagggcgattggttgctttttctcgatgatgatgatcgttttatgccagaaaaatgtgaaaaaatactacaagtgattgagcaaaatccagacattaattttatttatcatcctgctaaatgtgaaatggtcaatgaagggtttacttatgtgactcaaccgattgaaccccaagaaatctcgacagaacgtattttgttagccaataagattggtggcatgccaatggttgcgattaaaaaagagatgtttttaaaaataggtggattatccaccgcacttcgttctttggaagactatgatttcttgttaaaactgttacaagagccaagttttactccttataaaattaatgaaccactaacttactgtactttccatactaaacgctcaagtgtgtctacggataccactaatacgcaaaaagccattgattatattcgcgagcattatgtgaaaacggtggagcaagctcgtaattttgatattaacgcgagctatattttggcttatccccatatcatgaatttatcgcgtaaagcggcaaaatattattttgatatttttaagaaaacaaaaagcattaggcaatttattattactttggttattttaatttcgccaaaattagccattaatttaaaacggttgggaaaa

SEQ ID NO: 904 - protein, 257 aa, Haemophilus influenzae
  Name: NTH0496
LLQREVVVEQSYSFPVTVIRNETNQGAAESRNVGARTSKGDWLLFLDDDDRFMPEKCEKILQVIEQNPDINFIYHPAKCEMVNEGFTYVTQPIEPQEISTERILLANKIGGMPMVAIKKEMFLKIGGLSTALRSLEDYDFLLKLLQEPSFTPYKINEPLTYCTFHTKRSSVSTDTTNTQKAIDYIREHYVKTVEQARNFDINASYILAYPHIMNLSRKAAKYYFDIFKKTKSIRQFIITLVILISPKLAINLKRLGK

SEQ ID NO: 905 - DNA, 111 bp, Haemophilus influenzae
  Name: NTH0498
gtgaaacgcagtgcagaaaaaatgaaagggaaaataaccgcacttagttgtttacttattgtttgcatttttctccttttaacaggggcagtcgaaatatttaatatgctt

SEQ ID NO: 906 - protein, 37 aa, Haemophilus influenzae
  Name: NTH0498
VKRSAEKMKGKITALSCLLIVCIFLLLTGAVEIFNML

SEQ ID NO: 907 - DNA, 1227 bp, Haemophilus influenzae
  Name: NTH0499
ttgcgaatttttcgttgtgagtttttgataaaacacctgcacaacgctatcgccacaatgtgtaataacgaggctaaaatgtcagaattattgtctgtgcaatcagatgcacccgctaaaaaaattaatctaatggatttaacgcgccaacaaatgcgcgaattttttaaagaactcggcgaaaaaccattccgagcagatcagttagtaaaatggatttatcattttggcgaagataacttcgacaatatgacaaacattaataaaaaattacgtgaaaaacttaaagcggttgcagaaattaaagccccagaagttgccgttgaacagcgttcagccgatggcacgataaaatgggcaatgcaagtgggcgagcagcaagttgaaactgtgtatattcccgaagcagatcgcgcgacgctttgtgtatcttcccaagttggctgtgccttagcttgtacattttgttcaacagcacaacaaggatttaatcgcaatttaacggtttcagaaattatcggtcaagtatggcgagcctctaaaattattggtaactttggcgtaactggcgttagacccattacaaatgtggtaatgatgggaatgggcgaacccttattaaatgtcgcaaacgttgttcctgcaatggaaattatgttagatgactttgcttacggtttatcaaaacgtcgtgtcactttatcaacttctggggttgtgccagcactagataatttgagcaaaatgatcgatgtggcactggcaatttcattacatgcaccaaatgatgaattacgtgatgaaattgtgccaatcaacaaaaaatataatatcaaaaccttgattgactcagtaaatcgttatttaaatgtatcaaatgcaaaccacggcaaagtgacgattgagtatgtgatgctcgatcatgtaaatgatggcattgaacacgctcatcaacttgcagaagtattaaaaaatacaccttgtaaaattaatttaattccgtggaatccgttcccagaggcaccttatgcaaaaagctcgaatacgcgtatcgaccgcttccaaaaaacattaatggaatatggctttaccgtgattatccgtaaaacccgtggcgatgatattgatgcggcttgcggacagctagctggagatgtgatcgatcgtactaaacgtacggcaatgaaacgccaatttggacaaaatattggggtaacagaagttaat

SEQ ID NO: 908 - protein, 409 aa, Haemophilus influenzae
  Name: NTH0499
LRIFRCEFLIKHLHNAIATMCNNEAKMSELLSVQSDAPAKKINLMDLTRQQMREFFKELGEKPFRADQLVKWIYHFGEDNFDNMTNINKKLREKLKAVAEIKAPEVAVEQRSADGTIKWAMQVGEQQVETVYIPEADRATLCVSSQVGCALACTFCSTAQQGFNRNLTVSEIIGQVWRASKIIGNFGVTGVRPITNVVMMGMGEPLLNVANVVPAMEIMLDDFAYGLSKRRVTLSTSGVVPALDNLSKMIDVALAISLHAPNDELRDEIVPINKKYNIKTLIDSVNRYLNVSNANHGKVTIEYVMLDHVNDGIEHAHQLAEVLKNTPCKINLIPWNPFPEAPYAKSSNTRIDRFQKTLMEYGFTVIIRKTRGDDIDAACGQLAGDVIDRTKRTAMKRQFGQNIGVTEVN

SEQ ID NO: 909 - DNA, 114 bp, Haemophilus influenzae
  Name: NTH0500
atgaacggcgattgtacagatttgtcattgcataatctagcggaattgaaaaacgatggaaaatcttaccgcacttttttgcgatctagatcgcaaatatttccaattacagcg

SEQ ID NO: 910 - protein, 38 aa, Haemophilus influenzae
  Name: NTH0500
MNGDCTDLSLHNLAELKNDGKSYRTFLRSRSQIFPITA

SEQ ID NO: 911 - DNA, 90 bp, Haemophilus influenzae
  Name: NTH0501
ttggacaccttaaaaaatgagctcacattttaccgcactttttacgctgtaattggaaatatttgcgatctagatcgcaaaaaagtgcgg

SEQ ID NO: 912 - protein, 30 aa, Haemophilus influenzae
  Name: NTH0501
LDTLKNELTFYRTFYAVIGNICDLDRKKVR

SEQ ID NO: 913 - DNA, 138 bp, Haemophilus influenzae
  n 129, 130, 131, 132, 133: n is any nucleotide
  Name: NTH0502
atgtttaaaaaagctttatttattttatctttgtgtccttcttttttgctggcacagtcttatgttgtgtatgattttacccataatcgagtattggaaagctatgcgcctgatagtatcagcctattnnnnnttaat

SEQ ID NO: 914 - protein, 46 aa, Haemophilus influenzae
  Xaa 43, 44, 45: Xaa is any amino acid
  Name: NTH0502
MFKKALFILSLCPSFLLAQSYVVYDFTHNRVLESYAPDSISLXXXN

SEQ ID NO: 915 - DNA, 414 bp, Haemophilus influenzae
  n 401, 402, 403, 404, 405: n is any nucleotide
  Name: NTH0503
ttgttttatttagtaaaaggaaaaacaatgcaacaaattccaatgactgtgcgtggcgcagaacaattacgagaagaattggatttcttaaaaaatgtacgtcgtccagaaattattaaagccatagcagaagcacgcgagcacggagatttaaaagaaaatgcagaatatcacgcagcgcgtgagcaacaaggtttttgtgaggggcgtattcaagagattgaaggtaaacttggtaatgctcaaattattgatgtcacaaaaatgccaaataatggtaaagtgatttttggtgcaacagttgtacttgtaaatacaaatacagacgaagaagtcacttatcgcattgtaggcgatgatgaggctgatatgggtaccgagtccgatattcgtataacatnnnnnttaattaat

SEQ ID NO: 916 - protein, 138 aa, Haemophilus influenzae
  Xaa 134, 135: Xaa is any amino acid
  Name: NTH0503
LFYLVKGKTMQQIPMTVRGAEQLREELDFLKNVRRPEIIKAIAEAREHGDLKENAEYHAAREQQGFCEGRIQEIEGKLGNAQIIDVTKMPNNGKVIFGATVVLVNTNTDEEVTYRIVGDDEADMGTESDIRITXXLIN

SEQ ID NO: 917 - DNA, 345 bp, Haemophilus influenzae
  Name: NTH0504
atgaaaaaattatcttcaatttccaccgcacttggttcctttttactttcagtgagttttagcctaccaactttcgccaatattaatgtttcagatttaacacaaaaattgcctgaaggctctaacgcaggtgttattgctaaaaatatcaatcaaaatcaaataattgctgattataatggctcaacctttatgctgcctgcgagtaccaaaaagtttttacagccgttgccgctaaactgcattagcgatcaattccaatttgagaccgcacttttgagtaatggggaaaattcaaaatgggaatttagatggcaacttaatcgtgagtttcacaggcgatcc

SEQ ID NO: 918 - protein, 115 aa, Haemophilus influenzae
  Name: NTH0504
MKKLSSISTALGSFLLSVSFSLPTFANINVSDLTQKLPEGSNAGVIAKNINQNQIIADYNGSTFMLPASTKKFLQPLPLNCISDQFQFETALLSNGENSKWEFRWQLNREFHRRS

SEQ ID NO: 919 - DNA, 1110 bp, Haemophilus influenzae
  Name: NTH0505
gtgagtttcacaggcgatcctgatctcacaagaggtcagctttatagcttacttgcagaattaaaaaaacaaggcatcaaaaaaattaatggcgatttagtattagatacctctgttttttctagtcacgaccgaggattaggttggatttggaacgatctcacaatgtgtttcaactctccaccagcagctgcgaatattgataacaactgtttttatgcggaactagatgcgaataaaaatccaggtgaaatagtaaaaattaatgtgcctgcacaatttccaattcaagtgttcggacaagtttatgtagcggatagcaatgaagcgccttattgtcagctcgatgttgttgtacacgacaataatcgctatcaagtaaaaggatgtttagcccgtcaatataaaccttttggcttaagttttgccgtgcaaaatacggatgcttatgctgccgcgattattcaacgtcaattaagaaaattaggtattgagttcaatggcaaagtcttgttaccccaaaaaccacaacaaggtcagctattagcgaaacatttatcaaaaccattacctgatttattgaaaaaaatgatgaaaaaatcggataaccaaattgccgattcattattccgagcggtggcattcaattactataaacgccccgcctcctttcaattaggcacattagcggttaaatccatattgcaaaaacaaggaattcgttttggtaatagcattttagccgatggttcgggtctatctcgccataatcttgtggcacctaaaacgatgctatccgttttagaatacatcgccaaaaacgaagataaattacatttaatggaaacttttcccatcgcaggtgtagatggcacgatcagtgggcgaggtggattaattagcccaccattagtgaaaaacgtgattgctaaaactggttctttgaaaggcgtttataacctagctggctttatgacaaatgcgcgaggggaaaaagtggcatttgtacaatttattaatggctactcaacgggcgatttagaaagcaaaacaaaacgtgccccattagtacaattcgagcgtaatttatataacgaactctataaatat

SEQ ID NO: 920 - protein, 370 aa, Haemophilus influenzae
  Name: NTH0505
VSFTGDPDLTRGQLYSLLAELKKQGIKKINGDLVLDTSVFSSHDRGLGWIWNDLTMCFNSPPAAANIDNNCFYAELDANKNPGEIVKINVPAQFPIQVFGQVYVADSNEAPYCQLDVVVHDNNRYQVKGCLARQYKPFGLSFAVQNTDAYAAAIIQRQLRKLGIEFNGKVLLPQKPQQGQLLAKHLSKPLPDLLKKMMKKSDNQIADSLFRAVAFNYYKRPASFQLGTLAVKSILQKQGIRFGNSILADGSGLSRHNLVAPKTMLSVLEYIAKNEDKLHLMETFPIAGVDGTISGRGGLISPPLVKNVIAKTGSLKGVYNLAGFMTNARGEKVAFVQFINGYSTGDLESKTKRAPLVQFERNLYNELYKY

SEQ ID NO: 921 - DNA, 114 bp, Haemophilus influenzae
  Name: NTH0506
ttggaaatgtttgaaggcaaaattgaagccgatgaaagctatttcggcagtactcgaaaaggcaaacgtggtcgcagtgttgcagggaaagtcgcggtattcgggcttctcaaa

SEQ ID NO: 922 - protein, 38 aa, Haemophilus influenzae
  Name: NTH0506
LEMFEGKIEADESYFGSTRKGKRGRSVAGKVAVFGLLK

SEQ ID NO: 923 - DNA, 474 bp, Haemophilus influenzae
  Name: NTH0507
atgagaaaaagtcgcttaagtcagcataaacaaaataaactcattgaactgtttgtcgcaggtgtcacagcaagaacagccagtaaattggttaatgtaaacaaaaatacagccactattactttcatcgattacgcttactcatttatcaaacaagcccacatttggaaatgtttgaaggcaaaattgaagccgatgaaagctatttcggcagtactcgaaaaggcaaacgtggtcgcagtgttgcagggaaagtcgcggtattcgggcttctcaaatgaaatgcaaggtttataccgtaatatgttcctaatgtgcaatcagcaacattattgccaattatccgaaagaaagttaagcctgatagcattgtgtacacggatacctttcgtagttatgatatgcttgatgtcagtgaatttagccattttcgcatcaatcacagcacgcattttgctgaaaatcacaactaca

SEQ ID NO: 924 - protein, 158 aa, Haemophilus influenzae
  Name: NTH0507
MRKSRLSQHKQNKLIELFVAGVTARTASKLVNVNKNTATITFIDYAYSFIKQAHIWKCLKAKLKPMKAISAVLEKANVVAVLQGKSRYSGFSNEMQGLYRNMFLMCNQQHYCQLSERKLSLIALCTRIPFVVMICLMSVNLAIFASITARILLKITTT

SEQ ID NO: 925 - DNA, 333 bp, Haemophilus influenzae
  Name: NTH0508
gtgcaatcagcaacattattgccaattatccgaaagaaagttaagcctgatagcattgtgtacacggatacctttcgtagttatgatatgcttgatgtcagtgaatttagccattttcgcatcaatcacagcacgcattttgctgaaaatcacaactacataaacggaattgggaatttttggaatcacgcaaaacgccatttacagaagtttaatggcattcccaaagagcattttgagctgtatttaaaagaatgtgaatggcgttttaacaatagcgaaataaaatctcaaatttccattttaaaacaattagttaaggggagtttggtc

SEQ ID NO: 926 - protein, 111 aa, Haemophilus influenzae
  Name: NTH0508
VQSATLLPIIRKKVKPDSIVYTDTFRSYDMLDVSEFSHFRINHSTHFAENHNYINGIGNFWNHAKRHLQKFNGIPKEHFELYLKECEWRFNNSEIKSQISILKQLVKGSLV

SEQ ID NO: 927 - DNA, 579 bp, Haemophilus influenzae
  Name: NTH0509
ttgtgcgttgatactcttgatattccgcccacttttgcggatctaatttcaactggtcacgttttttggctttatgtttacgttgtattgcttgattgcgctcaagtcgctccgctttctcaacatcgcttaaactatcccaaaattcgcgccgttgagccagtatctcatcttttttatcctgccatcgttgagcctgataaactttccgagtggctagataattcggatcttgcacacgtctataatgcctttccctttgtgcttccaaatgttcgtgcattcgttccgggtctgcttttcggttttcgcgggctttggcgtggttgcgtttatttaactcagggtcttccgctatccgtttggcgtagtgcgcattttggatattgtgtatcttcaatttttcgcactccgcacagcaagtatttttccgcccacgttccggcggtacttttttaccacaaactacacaatcaagattgcgacaatattcgcaaagctcaaaagtacgcccacttgcccgccgatattgataatttctgccgcactgcgggcatggtcttgttatcggcttgtttt

SEQ ID NO: 928 - protein, 193 aa, Haemophilus influenzae
  Name: NTH0509
LCVDTLDIPPTFADLISTGHVFWLYVYVVLLDCAQVAPLSQHRLNYPKIRAVEPVSHLFYPAIVEPDKLSEWLDNSDLAHVYNAFPFVLPNVRAFVPGLLFGFRGLWRGCVYLTQGLPLSVWRSAHFGYCVSSIFRTPHSKYFSAHVPAVLFYHKLHNQDCDNIRKAQKYAHLPADIDNFCRTAGMVLLSACF

SEQ ID NO: 929 - DNA, 711 bp, Haemophilus influenzae
  Name: NTH0510
ttgatgccgtccgagtgtattgggcgagcggcgaagatgggaattaaaaacaagccgataacaagaccatgcccgcagtgcggcagaaattatcaatatcggcgggcaagtgggcgtacttttgagctttgcgaatattgtcgcaatcttgattgtgtagtttgtggtaaaaaagtaccgccggaacgtgggcggaaaaatacttgctgtgcggagtgcgaaaaattgaagatacacaatatccaaaatgcgcactacgccaaacggatagcggaagaccctgagttaaataaacgcaaccacgccaaagcccgcgaaaaccgaaaagcagacccggaacgaatgcacgaacatttggaagcacaaagggaaaggcattatagacgtgtgcaagatccgaattatctagccactcggaaagtttatcaggctcaacgatggcaggataaaaaagatgagatactggctcaacggcgcgaattttgggatagtttaagcgatgttgagaaagcggagcgacttgagcgcaatcaagcaatacaacgtaaacataaagccaaaaaacgtgaccagttgaaattagatccgcaaaagtgggcggaatatcaagagtatcaacgcacaaagcggcgcgaacatagacagagaaaggcgcttaatgaattaatggtcggcacaaaggagttattaaatgttaccaacaaagacaaa

SEQ ID NO: 930 - protein, 237 aa, Haemophilus influenzae
  Name: NTH0510
LMPSECIGRAAKMGIKNKPITRPCPQCGRNYQYRRASGRTFELCEYCRNLDCVVCGKKVPPERGRKNTCCAECEKLKIHNIQNAHYAKRIAEDPELNKRNHAKARENRKADPERMHEHLEAQRERHYRRVQDPNYLATRKVYQAQRWQDKKDEILAQRREFWDSLSDVEKAERLERNQAIQRKHKAKKRDQLKLDPQKWAEYQEYQRTKRREHRQRKALNELMVGTKELLNVTNKDK

SEQ ID NO: 931 - DNA, 615 bp, Haemophilus influenzae
  Name: NTH0511
atgttaccaacaaagacaaatagttttgatattgtcgccgttaaaagcatgacaatccaagatttaaaggcggaattagccaaaacactaagcattacggcggaatatctcatgtatattgcggcaatatggcgggagttagagtcgcgtggagaggacttgagcgagttacgccatggcgtgatgacttatatcccgttaatcgcaacaaatcaacttgacgcgcggcttgttgtcaattatgccgggcaaaaaacgctgttatccagcatggcaaaattaccattaagagagcaacaaaaactggccgaaaaaggcactttggatgttgttattttgggtgacgataatcaacagctaattaaagaagttaaaatatccgacctcacagcagcccaagtttatcaaaccatcggtgatggcaaaataaaaacaccagaacagcagtatcaaatcctgttagtccgcaataaagtgcggtcaaaatcaaagccgaaaaagacttaccgactaacgcaaaatttaaaaatagatggtaaaaatttagtgattgccggaaaacatgcggtatccattgagattttgaaaaaatatttagaggataacaatgagcta

SEQ ID NO: 932 - protein, 205 aa, Haemophilus influenzae
  Name: NTH0511
MLPTKTNSFDIVAVKSMTIQDLKAELAKTLSITAEYLMYIAAIWRELESRGEDLSELRHGVMTYIPLIATNQLDARLVVNYAGQKTLLSSMAKLPLREQQKLAEKGTLDVVILGDDNQQLIKEVKISDLTAAQVYQTIGDGKIKTPEQQYQILLVRNKVRSKSKPKKTYRLTQNLKIDGKNLVIAGKHAVSIEILKKYLEDNNEL

SEQ ID NO: 933 - DNA, 279 bp, Haemophilus influenzae
  n 274, 275, 276, 277, 278: n is any nucleotide
  Name: NTH0512
gtgatgcgcgcgtgcggtgtggggcaacggattttggttaaagtggcactgattatgattttattaacggcaggtattgccgcttataacgcattatggctttcgccttgggcaattcaaaaacaagtgaatatggtggaagatgcaaaggctaatccaaccgttggcgtgctgtcttcaggtcagtttatttctaccaacaataataacgttgtgttatttattgataagattaaagataatcaaatccgcaatgtttatttatttcaaatgnnnnnt

SEQ ID NO: 934 - protein, 93 aa, Haemophilus influenzae
  Xaa 92, 93: Xaa is any amino acid
  Name: NTH0512
VMRACGVGQRILVKVALIMILLTAGIAAYNALWLSPWAIQKQVNMVEDAKANPTVGVLSSGQFISTNNNNVVLFIDKIKDNQIRNVYLFQMXX

SEQ ID NO: 935 - DNA, 243 bp, Haemophilus influenzae
  Name: NTH0513
atgattttaattcgatatttaataaaagaagttttcaaaagccaaatcgcaattttactaattttgctattgattttttttagtcagcagtttgtgcgtgtattaggtgcggcggcaaatgggaatgtgccagctgatttggttttctctttattaggcttaggaatgccgacatgggccgcagttgatgttgccactatgtgtaggtattgcgattttactgagttttggtcgcctttacgc

SEQ ID NO: 936 - protein, 81 aa, Haemophilus influenzae
  Name: NTH0513
MILIRYLIKEVFKSQIAILLILLLIFFSQQFVRVLGAAANGNVPADLVFSLLGLGMPTWAAVDVATMCRYCDFTEFWSPLR

SEQ ID NO: 937 - DNA, 888 bp, Haemophilus influenzae
  Name: NTH0514
atgaaatatcaagcaaaaaataccgcactttctcaagccactgattgcattgttttaggcatctatgaaaataataaattttcaaaaagttttaatgaaatcgatcaattaacccaaggttatttaaacgatttagtgaaatcaggtgagctcactggcaaattagcccaaaccattttacttcgtgatcttcaaggtttatctgctaaacgcctattaatcgttggctgtggcaaaaaaggagaactcacagagcgtcaatataaacaaatcatccaagctgtattaaagacactaaaagaaaccaacacgcgtgaagtcatttcttatttaactgaaattgaattaaaagatcgcgatctttattggaatatccgctttgccattgaaacgattgaacacaccaattatcaatttgatcatttcaaatctcaaaaagcagaaacctctgttttagaatctttcatctttaatacggattgtaatcaagcacaacaagctatttctcacgccaatgccattagctcaggcataaaagcagcacgtgacatcgcaaatatgccaccaaatatttgtaatccagcttatcttgctgagcaagcaaaaaatttagcagaaaattctaccgcactttcattgaaagttgtggatgaagaagaaatggctaaacttggaatgaacgcttatcttgccgtctcaaaaggctctgaaaaccgtgcttatatgtctgttttaacattcaataatgcgccagataaaaacgccaaacccattgtacttgtaggcaaaggattaacctttgatgctggcggtatttcacttaaacccgccgcagatatggatgaaatgaaatatgatatgtgcggtgcagcctctgtcttcggcaca

SEQ ID NO: 938 - protein, 296 aa, Haemophilus influenzae
  Name: NTH0514
MKYQAKNTALSQATDCIVLGIYENNKFSKSFNEIDQLTQGYLNDLVKSGELTGKLAQTILLRDLQGLSAKRLLIVGCGKKGELTERQYKQIIQAVLKTLKETNTREVISYLTEIELKDRDLYWNIRFAIETIEHTNYQFDHFKSQKAETSVLESFIFNTDCNQAQQAISHANAISSGIKAARDIANMPPNICNPAYLAEQAKNLAENSTALSLKVVDEEEMAKLGMNAYLAVSKGSENRAYMSVLTFNNAPDKNAKPIVLVGKGLTFDAGGISLKPAADMDEMKYDMCGAASVFGT

SEQ ID NO: 939 - DNA, 339 bp, Haemophilus influenzae
  Name: NTH0515
gtgaatgttcctgtcgaatatgtaaaagatggacagattgtattaaacttgtctgccagtgctacgggcaatttacaacttacaaatgatttcatccagtttaatgcgcgttttaaaggtgtctctcgtgaactgtatattccaatgggcgcagcccttgcgatttatgctcgtgagaatggcgatggcgtgatgtttgaacctgaggaaatttatgatgaacttaacattgagccagatactgaacaaccaacaggtttttatgaagcagtagataagcctaaaaaacgagaagaaaaaaagaaaacaaaatcagtttcccatttaagaattgtggat

SEQ ID NO: 940 - protein, 113 aa, Haemophilus influenzae
  Name: NTH0515
VNVPVEYVKDGQIVLNLSASATGNLQLTNDFIQFNARFKGVSRELYIPMGAALAIYARENGDGVMFEPEEIYDELNIEPDTEQPTGFYEAVDKPKKREEKKKTKSVSHLRIVD

SEQ ID NO: 941 - DNA, 936 bp, Haemophilus influenzae
  Name: NTH0517
atggaccaggcgcaaagtaaccggcttattggaagatttggcgattggctatgtgaaatgccagaaaaggatgccaaaattataggtatctcacctgcaatgcgtgagggttcaggtatggtagaattttcccaacgcttcccaaaccaatattttgacgtagcgattgcagaacagcacaccgtcacgtttgccacaggacttgcaattggcggatataaacctgtcgtcgcaatttactcgacatttttacaacgtgcttacgatcaattaattcatgatgttgccattcaaaatctccccgtgctatttgcgattgatcgagcagggatagttggcgcagatggggctacacatcaaggtgcattcgatattagctttatgcgttgcattccaaatatgatcattatgacgccgagtgatgaaaatgaatgccgtcaaatgctctatacaggttatcaatgtggaaaacctgcggcagtgcgttaccctcgcggaaatgccgttggtgtaaaacttactcctttagaaatgcttcctattggtaaatcacgtttaattcgaaaaggtcaaaaaattgcgattttaaattttggtactctattaccatccgctttagagttatcagaaaaactcaatgcaacggttgtcgatatgcgttttgtgaaaccgattgatattgaaatgattaatgtgcttgcacaaactcacgattatttggtcacattggaagaaaatgcaattcaaggtggagcgggatctgctgttgcggaagtactaaattcatcaggaaaatcaaccgcacttttacaacttggtttgccagattattttattccacaagcgacacggcaagaagcattggcagatttaggattggatacaaaaggcattgaagaaaaaattctcaactttattgcaaaacaaggtaattta

SEQ ID NO: 942 - protein, 312 aa, Haemophilus influenzae
  Name: NTH0517
MDQAQSNRLIGRFGDWLCEMPEKDAKIIGISPAMREGSGMVEFSQRFPNQYFDVAIAEQHTVTFATGLAIGGYKPVVAIYSTFLQRAYDQLIHDVAIQNLPVLFAIDRAGIVGADGATHQGAFDISFMRCIPNMIIMTPSDENECRQMLYTGYQCGKPAAVRYPRGNAVGVKLTPLEMLPIGKSRLIRKGQKIAILNFGTLLPSALELSEKLNATVVDMRFVKPIDIEMINVLAQTHDYLVTLEENAIQGGAGSAVAEVLNSSGKSTALLQLGLPDYFIPQATRQEALADLGLDTKGIEEKILNFIAKQGNL

SEQ ID NO: 943 - DNA, 450 bp, Haemophilus influenzae
  n 441, 442, 443, 444, 445: n is any nucleotide
  Name: NTH0518
atgagaaccacaactgcattagtaacaggtgcaaccgcaggctttggcttagcgatctgtaaaaaattgatcgaagcaggctataaagtgattggcacgggtagacgtgcagatcgattggcagaaatccattcacaattgggcaataattttctaccgcttgcctttgatattcgtgatgaacaagtcacaattaacgctctaaatacccttcctgaaggttggcaagcggtcgatttattagtgaataatgcaggtttagccttgggattagagccagcacataaagcggatttacaagattggtatcagatgatcgataccaacatcaaaggattggttactatcactcgccttgtgttgccaaatatggtcgctcgtaatcacgggcagattatcaatttgagttcaattgcagggacttatccttatgcgggcagnnnnnttaat

SEQ ID NO: 944 - protein, 150 aa, Haemophilus influenzae
  Xaa 147, 148, 149: Xaa is any amino acid
  Name: NTH0518
MRTTTALVTGATAGFGLAICKKLIEAGYKVIGTGRRADRLAEIHSQLGNNFLPLAFDIRDEQVTINALNTLPEGWQAVDLLVNNAGLALGLEPAHKADLQDWYQMIDTNIKGLVTITRLVLPNMVARNHGQIINLSSIAGTYPYAGXXXN

SEQ ID NO: 945 - DNA, 1044 bp, Haemophilus influenzae
  Name: NTH0519
ttgaggttaatcgtgagcaacacacaactgagctataaagatgctggcgtcgatattcacactggaaatgaattagtcgaacgtatcaaaggcgatgtaaaacgcactcgccgctctgaagttatgggcggattgggtggtttcggcgcattatgtgctttacccaccaaatataaagagccaattttagtttctggcacagatggcgttggcacaaaattacgtcttgcgattgacttgaaaaaacacgataccattggtcaggatttagtggcaatgtgtgtgaatgacttaatcgtacaaggtgcagaaccgcttttcttcttagattactatgctacagggaaattagacgttgatgtggcagcaagtgtgatcaaaggtattgcagatggttgtgaaatgtctggctgtgcgttagtgggtggcgaaaccaccgaaatgccaggaatgtatcacgaaggcgactatgatttggcgggtttctgcgtaggcgtggtagaaaaatcagagattattgacggcacagcagtgaaaacaggcgacacgcttatcgcactcggctcaagcggtgcacactcaaacggttattcgttaattcgcaaagtgcttgaagtaagtggtgcaaatccagcggatttattagaaggtaaaccacttagcgaacactttttagcaccaaccaaaatctatgtaaaatcgattttacagttgatcaagcagaccgaagttcacgccattgctcacttaacaggtggtggtttctgggaaaatatcccgcgtgtattacctgcaaacacaaaagcagtgattgatgaatcaagctggcaatggcctgcgatcttcaactggttacaagaaaaaggcaacatcagtcgttatgaaatgtatcgcacctttaactgtggcgtaggtatggtaatttcattaccagaaaaagaggttgaaaccgctcttgcattgcttgaacaagcgggcgaaaaagcgtgggttatcggcaaaattgaacatcttggcgaaggcgaagcacaggttgagattcaa

SEQ ID NO: 946 - protein, 348 aa, Haemophilus influenzae
  Name: NTH0519
LRLIVSNTQLSYKDAGVDIHTGNELVERIKGDVKRTRRSEVMGGLGGFGALCALPTKYKEPILVSGTDGVGTKLRLAIDLKKHDTIGQDLVAMCVNDLIVQGAEPLFFLDYYATGKLDVDVAASVIKGIADGCEMSGCALVGGETTEMPGMYHEGDYDLAGFCVGVVEKSEIIDGTAVKTGDTLIALGSSGAHSNGYSLIRKVLEVSGANPADLLEGKPLSEHFLAPTKIYVKSILQLIKQTEVHAIAHLTGGGFWENIPRVLPANTKAVIDESSWQWPAIFNWLQEKGNISRYEMYRTFNCGVGMVISLPEKEVETALALLEQAGEKAWVIGKIEHLGEGEAQVEIQ

SEQ ID NO: 947 - DNA, 222 bp, Haemophilus influenzae
  Name: NTH0520
gtgaattaccgtgagcaactactaaaacacgtttgccagaaagcattgctggtgcaatttgatcttcccagaatggtaatgcgcgttctaatgttaattttaaattttctgcgtttggcccaacctcagatggaatatttgcgtaacgacggtcactgtgtgcagaatttggattctgtggattttaatttggtggaagaatgttataagaacgacccccaa

SEQ ID NO: 948 - protein, 74 aa, Haemophilus influenzae
  Name: NTH0520
VNYREQLLKHVCQKALLVQFDLPRMVMRVLMLILNFLRLAQPQMEYLRNDGHCVQNLDSVDFNLVEECYKNDPQ

SEQ ID NO: 949 - DNA, 120 bp, Haemophilus influenzae
  Name: NTH0521
ttggcaaaacatattatcggtatttctgatgctgaaattatggattttgaaattccaacaggtcagcctttagttttaaaacttgatgataaattaaattacgtagaacattactatctt

SEQ ID NO: 950 - protein, 40 aa, Haemophilus influenzae
  Name: NTH0521
LAKHIIGISDAEIMDFEIPTGQPLVLKLDDKLNYVEHYYL

SEQ ID NO: 951 - DNA, 210 bp, Haemophilus influenzae
  Name: NTH0522
atgaaacaaggtattcatccagaatataaagaagttactgcgacttgttcttgcggtaatgtgatcaaaacacgttcaactttaggcaaagacatcaatcttgatgtgtgcggtaactgccacccattctacactggtaaacaacgtgttgttgatactggtggtcgtgtcgagcgtttcaacagccgtttcaaaattccaagcacaaaa

SEQ ID NO: 952 - protein, 70 aa, Haemophilus influenzae
  Name: NTH0522
MKQGIHPEYKEVTATCSCGNVIKTRSTLGKDINLDVCGNCHPFYTGKQRVVDTGGRVERFNSRFKIPSTK

SEQ ID NO: 953 - DNA, 219 bp, Haemophilus influenzae
  Name: NTH0523
ttgcgtccaaacttgtcgtaccaagctaaaacagatttggcaaatggcgcattgatggaagattttgctaacataaaaagaaaagtgcggttaaaaatgctgatgattttacacgaaaatagagcttgtttatctgcattttttcagtataattcgcaacctatttggtgccaattatggcgtattattcactcacgcggtgtggggagaaagttccta

SEQ ID NO: 954 - protein, 73 aa, Haemophilus influenzae
  Name: NTH0523
LRPNLSYQAKTDLANGALMEDFANIKRKVRLKMLMILHENRACLSAFFQYNSQPIWCQLWRIIHSRGVGRKFL

SEQ ID NO: 955 - DNA, 474 bp, Haemophilus influenzae
  Name: NTH0524
gtgatgttgcaacaaacgcaagttgcgacggtaattccttattttgagcggtttatcaaaacatttccaaatatcaccgcacttgccaatgcttcacaagatgaagtgttacatttatggacaggcttgggctattatgcacgagcgcgtaatttacataaagccgctcaaaaagtacgggatgaatttaatggaaatttcccgacaaattttgagcaagtttgggcgttatctggagtgggacgttcaactgctggtgccattttatcttctgttttaaatcagccttatccaattttagatggtaatgtgaaacgtgtgttggcgcgttattttgctgttgagggatggagtggcgagaaaaaagtagaaaatcgcttgtgggcattaacggagcaagttacacctacgatgcgtgtggcagattttaatcaagcaatgatggacattgggtgcaatggtttgcacgcgaac

SEQ ID NO: 956 - protein, 158 aa, Haemophilus influenzae
  Name: NTH0524
VMLQQTQVATVIPYFERFIKTFPNITALANASQDEVLHLWTGLGYYARARNLHKAAQKVRDEFNGNFPTNFEQVWALSGVGRSTAGAILSSVLNQPYPILDGNVKRVLARYFAVEGWSGEKKVENRLWALTEQVTPTMRVADFNQAMMDIGCNGLHAN

SEQ ID NO: 957 - DNA, 258 bp, Haemophilus influenzae
  Name: NTH0525
ttgggtgcaatggtttgcacgcgaactaagcccaaatgcgatctttgtccgttaaatattgattgtttggcttataaaaatacaaactgggaaaaatttccagctaaaaaacctataaaagcgatgccagaaaaaactacctattttttattttgtcgaaaatggcaaagatgtttggaacagcgagaaaactcaggattatggggcggattattttgtttttcacaatttgaagataatcctcgttgcttcattttt

SEQ ID NO: 958 - protein, 86 aa, Haemophilus influenzae
  Name: NTH0525
LGAMVCTRTKPKCDLCPLNIDCLAYKNTNWEKFPAKKPIKAMPEKTTYFLFCRKWQRCLEQRENSGLWGGLFCFSQFEDNPRCFIF

SEQ ID NO: 959 - DNA, 111 bp, Haemophilus influenzae
  Name: NTH0526
ttgaagataatcctcgttgcttcattttttagcccagaaaaagcccgcattatcagaatgcgcgagtttcgacaacatttagccttttctttagatattatccaattatgc

SEQ ID NO: 960 - protein, 37 aa, Haemophilus influenzae
  Name: NTH0526
LKIILVASFFSPEKARIIRMREFRQHLAFSLDIIQLC

SEQ ID NO: 961 - DNA, 114 bp, Haemophilus influenzae
  n 101, 102, 103, 104, 105: n is any nucleotide
  Name: NTH0527
atggaagcgcttatgcgaaagcagctatttaactggcgaaaaggtggaagccaaaaatacaatcaccttcagggcggcaatatggatgacccaaacctacnnnnnttaattaat

SEQ ID NO: 962 - protein, 38 aa, Haemophilus influenzae
  Xaa 34, 35: Xaa is any amino acid
  Name: NTH0527
MEALMRKQLFNWRKGGSQKYNHLQGGNMDDPNLXXLIN

SEQ ID NO: 963 - DNA, 510 bp, Haemophilus influenzae
  Name: NTH0528
atgtcttcgccttcatctactaagcgttattgtactgggatcgcaatattccagaaaaaaaacgatattcgctgggcaaaaggtgttattgaagttcttaaagggaatgaacacgcggttgctgataatggcaaatataaccttggtcaaaaaatgctcttttggacattaaacttggcaatggtaacgttattagtcactggcatcattatgtggcgtcaatatttttcacattacttctcaatcccagtattgcgaattgctattttactccactctgcaagtgcttttatgttattcactggtatcttagtgcatatatatatggcattttgggttaaaggatcaattcgtggtattgttgaaggttgggtaaccgttcgttgggcgaaaaaacaccacccaagatggtatcgtgaagaagttttatcaaaacttgaggaagatttactcaacgagcaatctggcaaagtaggtaaaaccaaagtcttatttaaaggatttggcaaa

SEQ ID NO: 964 - protein, 170 aa, Haemophilus influenzae
  Name: NTH0528
MSSPSSTKRYCTGIAIFQKKNDIRWAKGVIEVLKGNEHAVADNGKYNLGQKMLFWTLNLAMVTLLVTGIIMWRQYFSHYFSIPVLRIAILLHSASAFMLFTGILVHIYMAFWVKGSIRGIVEGWVTVRWAKKHHPRWYREEVLSKLEEDLLNEQSGKVGKTKVLFKGFGK

SEQ ID NO: 965 - DNA, 957 bp, Haemophilus influenzae
  n 895, 952, 953, 954, 955, 956: n is any nucleotide
  Name: NTH0529
atgagtatcaaaatcttatctgaatcagaaattaaacaagtagcaaattcatatcaagccccagcggttttatttgccaatcctaaaaatctttaccaacgcagagcgaaacgtttaagagacttagcacaaaatcatcctctatctgattatttattatttgctgcagacatagttgaaagccaactttccacgttagaaaaaaatcctttaccgccacaacagcttgaacagttaaatgctatcgagccactaaatgccaaaacctttaagagagacagtatctggcgtgaatacttaactgaaattcttgatgaaataaagcccaaagctaacgagcaaattgctgcaacaattgaatttcttgaaaaagcctcttctgctgaattagaggaaatggcaaataagctcttagcacaagaatttaatttagtcagcagtgataaagccgtctttatttgggctgcactttctctttattggttacaagcagctcaacaaattccccataatagccaagttgaaaacgctgaaaatttacatcactgccctgtttgtggttctttacctgttgcaagtattgtacagattggtacatcacaaggtttacgctacttacattgtaatttatgtgaaagtgaatggaatttggtacgcgcacaatgcaccaattgtaatagtcatgacaaacttgaaatgtggtcattaaatgaagaacttgcgcttgctcccgccgaaacctgtggtattctgggaagctatctcgaatatgtcccccctttattaagatcctcacccccacctttgttccccacgcactgtttttcacttttttacacttcgaaacgcacccatttggtccttttatccgtccttattccccttattccgcttnttccatccccccttatttccgcgccatttatagctctttatctcctctattttctcnnnnnt

SEQ ID NO: 966 - protein, 319 aa, Haemophilus influenzae
  Xaa 299, 318, 319: Xaa is any amino acid
  Name: NTH0529
MSIKILSESEIKQVANSYQAPAVLFANPKNLYQRRAKRLRDLAQNHPLSDYLLFAADIVESQLSTLEKNPLPPQQLEQLNAIEPLNAKTFKRDSIWREYLTEILDEIKPKANEQIAATIEFLEKASSAELEEMANKLLAQEFNLVSSDKAVFIWAALSLYWLQAAQQIPHNSQVENAENLHHCPVCGSLPVASIVQIGTSQGLRYLHCNLCESEWNLVRAQCTNCNSHDKLEMWSLNEELALAPAETCGILGSYLEYVPPLLRSSPPPLFPTHCFSLFYTSKRTHLVLLSVLIPLIPLXPSPLISAPFIALYLLYFLXX

SEQ ID NO: 967 - DNA, 411 bp, Haemophilus influenzae
  n 406, 407, 408, 409, 410: n is any nucleotide
  Name: NTH0530
atgaatataaaggatgagcatatagatagcgtttgctccttgttagatcagttagtaggaaatgtttcctttaaaaatctttttactggttacggtttgtttcacaaggaagagacaatgtttgctatttggcaaaataaaaaactttatttacgcggtgagggtgttctcgcaattcaattaactaaattaggttgtgaaccttttacaacgaatgaattgaataaacggtttgtgctttcacaatattatgcactttctgatcagattttacgtagtaatagattgtgtagaaaattgattattctttctattaagcagattcttgagcggaagctagaatgtacgttaagaaaattgaatcgattaaaggatttacccaatttaacgattaaacagaaagagnnnnnt

SEQ ID NO: 968 - protein, 137 aa, Haemophilus influenzae
  Xaa 136, 137: Xaa is any amino acid
  Name: NTH0530
MNIKDEHIDSVCSLLDQLVGNVSFKNLFTGYGLFHKEETMFAIWQNKKLYLRGEGVLAIQLTKLGCEPFTTNELNKRFVLSQYYALSDQILRSNRLCRKLIILSIKQILERKLECTLRKLNRLKDLPNLTIKQKEXX

SEQ ID NO: 969 - DNA, 93 bp, Haemophilus influenzae
  n 80, 81, 82, 83, 84: n is any nucleotide
  Name: NTH0531
ttggatgagagtctatttttatggatcacttgggtacagttgcgttgggattggtgcttgccaatggctcaattgaaatnnnnnttaattaat

SEQ ID NO: 970 - protein, 31 aa, Haemophilus influenzae
  Xaa 27, 28: Xaa is any amino acid
  Name: NTH0531
LDESLFLWITWVQLRWDWCLPMAQLKXXLIN

SEQ ID NO: 971 - DNA, 1713 bp, Haemophilus influenzae
  n 1608, 1708, 1709, 1710, 1711, 1712: n is any nucleotide
  Name: NTH0532
gtgttaaatattcaggtaaatatttcaattaatcacactgctaataatcaattatcttattttcatcgccagggttatacatattggaatttgacgcagcttaatgttgattctgattctagtttttctttaacatcaataaaagacgcgattaaagttgggggatatgacaatgctaaagacaaaaaaaacacaggagggattggttttacacgagataccattttcaatgtaaaacaaggtgctagagttgatatttcctacaccctaccgatatctccagttaaaaattcaagaattgctgctgtcaattttgacggaaatattactgttaaaggaggaggagttgttaatttaaaatttaatgcgcttagcaataactacaaaactccaggggtgaacatttcctctagatttattaatgttaccgaaggttcgcagctaaacattactggtagtatgccatctacaaccttatttaatgtagcaaatgatttaatcataaacgcaaccaattcatttgtatccattaaagaaattgaaggtacagatactcatcttgatacaggtttaaaggtaaacggtaatgttaccattaaaggagggaatgtcaccctaggttcaaataaagctaaaaccaaatttgataaaaatgtaactgttgaaaagggtgcaaatcttactcttgcgtcagcaaactttggaaatcataagggtgctttagctgtagctggaaatatcaatactcaaggtaagcttgttgcaactggcgatactattgatgtatctggtgattttactgttggaaacgatgctacttttaatggtaatactaataacaacctaaacattaccggcaattttaccaacaacggcacctccataattgatgtaaaaaaaggggcggcaaaactaggtaatattaccaatgaaggtagtttaaatattactactcacgctaacactaatcaaaaaaccattattaccggaaatataaccaataaaaaaggcgacttaaacatcagggataataaaaataatgccgaaatccaaattggcggcaatatctcgcaaaaagaaggcaatctcacaatttcttctgataaagtcaatattaccaagcagataacaatcaaagcaggcgttaatggggagaattctgattcaggcacagaaaacaatgccaatctaaccattaaaaccaaaacgctagaattaacaaacaacctaaacatttcaggctttcataaagcagaaattacagctaaagataacagtgatttaattattggcaaggctagcagtgatagcggtaatgctggtgctcaaaaagtaatctttgacaaggttaaagattcaaaaatctcagctggcaatcacaatgtaacactaaatagcgaagtggaaacgtctaatggtaatagtaatgctgctggcgatagtaatggtaacaacgctggtttaactatttccgcaaaagatgtggcagtaaataataacatcacttctcacaagacaataaatatctctgccacaacaggaaatgtaacaaccaaagaaggcacaaccattaatgcgaccacaggtggcgtgggagtaaccgctaanacaggtgacattaaaggtggaattgagtccaagtctggcggagtaacacttactgcaaccggagatactcttgctgtaggtaatatttcgggtacactgnnnnnt

SEQ ID NO: 972 - protein, 571 aa, Haemophilus influenzae
  Xaa 536, 570, 571: Xaa is any amino acid
  Name: NTH0532
VLNIQVNISINHTANNQLSYFHRQGYTYWNLTQLNVDSDSSFSLTSIKDAIKVGGYDNAKDKKNTGGIGFTRDTIFNVKQGARVDISYTLPISPVKNSRIAAVNFDGNITVKGGGVVNLKFNALSNNYKTPGVNISSRFINVTEGSQLNITGSMPSTTLFNVANDLIINATNSFVSIKEIEGTDTHLDTGLKVNGNVTIKGGNVTLGSNKAKTKFDKNVTVEKGANLTLASANFGNHKGALAVAGNINTQGKLVATGDTIDVSGDFTVGNDATFNGNTNNNLNITGNFTNNGTSIIDVKKGAAKLGNITNEGSLNITTHANTNQKTIITGNITNKKGDLNIRDNKNNAEIQIGGNISQKEGNLTISSDKVNITKQITIKAGVNGENSDSGTENNANLTIKTKTLELTNNLNISGFHKAEITAKDNSDLIIGKASSDSGNAGAQKVIFDKVKDSKISAGNHNVTLNSEVETSNGNSNAAGDSNGNNAGLTISAKDVAVNNNITSHKTINISATTGNVTTKEGTTINATTGGVGVTAXTGDIKGGIESKSGGVTLTATGDTLAVGNISGTLXX

SEQ ID NO: 973 - DNA, 363 bp, Haemophilus influenzae
  n 23, 327: n is any nucleotide
  Name: NTH0534
ttgctgcctgcggtcgactctangagacccctcattaaggccgatagaggcgattcacctaataaaattctagcagataataaacatactgttaataacaaaacattatctacagctttagctaaaggtattggagttaatatttctgctaaaaagaaagtaaatgttactgcagatattaatgttcataatggaacattaacgttacactcagaacaaggtggagttgaaattaacggtgatattacctcagaacaaaatggtaatttaaccattaaagcaggtagctgggttgatgttcacaaaaatatcacgattggtatgggngtttttaaatattaccgctgggggttctgtagcttt

SEQ ID NO: 974 - protein, 121 aa, Haemophilus influenzae
  Xaa 8: Xaa is any amino acid
  Name: NTH0534
LLPAVDSXRPLIKADRGDSPNKILADNKHTVNNKTLSTALAKGIGVNISAKKKVNVTADINVHNGTLTLHSEQGGVEINGDITSEQNGNLTIKAGSWVDVHKNITIGMGVFKYYRWGFCSF

SEQ ID NO: 975 - DNA, 867 bp, Haemophilus influenzae
  Name: NTH0535
atggcggaatttggttcttgccatcgtaatgaaccatcaggttctttgcacggtttaatgcgtgttcgtggctttactcaagatgatgcgcacattttctgtactgaagatcaaattgagagcgaagtaactagctgtatcaaaatggtgtacgacatttatagcacctttggtttcactaatatcgcagtgaaactttctactcgtccggaaaatcgtatcggttcagatgagatgtgggatcgagcggaagcaggtcttgcagcagcattagcacacaacggtcttgaatatgaaatccaagaaggtgaaggcgcattctatggtccgaaaattgagtttgcactacgagattgtttaggtcgtgaatggcaatgtggtacagtgcaattagacttcgcattaccaggtcgtttagatgcaacttatgtggcagaagataatagccgtaaaacccctgtcatgattcaccgtgcgattttaggttctattgagcgtttcattggtatcattactgaagaatatgctggtttcttccctgcgtggttagccccaacccaagcagttgtgatgaatatcactgatagccaagctgactatgtacaacaagtcgttaaaaccttatctgatgcaggtttacgtgttaaagcagacctccgaaatgaaaaagtgggcttcaaaattcgtgaacatactttacgtcgcgtgccttatatgctcgtttgtggcgataaagaaatcgcagaaggaaaagtggctgtacgtacccgtaaaggtgctgatttaggtacatttactgtggaagaatttgcggaaatcttgaaaaatcaagtaagaagtcgtgaattaaagttattgaatgaagag

SEQ ID NO: 976 - protein, 289 aa, Haemophilus influenzae
  Name: NTH0535
MAEFGSCHRNEPSGSLHGLMRVRGFTQDDAHIFCTEDQIESEVTSCIKMVYDIYSTFGFTNIAVKLSTRPENRIGSDEMWDRAEAGLAAALAHNGLEYEIQEGEGAFYGPKIEFALRDCLGREWQCGTVQLDFALPGRLDATYVAEDNSRKTPVMIHRAILGSIERFIGIITEEYAGFFPAWLAPTQAVVMNITDSQADYVQQVVKTLSDAGLRVKADLRNEKVGFKIREHTLRRVPYMLVCGDKEIAEGKVAVRTRKGADLGTFTVEEFAEILKNQVRSRELKLLNEE

SEQ ID NO: 977 - DNA, 288 bp, Haemophilus influenzae
  Name: NTH0536
atggagcaacatatggtttctacctccttaacggctgaaaaacgtaaagaacgagccgagaaagcagcgttagcacgctgggaacataaaaaagcactagaagaactccctttagctattcacgaaggcgtattaagcattggtgataaatcgcttgatgtggcagtgcttcaaaatgacttacgcattatttcaagtgcttctgtttttgaagcattagatcgcccaaatcgtggttctcgtggtggcgcaataacagaaaacgaagaattgatcaaactcctgcgt

SEQ ID NO: 978 - protein, 96 aa, Haemophilus influenzae
  Name: NTH0536
MEQHMVSTSLTAEKRKERAEKAALARWEHKKALEELPLAIHEGVLSIGDKSLDVAVLQNDLRIISSASVFEALDRPNRGSRGGAITENEELIKLLR

SEQ ID NO: 979 - DNA, 783 bp, Haemophilus influenzae
  Name: NTH0537
atgttcgacagtgcgactaatacaataccgaaagggaataagtccgctggattcttgaccagttttgagctgtcgaacgcccgatttatcgggggcttccatcaaaaggaaatcaagatgactactcaaatccaattctcaatatttaatttcaaaaattccccagttcgcacgattaccgatcctaatagtgaaatttggttctgtggcacagatgtgtgcgatattctcggttatgtaaatgcgcctgatgcaatgaaaaaacattgtaaagaagctggtatagcaaaacgctatatcagctatccaagcggtagaaaggaagcgatctttatcaatgaaccaaatctttaccgtctgatcatcaaatctcgtaaaccagaagctgaaccatttgaagcgtgggtatttgaagaagttcttccgcaaattcgtaaaacaggaaaatatcaacttcaaccgcaacagctcgccttgccagaacccgaaaagaaattcagttttgaatttaccgagtatgaacttcaacagcttgtttggttgtggttcgctttcatgcgtggcatcgtcacattccaacatatcgaaaaagcctttagagttttaggctcaaatatgagttcacaaatctacgggcaggcttacgagtatctaagcgtgctacgctctaccaatcaaatcttaaaccgcatcacaagtgattttgacatcgaccaaatgacaaactggcgtgtattaaaacacttgcgaggctttaatccaaaagcagtcaaaatcgacttc

SEQ ID NO: 980 - protein, 261 aa, Haemophilus influenzae
  Name: NTH0537
MFDSATNTIPKGNKSAGFLTSFELSNARFIGGFHQKEIKMTTQIQFSIFNFKNSPVRTITDPNSEIWFCGTDVCDILGYVNAPDAMKKHCKEAGIAKRYISYPSGRKEAIFINEPNLYRLIIKSRKPEAEPFEAWVFEEVLPQIRKTGKYQLQPQQLALPEPEKKFSFEFTEYELQQLVWLWFAFMRGIVTFQHIEKAFRVLGSNMSSQIYGQAYEYLSVLRSTNQILNRITSDFDIDQMTNWRVLKHLRGFNPKAVKIDF

SEQ ID NO: 981 - DNA, 144 bp, Haemophilus influenzae
  n 139, 140, 141, 142, 143: n is any nucleotide
  Name: NTH0539
gtgtggcggatttttacacctcaaattcacgaaaaaggatacattatgttcagaattctctttgcggtggcgttgttatgggcagcatacgaactcaatttaaaccaagattgcgatgggtatattgcgggggatttcnnnnnt

SEQ ID NO: 982 - protein, 48 aa, Haemophilus influenzae
  Xaa 47, 48: Xaa is any amino acid
  Name: NTH0539
VWRIFTPQIHEKGYIMFRILFAVALLWAAYELNLNQDCDGYIAGDFXX

SEQ ID NO: 983 - DNA, 552 bp, Haemophilus influenzae
  Name: NTH0540
ttgcttgatttagaattgagtgcgttggagcgtgaaaataatgtagaaattattgcaagtcctcgcttactcactaccaataagaaaagtgcgagcattaaacaggggacagaaattccttacatcgtgagtaatactcgtaacgatacgcaatctgtggaatttcgtgaggcagtacttggtttggaagtgacgccacatatttctaaagataacaatatcttacttgatttattggtaagtcaaaattcccctggttctcgtgtcgcttatggacaaaatgaggtggtttctattgataagcaagaaattaatactcaggtttttgccaaagatggggaaaccattgtgcttggcggcgtatttcacgacacaatcacgaaaagcgaagataaagtgccattgcttggcgatatacccgttattaaacgattatttagcaaagaaagtgaacgacatcaaaaacgtgagctcgtgattttcgtcacgccgcatattttaaaagcaggagaaacgttagaggcgttgaaacaaaaaagtgcggggaaaaaa

SEQ ID NO: 984 - protein, 184 aa, Haemophilus influenzae
  Name: NTH0540
LLDLELSALERENNVEIIASPRLLTTNKKSASIKQGTEIPYIVSNTRNDTQSVEFREAVLGLEVTPHISKDNNILLDLLVSQNSPGSRVAYGQNEVVSIDKQEINTQVFAKDGETIVLGGVFHDTITKSEDKVPLLGDIPVIKRLFSKESERHQKRELVIFVTPHILKAGETLEALKQKSAGKK

SEQ ID NO: 985 - DNA, 639 bp, Haemophilus influenzae
  n 594, 600, 619, 624, 634, 635, 636, 637, 638: n is any nucleotide
  Name: NTH0542
atgaatttttttaattttcgctgtatccactgtcgtggcaatcttcatattgcaaaaaatgggctatgttcaggttgccaaaaacaaattaaatcttttccttattgcggtcattgtggtgcggaattgcaatattatgcgcagcattgtggtaattgtcttaaacaagaaccaagttgggataagatggtcattattgggcattatattgaacctctttcgatattgattcaccgttttaaatttcaaaatcaattttggattgaccgcactttagctcggcttttatatcttgcggtgcgtgatgctaaacgaacgcatcaacttaaattgccagaagcaatcattccagtgcctttatatcattttcgtcagtggcgacggggttataatcaggcagatttattatctcggcaattaagtcgctggctggatattcctaatttgagcaatatcgtaaagcgtgtgaaacacacctatactcaacgtggtttgagtgcaaaagatcgtcgtcagaatttaaaaaatgcctttctcttgttgtttcgaaaaatgaatttccttatcgccgtgttgcgttggtggatgatgtgnttactnacgggtaccgaaggcccgnaattncgaataacannnnnt

SEQ ID NO: 986 - protein, 213 aa, Haemophilus influenzae
  Xaa 198, 207, 208, 212, 213: Xaa is any amino acid
  Name: NTH0542
MNFFNFRCIHCRGNLHIAKNGLCSGCQKQIKSFPYCGHCGAELQYYAQHCGNCLKQEPSWDKMVIIGHYIEPLSILIHRFKFQNQFWIDRTLARLLYLAVRDAKRTHQLKLPEAIIPVPLYHFRQWRRGYNQADLLSRQLSRWLDIPNLSNIVKRVKHTYTQRGLSAKDRRQNLKNAFLLLFRKMNFLIAVLRWWMMXLLTGTEGPXXRITXX

SEQ ID NO: 987 - DNA, 660 bp, Haemophilus influenzae
  Name: NTH0543
ttgaatcaagcgacagatagtgcattacgttatgttattgggcatatgtctatgaatgatattttaaccacaggtcgctctgtcgtgcgtgaaaatacttggaaagctttgaatgaaattatcaaatcctatgatatgggacttgaggttattgatgtgaacttccaatctgctcgtccacctgaagaagtaaaagatgcgtttgatgatgcaattaaagcgcaggaagatgaacaacgttttattcgtgaagcggaagcctatgcgcgtgagaaagaaccgattgcacgcggtgatgcacaacgtattcttgaagaagcaacagcttataaagatcgtatcgtgttagatgcaaaaggtgaagtggaacgtttgcaacgcttgttgccagaatttaaggctgcaccagatttactgcgtgagcgtttatatattcagacgatggaaaaagtgatggcaaataccccaaaagtaatgcttgatggcaataatggtaataatttaactgtgttaccgctagagcaaattatgggcaaaaaatcggtaacaagtgcgccaagtgcggtcaattcttcgcctgcttttactgcaccagaacgtcaaaattcttatcagcctcagccgactaccgttgcgccgattcgtcaagggagatttaac

SEQ ID NO: 988 - protein, 220 aa, Haemophilus influenzae
  Name: NTH0543
LNQATDSALRYVIGHMSMNDILTTGRSVVRENTWKALNEIIKSYDMGLEVIDVNFQSARPPEEVKDAFDDAIKAQEDEQRFIREAEAYAREKEPIARGDAQRILEEATAYKDRIVLDAKGEVERLQRLLPEFKAAPDLLRERLYIQTMEKVMANTPKVMLDGNNGNNLTVLPLEQIMGKKSVTSAPSAVNSSPAFTAPERQNSYQPQPTTVAPIRQGRFN

SEQ ID NO: 989 - DNA, 885 bp, Haemophilus influenzae
  Name: NTH0544
atgcgtagatttttattacctgttattttcgtgattgcggcagtggtttattctagtatcgtcgttgtaacggaaggtacccgtggcattatgttacgatttaacaaagtacagcgtgatgctgataacaaagtggttgtatatgaaccaggcttgcattttaaagtgcctttaattgatagcatcaaagttttagatgcgcgtattcgtactttagatggctctgcaacacgttttgttactgttgagaaaaaagatttgctagtggattcttatgtgaaatggaaaatcagtgattttggtcgattctacacatctactggcggtggcgattatgctcaagctgcaaatttattaagtcgtaaagtaaacgaccgtttacgttctgaaattggttcacgcacgattaaagatattgtttctggtacacgtggagaattaatggaaggggcaaaaaaagctttaagttcaggacaagacagtacggcagaattaggtattgaagtgatcgatgtgcgtgtaaaacaaattaatttaccagatgaagtctcttcttcgatttaccaacgtatgcgtgcagaacgtgatgcagtggcgcgtgaacatcgttctcaagggaaagaaaaagcagcatttattcaagctgatgtagatcgcaaagtgacgttaattcttgctaatgcaaataaaactgcacaagaattacgaggttcaggcgatgcagctgcagcaaaattatattcagatgcttttgctcaagaaccacaattctttacttttgtgcgtagcttaaaagcctatgaagcgagttttgcaaattctgacaatataatgattttaaaaccagatagtgatttcttccgctttatgcaggcaccgaaaaaa

SEQ ID NO: 990 - protein, 295 aa, Haemophilus influenzae
  Name: NTH0544
MRRFLLPVIFVIAAVVYSSIVVVTEGTRGIMLRFNKVQRDADNKVVVYEPGLHFKVPLIDSIKVLDARIRTLDGSATRFVTVEKKDLLVDSYVKWKISDFGRFYTSTGGGDYAQAANLLSRKVNDRLRSEIGSRTIKDIVSGTRGELMEGAKKALSSGQDSTAELGIEVIDVRVKQINLPDEVSSSIYQRMRAERDAVAREHRSQGKEKAAFIQADVDRKVTLILANANKTAQELRGSGDAAAAKLYSDAFAQEPQFFTFVRSLKAYEASFANSDNIMILKPDSDFFRFMQAPKK

SEQ ID NO: 991 - DNA, 339 bp, Haemophilus influenzae
  Name: NTH0545
gtgattgtttttgttatttccctttcatttttgattgctttaagcagcgttatgcaattctttatatgtaaaacctccattaatcctcgtgactttaaaggcacaacaaaattagtttccacaggcatatttcgatttagccgtaacccaatgtatttaagtttgctgttaattttgcttgcttggacgctttggttaggtaatagtttagcttggttaggcgtaattgtctttatactagttatgaaccactgtcaaatagcccgagaagaagcctatttggaaaataaatttggcgatgaatatcgtcgttacaaacaaaaagtaagacgttggcta

SEQ ID NO: 992 - protein, 113 aa, Haemophilus influenzae
  Name: NTH0545
VIVFVISLSFLIALSSVMQFFICKTSINPRDFKGTTKLVSTGIFRFSRNPMYLSLLLILLAWTLWLGNSLAWLGVIVFILVMNHCQIAREEAYLENKFGDEYRRYKQKVRRWL

SEQ ID NO: 993 - DNA, 222 bp, Haemophilus influenzae
  n 213, 214, 215, 216, 217: n is any nucleotide
  Name: NTH0547
atgtttggattcgacccaagtcttattacttttactatttatattttcgggatgttgctgattggcgtactcgcctattattacacgaataatttatcagattacattctcggtggacgtcgtttaggcagttttgttactgcaatgtctgcaggtgcgtcagatatgtctggttggcttttaaggggggtaccgagtccgaatcgtaaacannnnnttaat

SEQ ID NO: 994 - protein, 74 aa, Haemophilus influenzae
  Xaa 71, 72, 73: Xaa is any amino acid
  Name: NTH0547
MFGFDPSLITFTIYIFGMLLIGVLAYYYTNNLSDYILGGRRLGSFVTAMSAGASDMSGWLLRGVPSPNRKXXXN

SEQ ID NO: 995 - DNA, 912 bp, Haemophilus influenzae
  Name: NTH0548
atggatgctgtcgagttattgatgaacgtaacgcctaacgaaacacgcattgcgctagtagaaacaggaatgttgcgcgaagtgcatattgaacgccaagctaaacgaggaattgtcggaaacatttataaaggtcgtgtcactcgagtgttaccaggaatgcagtcggcttttgttgatattggtttggaaaaagcggcttttttacacgctgcggacattgtatcccatacagaatgtgtagatgaaaatgaacaaaagcaatttaaagttaagagcatttcagaattagtacgagaagggcaggatattgttgtacaagtggtgaaagagccgctaggtacaaaaggtgcacgtttaacaacggatatcacattgccatcgcgtcatcttgtttttatgcctgaaaatagccacgtaggcgtttcacaacgcattgaaagcgaagaagaacgcgcccgtttaaaagcattagttgaacctttttgtgatgaactcggcggttttattattcgtaccgccacagaaggggcaagcgaagaagaattacgtcaagacgctgaatttttaaaacgcttatggcgtaaagttttagaacgtaaatctaagtacccaaccaaatcaaaaatttacggcgagccagcacttccacaacgtattttgcgcgattttatcggcacaaacttagaaaaaattcgtatcgactctaaactttgctttggcgaagtaaaagagtttaccgatgaatttatgcctgaattaagcgataaacttgttctttattctggcaatcaacctatctttgatgtgtacggggttgaaaatgcgatccaaacagccttagataaacgtgttaatctcaaatcgggcggctatttaattatcgagcaaacagaagccatgaccacccat

SEQ ID NO: 996 - protein, 304 aa, Haemophilus influenzae
  Name: NTH0548
MDAVELLMNVTPNETRIALVETGMLREVHIERQAKRGIVGNIYKGRVTRVLPGMQSAFVDIGLEKAAFLHAADIVSHTECVDENEQKQFKVKSISELVREGQDIVVQVVKEPLGTKGARLTTDITLPSRHLVFMPENSHVGVSQRIESEEERARLKALVEPFCDELGGFIIRTATEGASEEELRQDAEFLKRLWRKVLERKSKYPTKSKIYGEPALPQRILRDFIGTNLEKIRIDSKLCFGEVKEFTDEFMPELSDKLVLYSGNQPIFDVYGVENAIQTALDKRVNLKSGGYLIIEQTEAMTTH

SEQ ID NO: 997 - DNA, 324 bp, Haemophilus influenzae
  Name: NTH0549
ttgtggggcatcgtaatctataagaaaccatctttcaataccaatattgaagcaactaagccatttgcgcagcactccaactacgtaatcttggtgggcataatcattattgattttattgatatgcaaacagatgaacatcgcaatcgagtattgcaatctttatgtgatgcgctttctaaagatcgtatgaaaactaatgtgaatggctttacgcaattaaggcttgtagaaatgactccgaaaagaacccgcgaaagccttgaacacgtgctatgcgatgaatggccaacttggcatggaccgggtcgcggtgaaaacctg

SEQ ID NO: 998 - protein, 108 aa, Haemophilus influenzae
  Name: NTH0549
LWGIVIYKKPSFNTNIEATKPFAQHSNYVILVGIIIIDFIDMQTDEHRNRVLQSLCDALSKDRMKTNVNGFTQLRLVEMTPKRTRESLEHVLCDEWPTWHGPGRGENL

SEQ ID NO: 999 - DNA, 279 bp, Haemophilus influenzae
  Name: NTH0550
gtgagacaggttggtaccaaattatgcgtggaattattccggggggatcatttatttcaggagtggcactttggtggttatgcctgcgcagccgtttcacaaaattttattaatgaaaaattctcccggttactgccccaaagggaatgggtttttgggaaagcggttaaggtaaaacggacccgtttttatcccaaacaacttgtggggggggttatgggaaccccttttccaaaagggggggaaaaatttttggaacttttcccgcctttttttttt

SEQ ID NO: 1000 - protein, 93 aa, Haemophilus influenzae
  Name: NTH0550
VRQVGTKLCVELFRGDHLFQEWHFGGYACAAVSQNFINEKFSRLLPQREWVFGKAVKVKRTRFYPKQLVGGVMGTPFPKGGEKFLELFPPFFF

SEQ ID NO: 1001 - DNA, 651 bp, Haemophilus influenzae
  n 642, 643, 644, 645, 646: n is any nucleotide
  Name: NTH0552
atgtctgatgtttttgaattagaaaatgaaatcgaattagagagcgatgaagtcattatggaaaatgaaaacgtcgaagaaatcgttgacgcacctatgccttttagcatgacgacaaataatggtgtagagcgtggtaaattccgttctttaaccttaattaactggaatggtttttttgcccgtactttcgatttagatgaattagttaccacgctttctggtggtaacggtgcaggtaaatcaaccacaatggctggatttgtgaccgcattaattcccgatttaacccttttacatttccgtaatacaacagaggctggctccacaggcggttctcgcgataaaggtttacatggtaaattgcgtccaggtgtttgttacgcggtattagataccattaactcacgtcatcaacgtattcttgtcggtgtgcgtctgcagcaaattgcgggtcgtgataaaaaggttgatttaaaaacgttttcaattcaaggtgtagaattatctcaaaatccgaccgcacttttcacagaaaccgtgggcgaacgtcaagctcgcgtccttaatttaaacgaactcaaagataaaattgaaaatatcggtgcacaatttaaacaatatcatccatcaccgattatnnnnnttaat

SEQ ID NO: 1002 - protein, 217 aa, Haemophilus influenzae
  Xaa 214, 215, 216: Xaa is any amino acid
  Name: NTH0552
MSDVFELENEIELESDEVIMENENVEEIVDAPMPFSMTTNNGVERGKFRSLTLINWNGFFARTFDLDELVTTLSGGNGAGKSTTMAGFVTALIPDLTLLHFRNTTEAGSTGGSRDKGLHGKLRPGVCYAVLDTINSRHQRILVGVRLQQIAGRDKKVDLKTFSIQGVELSQNPTALFTETVGERQARVLNLNELKDKIENIGAQFKQYHPSPIXXXN

SEQ ID NO: 1003 - DNA, 744 bp, Haemophilus influenzae
  Name: NTH0554
atgagatcgagggagacgagaggcgagcagctacaagggttacttcccgacacggtcgtgtgcaatgccaataccaaatttgcagcgagaagaaataagaggggcacggggcgccagacaggcccgggccttagaatatctcgcctgtctaatgcgtttcccaaagaaataggcggctttcatcgtcgctatccgtggacctattcgtggcgccagaaggattcttctatcttcgccggagagcaccgaccattaattgcacgttcagtactggctgagttggaaatgcttgttggtaaagtgctttgttatctttatttaagcccagaacgtttagcccaacaaggtatttttagcacgcaagaagtgtatgatgaattattaaatcttgctgatgaaggaaaattattaaaagcagttaatcagcgttcaagtggttctgacttagataaacaaaaattggcagaaaaagtgcgagctgcaattggtcgtttacgtcgtttaggtatgattcaaaccgttggcgaacaaaatagtgggaaatttactatttctgaatctgtatttcgttttggggcggaagtgcgtagcggagatgatccattagaggcccaagctagactcattcgtgatggggaagcggcaacacctgaatccttatcgttggaaaaacaagcacaattagtggaaaacgatacagaaagtgcggatgaaattgacgaagaatttgacggagaacaagaa

SEQ ID NO: 1004 - protein, 248 aa, Haemophilus influenzae
  Name: NTH0554
MRSRETRGEQLQGLLPDTVVCNANTKFAARRNKRGTGRQTGPGLRISRLSNAFPKEIGGFHRRYPWTYSWRQKDSSIFAGEHRPLIARSVLAELEMLVGKVLCYLYLSPERLAQQGIFSTQEVYDELLNLADEGKLLKAVNQRSSGSDLDKQKLAEKVRAAIGRLRRLGMIQTVGEQNSGKFTISESVFRFGAEVRSGDDPLEAQARLIRDGEAATPESLSLEKQAQLVENDTESADEIDEEFDGEQE

SEQ ID NO: 1005 - DNA, 600 bp, Haemophilus influenzae
  n 587, 588, 589, 590, 591: n is any nucleotide
  Name: NTH0555
ttgttgttgaaaggagtgattatgcaggtctcaagaagaaaattcttcaagatctgtgcaggaggtatggcgggaacgtcagctgcaatgttgggctttgctccagcaaacgtattagctgcgccacgcgaatataaattattacgcgcgtttgaatcccgtaacacctgtacatattgcgctgtaagttgcggtatgttgttatatagcacaggcaaaccttacaattcattaagcagccatactggcacaaatactcgttcaaaactctttcatattgagggtgatccagatcatccagtcagtcgtggtgcgctttgcccgaaaggtgctggctcactcgattatgtcaatagtgaaagccgttctttatatcctcaatatcgtgcgccaggttctgataaatgggaacgaatttcttggaaagatgccattaaacgtattgctcgtttaatgaaagatgaccgagatgccaactttgttgaaaaagattcaaatggaaaaacggttaatcgttgggcaacgacaggaattatgactgctcagccaatgagcaatgagggtaccgagtccgaattcgaaaacannnnnttaattaat

SEQ ID NO: 1006 - protein, 200 aa, Haemophilus influenzae
  Xaa 196, 197: Xaa is any amino acid
  Name: NTH0555
LLLKGVIMQVSRRKFFKICAGGMAGTSAAMLGFAPANVLAAPREYKLLRAFESRNTCTYCAVSCGMLLYSTGKPYNSLSSHTGTNTRSKLFHIEGDPDHPVSRGALCPKGAGSLDYVNSESRSLYPQYRAPGSDKWERISWKDAIKRIARLMKDDRDANFVEKDSNGKTVNRWATTGIMTAQPMSNEGTESEFENXXLIN

SEQ ID NO: 1007 - DNA, 735 bp, Haemophilus influenzae
  Name: NTH0557
atgcagtgctggattcgacaaactatcaacttttttagaaagacaaaaaatacagaaaaattgaccgcacttttgcaacaaaaagaggacatactggctgttgagatgccagtttctttagtatataacgggatttctcacgcagttatgatgtgttccccaaacaatttagaggattttgctttaggcttttctataacagagggaattattgataaaccagaagatatttatggcattgatgttgtagaagtttgcaatggtattgaagtgcaaattgaactttccagccgtaaatttatggcattaaaagagcatcgtcgtaatcttacggggcgtacaggctgtggtatttgtggtacagaacaattgaatcaagtatataaaacttttccaaaattagactgtacttttcaatttgatttaaatttgctagatagttgtcttattgatcttcaaaaaaatcaattacttggatgtaaaactggtgctacccatgcttgtgcatttttcgatttatatggaaatatgttagctatttacgaagatgtaggtcgccacgttgcgttagataaattgcttggttggcacgcaaaatcgggtaagcctagaggttttattttagcctccagtcgagcgagttatgaaatggtgcaaaaaacagtggctgcggggtggaatgttagtcacgatttccgccgcaacggatttagcagtaacaatggcagagaaaca

SEQ ID NO: 1008 - protein, 245 aa, Haemophilus influenzae
  Name: NTH0557
MQCWIRQTINFFRKTKNTEKLTALLQQKEDILAVEMPVSLVYNGISHAVMMCSPNNLEDFALGFSITEGIIDKPEDIYGIDVVEVCNGIEVQIELSSRKFMALKEHRRNLTGRTGCGICGTEQLNQVYKTFPKLDCTFQFDLNLLDSCLIDLQKNQLLGCKTGATHACAFFDLYGNMLAIYEDVGRHVALDKLLGWHAKSGKPRGFILASSRASYEMVQKTVAAGWNVSHDFRRNGFSSNNGRET

SEQ ID NO: 1009 - DNA, 114 bp, Haemophilus influenzae
  Name: NTH0558
atggcagagaaacataatttgactttaattggttttgctagggaaggaaaagggaatatttatagtggggcatcaacgacttcacaattaaccccaactaagagcgagagtttt

SEQ ID NO: 1010 - protein, 38 aa, Haemophilus influenzae
  Name: NTH0558
MAEKHNLTLIGFAREGKGNIYSGASTTSQLTPTKSESF

SEQ ID NO: 1011 - DNA, 108 bp, Haemophilus influenzae
  n 95, 96, 97, 98, 99: n is any nucleotide
  Name: NTH0559
atggaattttttattccgccgcgtaaagaaaacccccgcccaattattcaaaatccacccgccttttgttacacccaaacggccgcattagggcnnnnnttaattaat

SEQ ID NO: 1012 - protein, 36 aa, Haemophilus influenzae
  Xaa 32, 33: Xaa is any amino acid
  Name: NTH0559
MEFFIPPRKENPRPIIQNPPAFCYTQTAALGXXLIN

SEQ ID NO: 1013 - DNA, 90 bp, Haemophilus influenzae
  Name: NTH0560
gtggcatttcaatatgtcatgccacaaatttatttaactcaaattgctggctgggttgctaaacaaaaatggggcaaaaaacacattttg

SEQ ID NO: 1014 - protein, 30 aa, Haemophilus influenzae
  Name: NTH0560
VAFQYVMPQIYLTQIAGWVAKQKWGKKHIL

SEQ ID NO: 1015 - DNA, 96 bp, Haemophilus influenzae
  Name: NTH0561
atgatgacttcaaattcttattggcaacgcttaaaaagtggcatttcaatatgtcatgccacaaatttatttaactcaaattgctggctgggttgc

SEQ ID NO: 1016 - protein, 32 aa, Haemophilus influenzae
  Name: NTH0561
MMTSNSYWQRLKSGISICHATNLFNSNCWLGC

SEQ ID NO: 1017 - DNA, 522 bp, Haemophilus influenzae
  Name: NTH0562
atgcaaaaggtaaaactacccctaaccgttgatccagtaaaagatgctcaaagacggcttgattatgttggttattattcggcaaatcagcttgagcgtttggcggaatcagtggtaaacgtgctcagcgatgcacaggtaacattatcgttttatgttgatccacaaaaattagtggtgatgaaaggtaaagtacagattgatgtcgatcttgaatgtcagcgttgtaacgaaccttacaaacaaacattggaatgtgagtttacttatagtccagtggctaattgggatcaggctgatgacttgcccgaaatttatgagccaatcgagttcaatgagtttggcgaaatagatttaattggcacggtggaagatgagctaattttagctttgccgcttgtcccaatgcattcatctgaacactgtgaagtgtccgcgcaggaacaggtttttggcgaattgcctgaagaattggcaaaaaaaccgaacccgttcgctgtattagctaatttaaagcaaaag

SEQ ID NO: 1018 - protein, 174 aa, Haemophilus influenzae
  Name: NTH0562
MQKVKLPLTVDPVKDAQRRLDYVGYYSANQLERLAESVVNVLSDAQVTLSFYVDPQKLVVMKGKVQIDVDLECQRCNEPYKQTLECEFTYSPVANWDQADDLPEIYEPIEFNEFGEIDLIGTVEDELILALPLVPMHSSEHCEVSAQEQVFGELPEELAKKPNPFAVLANLKQK

SEQ ID NO: 1019 - DNA, 168 bp, Haemophilus influenzae
  Name: NTH0563
atggctgttcaacaaaacaaaaaatctcgttcacgtcgtgatatgcgtcgttcacacgatgctttaacaactgctgctgtatcagtagataaagcaagcggtgaaactcacttacgccaccacgtaactgcagacggttattatcgtggtcgtaaagtgatcaataag

SEQ ID NO: 1020 - protein, 56 aa, Haemophilus influenzae
  Name: NTH0563
MAVQQNKKSRSRRDMRRSHDALTTAAVSVDKASGETHLRHHVTADGYYRGRKVINK

SEQ ID NO: 1021 - DNA, 675 bp, Haemophilus influenzae
  Name: NTH0564
ttgagtatgaatagtagaattttatccaccggtagctatctgccgagccatattcgcacaaatgcggatttagaaaaaatggttgatacatcagatgaatggattgtcactcgttctggtatccgtgaacgtcgtatcgcagcggaagatgaaactgttgcaacaatgggatttgaagcggcaaaaaatgcgatcgaagctgctcaaattaatcctcaagatattgaactgattattgttgcaactacaagtcactcacatgcttatccaagtgcggcttgccaagtgcaaggtttattaaatattgatgatgcgatttcttttgatttggcggcagcttgcacaggctttgtctatgctttgagcgtagctgatcaatttattcgtgcaggcaaagtgaaaaaagccttagtgataggctcggatctcatttctcgtaaattagatgaaacagatcgcagcactgttgggctatttggtgatggtgcgggtgctgttattttacaaccgagtgaacataatgaattatctcactcattttacccctttaacagaaaaaaaatgtccttgtttagctcgccaaatctggtatacaaaatctgctttattaaatccaggtcacaatacgtaaattggccgttcctgactttcaatgggtggaaaaacccttttacc

SEQ ID NO: 1022 - protein, 225 aa, Haemophilus influenzae
  Name: NTH0564
LSMNSRILSTGSYLPSHIRTNADLEKMVDTSDEWIVTRSGIRERRIAAEDETVATMGFEAAKNAIEAAQINPQDIELIIVATTSHSHAYPSAACQVQGLLNIDDAISFDLAAACTGFVYALSVADQFIRAGKVKKALVIGSDLISRKLDETDRSTVGLFGDGAGAVILQPSEHNELSHSFYPFNRKKMSLFSSPNLVYKICFIKSRSQYVNWPFLTFNGWKNPFT

SEQ ID NO: 1023 - DNA, 1104 bp, Haemophilus influenzae
  Name: NTH0565
atgaccacatcaggattaatgatcctagaagctaatctgcattatccaacaggttcaagttttgacaccatcgttaaagatttattaggaaaaagttggaatattatcaacggcctttctgttgctttcgtcttatatgttttgacttatgcctacataacctcaggcggaggcattacacaaaatctgctcagccaagcattcagttctgctgaaagtgcggtagatattggaagaacttcaggatctttaattttctgccttattcttgcagcctttgtatggctttcaaccaaagcagtggatcgtttcacaaccgtgttaattgtcgggatggtggttgcttttttcctttctactactggtttattaagctctgtaaaaacagcagttttattcaataccgttgctgaaagtgagcaagcatatttaccttatttattgaccgcacttccagtttgtctcgtgtcgtttggtttccacggaaatgtccctagtctcgtcaaatattacgatcgtgatggtcgtcgcgtgatgaaatcgatctttattggtacgggcttagcattagtgatttacatcttatggcagctcgctgtacaaggtaatttaccacgcactgaatttgcaccagtcattgaaaaaggcggcgatgtttctgcattattagaggctttacataaatatattgaagtggaatacctttccatcgcattaaatttctttgcttatatggcaatttctacttcattcttaggcgtcactttagggttatttgattatattgcggatctatttaaatttgacgatagcttattaggcagaacaaaaacaacacttgttacttttttaccgccattattgctaagcctgcaatttccttatggatttgtgattgccattggttacgctggattggcggcaacaatttgggctgcaattgtccccgcacttcttgccaaagcaagccgtcaaaaattcccacaagcaagttataaagtatacggcggaaattttatgattggttttgtaatgctatttggcatattaaatattgtggcgcaaattggggcaaacttaggttggtttgcaagttttactggg

SEQ ID NO: 1024 - protein, 368 aa, Haemophilus influenzae
  Name: NTH0565
MTTSGLMILEANLHYPTGSSFDTIVKDLLGKSWNIINGLSVAFVLYVLTYAYITSGGGITQNLLSQAFSSAESAVDIGRTSGSLIFCLILAAFVWLSTKAVDRFTTVLIVGMVVAFFLSTTGLLSSVKTAVLFNTVAESEQAYLPYLLTALPVCLVSFGFHGNVPSLVKYYDRDGRRVMKSIFIGTGLALVIYILWQLAVQGNLPRTEFAPVIEKGGDVSALLEALHKYIEVEYLSIALNFFAYMAISTSFLGVTLGLFDYIADLFKFDDSLLGRTKTTLVTFLPPLLLSLQFPYGFVIAIGYAGLAATIWAAIVPALLAKASRQKFPQASYKVYGGNFMIGFVMLFGILNIVAQIGANLGWFASFTG

SEQ ID NO: 1025 - DNA, 1227 bp, Haemophilus influenzae
  Name: NTH0566
gtggatgtgtatggctctctttcgatgacagggagaggtcacagtacagatatcgccatcattatgggattagcgggttatttaccacataatgtggacatcgatatgatttcaggtttcatcgagaaagtgaaacaaactgcgcttttacccattaatgtcggtcaaaagatagtaaaatttgattttgaaaataatctcattttccaccgcacttttttaaaattgcacgaaaatggcatgacaattaccgctcttgatgaaaatcgcacagagctttatcgccaaacctattattcgattgggggtggttttattgtcgatgaagcccattttggcaaagaagaaaaaaacacagtccaagtgccttatccttacaaaaatgccgaagatattttgaaacattgtagtgataacggcttaatgctttccactgtgatgttggaaaatgaaatcgcattgaatggcaaagaggctgttagtgctcatctagagaatgtctggaaaacgatgcaggcttgtattgaacacggtattcacacagagggtattttacccggcccattaagagtaccacgtcgtgcagcttcactttatcgtgcgttgcaagcaaatacgaatttatctaacgatccaatgcgcgtaatcgactgggtcaatatgtttgcgcttgctgtcaatgaagaaaatgcagcgggcgggcgcgtggttacggcaccaactaacggtgcgtgcgggattattccagcggtattagcttactatgaaaaattcatctcgccattaacacctgaaatcattgaacgctatttattagccgcagggatgattggttcactttataagatgaacgcttctatttctggtgcagaagtgggttgtcaaggcgaagtgggtgtagcctgttcaatggctgctgcgggactagctgaaattttgggtggcaatccactacaagtatgcatcgcagctgaaattgcaatggagcataatttaggattaacttgcgaccctgtcggcggtcaagttcaagtaccttgtatcgaacgcaatgcaattgcttcagttaaagcgatcaatgcatcgcgtatggctttacgccgcaccaccaatccaagagtaagcttagataaagtgattgaaacaatgtacgaaacaggtaaagatatgaacgccaagtatcgcgaaacatctcaaggcggacttgcagttaaaattgtttgtaac

SEQ ID NO: 1026 - protein, 409 aa, Haemophilus influenzae
  Name: NTH0566
VDVYGSLSMTGRGHSTDIAIIMGLAGYLPHNVDIDMISGFIEKVKQTALLPINVGQKIVKFDFENNLIFHRTFLKLHENGMTITALDENRTELYRQTYYSIGGGFIVDEAHFGKEEKNTVQVPYPYKNAEDILKHCSDNGLMLSTVMLENEIALNGKEAVSAHLENVWKTMQACIEHGIHTEGILPGPLRVPRRAASLYRALQANTNLSNDPMRVIDWVNMFALAVNEENAAGGRVVTAPTNGACGIIPAVLAYYEKFISPLTPEIIERYLLAAGMIGSLYKMNASISGAEVGCQGEVGVACSMAAAGLAEILGGNPLQVCIAAEIAMEHNLGLTCDPVGGQVQVPCIERNAIASVKAINASRMALRRTTNPRVSLDKVIETMYETGKDMNAKYRETSQGGLAVKIVCN

SEQ ID NO: 1027 - DNA, 402 bp, Haemophilus influenzae
  Name: NTH0567
atggcaaaagatgaagtagggcataattttcttgcacgtttgggtaaaacgcgtttgcgtccaggcggtaaaaaagcgacagattggttaattgctaatggcgattttagccaagataaaaaagtgttagaggttgcctgtaatatggggacgactgcaattggattggcgaaacaatttggttgtcatattgaaggtgttgatttagatgaaaatgcgttagcaaaagcacaagcaaatattgaagcaaatggcttgcaagaaaaaattcatgtacagcgtgcgaatgcgatgaagttgcctttcgaggatgaaagttttgatattgtcatcaatgaagcgatgctcacaatgttacccgtggaagcgaagaaaaagccattgcagaatattttcgagtgt

SEQ ID NO: 1028 - protein, 134 aa, Haemophilus influenzae
  Name: NTH0567
MAKDEVGHNFLARLGKTRLRPGGKKATDWLIANGDFSQDKKVLEVACNMGTTAIGLAKQFGCHIEGVDLDENALAKAQANIEANGLQEKIHVQRANAMKLPFEDESFDIVINEAMLTMLPVEAKKKPLQNIFEC

SEQ ID NO: 1029 - DNA, 156 bp, Haemophilus influenzae
  n 63: n is any nucleotide
  Name: NTH0568
gtgttaaaacccaatggtttattgcttactcacgatgttatgctggtggggaatgatcatcanactattctagaaaatatgcgcaaagccgataatgtgactgtcacgccattaacgaaagatggatggaaaagcatattccaagaaagtggcttt

SEQ ID NO: 1030 - protein, 52 aa, Haemophilus influenzae
  Xaa 21: Xaa is any amino acid
  Name: NTH0568
VLKPNGLLLTHDVMLVGNDHXTILENMRKADNVTVTPLTKDGWKSIFQESGF

SEQ ID NO: 1031 - DNA, 342 bp, Haemophilus influenzae
  Name: NTH0570
atgtcaaaaacatcaatcggactagataaagttcaatcagcagaattagccgataaacttaacgaattacttgcaacctaccaagttttctatactaatgtgcggggctaccactggaacattaaaggcgtaaacttctttgcattacacgcaaaatttgaagaaatttatactaatttagttgctagagtagatgaggtggctgaacgtattttaactttaggttacacaccaaataatgcttacagccaatacttaaaaatatctcgaattaaagaagatattgcagtaagtgaggcacaagaatgtttatcaggcacattacaaggtctaaaacattac

SEQ ID NO: 1032 - protein, 114 aa, Haemophilus influenzae
  Name: NTH0570
MSKTSIGLDKVQSAELADKLNELLATYQVFYTNVRGYHWNIKGVNFFALHAKFEEIYTNLVARVDEVAERILTLGYTPNNAYSQYLKISRIKEDIAVSEAQECLSGTLQGLKHY

SEQ ID NO: 1033 - DNA, 876 bp, Haemophilus influenzae
  Name: NTH0571
atgcaagaacttattaagcgcaccttgccacaagatgatgcacttaatcaagctattgtgaatgaacttcgttcacaaaattgggctggttttttaaattattcccaagtgcagcagctttgtcataattttgaacttaccccactaaaattggctatgcacttgttgccacttgctgcaagttatagtcatactgctatttctcattttaatgtgggggcaattgctattggcgaacaaggggatttttatttcggcgcgaatcaagaatttgctaattcagccattcagcaaacgattcacgcggaacaaagtgcaatttctcacgcttggttgcgtaatgaacgccgtatttcagatatggtggtcaattacacgccgtgcggacattgtcgtcaatttatgaatgaattgcacggtgctgaaaaaatttcaattcatttgccgcatagccaaaataatccattacattcttatttaccggatgcgtttgggccaaaagatctcgatattgcagcgcatcttttggcggaagaaaatcatgatttagttgctgatcatcaagatgatttggttaatcaagctattttagcggcaaatcaatctcattgtccttattcaaatagtccgcacggcattgcgattttatttaaaaatggtgatgtggtgacaggacgttatgcagaaaacgccgcatttaatccgagtttgccagcgttgcaaaccgcacttaattttgcgtatttaaatgataaaaaattgagtgatattgagcgaattgtgatggctgaaaaagcattaaaattgagccataaaacgatggctgaaaccttattatccacattaacttcagtagaattagagtattattctttg

SEQ ID NO: 1034 - protein, 292 aa, Haemophilus influenzae
  Name: NTH0571
MQELIKRTLPQDDALNQAIVNELRSQNWAGFLNYSQVQQLCHNFELTPLKLAMHLLPLAASYSHTAISHFNVGAIAIGEQGDFYFGANQEFANSAIQQTIHAEQSAISHAWLRNERRISDMVVNYTPCGHCRQFMNELHGAEKISIHLPHSQNNPLHSYLPDAFGPKDLDIAAHLLAEENHDLVADHQDDLVNQAILAANQSHCPYSNSPHGIAILFKNGDVVTGRYAENAAFNPSLPALQTALNFAYLNDKKLSDIERIVMAEKALKLSHKTMAETLLSTLTSVELEYYSL

SEQ ID NO: 1035 - DNA, 102 bp, Haemophilus influenzae
  Name: NTH0572
gtggaaaatgaaagcctgattgattttttagattcaaatgatcacagtaaaaccattgaaggctatcaagcaccgaaaagagcggtaattttagcaaataaa

SEQ ID NO: 1036 - protein, 34 aa, Haemophilus influenzae
  Name: NTH0572
VENESLIDFLDSNDHSKTIEGYQAPKRAVILANK

SEQ ID NO: 1037 - DNA, 90 bp, Haemophilus influenzae
  Name: NTH0573
gtggtggatggcgatgtaaatactgggctcatcccagcagatcgctatgcgaaaatgaaaaatgttaatttatcccctctgtcgccgcac

SEQ ID NO: 1038 - protein, 30 aa, Haemophilus influenzae
  Name: NTH0573
VVDGDVNTGLIPADRYAKMKNVNLSPLSPH

SEQ ID NO: 1039 - DNA, 636 bp, Haemophilus influenzae
  n 631, 632, 633, 634, 635: n is any nucleotide
  Name: NTH0574
ttgatttatggggaaattatggcattagtaaacaaaattaaaacattatcatcagtaggtattctagctgctacattatttcttgcaggctgccaagcacaatcaaatatattagcatttacaccgcctgtgccaagtgcttcaatgaatgttaatcgaactgccgttgtatctgttacaacaaaagatagccgcacaatacaagagattgcgagttatacgaaacacggggaactgattaaattaaatgcatccccaagtgttacacaattatttcagcaagtgatgcagcaaaatttaattagtaaaggctttagaattgggcaattaaatggttcaaatgcgtgggtaactgtagatgtgcatgaatttggtacgcaagtagaacaaggtaatcttcgttataaacttaatactaaaattcaagcgacagtttatgtacaaggtgcgaaaggttcgtataataaatcatttaatgtcacgcgttcacaagagggcgtatttaatgcggacaatgatgaaattcataaagtgctatctcaaacttttaatgatattgtgaacaatatttatcaagatcaagaagttgcggctgcgattaaccaatttctaattatcacatggggtctcnnnnnt

SEQ ID NO: 1040 - protein, 212 aa, Haemophilus influenzae
  Xaa 211, 212: Xaa is any amino acid
  Name: NTH0574
LIYGEIMALVNKIKTLSSVGILAATLFLAGCQAQSNILAFTPPVPSASMNVNRTAVVSVTTKDSRTIQEIASYTKHGELIKLNASPSVTQLFQQVMQQNLISKGFRIGQLNGSNAWVTVDVHEFGTQVEQGNLRYKLNTKIQATVYVQGAKGSYNKSFNVTRSQEGVFNADNDEIHKVLSQTFNDIVNNIYQDQEVAAAINQFLIITWGLXX

SEQ ID NO: 1041 - DNA, 195 bp, Haemophilus influenzae
  Name: NTH0575
gtgtcaattcaacaaattattgagcaaaaaattcaaaaaaaatttcaaccgcactttttagcaatagaaaatgaaagccatttacatcactctaatcgaggttctgaatcacattttaaatgcgttattgtcagcgcagactttaaaaatattcgaaaagtacaacgtcatcagcgtatttatcaattattgaac

SEQ ID NO: 1042 - protein, 65 aa, Haemophilus influenzae
  Name: NTH0575
VSIQQIIEQKIQKKFQPHFLAIENESHLHHSNRGSESHFKCVIVSADFKNIRKVQRHQRIYQLLN

SEQ ID NO: 1043 - DNA, 474 bp, Haemophilus influenzae
  n 439, 443, 453, 465, 470: n is any nucleotide
  Name: NTH0576
ttgaaaagtagtgcaaatagtatgattacaattaagaaaggtttggatctcccaatcgcgggaaaaccagcacaagtaatccatagcggcaacgctgtgaatcaagttgcgattctaggtgaggagtatgtggggatgcgtccttcaatgaaggtacgcgaaggcgatgttgtgaaaaaaggtcaagtactttttgaagacaaaaaaaatcctggtgtaatttttacagcccctgcaagcggtaccatcactgcaatcaatcgtggcgaaaaacgggtattacaatctgttgttattaatgtagaaggtgatgaaaaaatcacttttgcaaaatatagcacagaacaattgaatacactttcttctgaacaagtaaaacaaaacttgatagaatctggcttatggacggcattacgtactcgtccatttagtaaagttnccanccattgggtnaccgaggcccgnaattncgga

SEQ ID NO: 1044 - protein, 158 aa, Haemophilus influenzae
  Xaa 147, 148, 157: Xaa is any amino acid
  Name: NTH0576
LKSSANSMITIKKGLDLPIAGKPAQVIHSGNAVNQVAILGEEYVGMRPSMKVREGDVVKKGQVLFEDKKNPGVIFTAPASGTITAINRGEKRVLQSVVINVEGDEKITFAKYSTEQLNTLSSEQVKQNLIESGLWTALRTRPFSKVXXHWVTEARNXG

SEQ ID NO: 1045 - DNA, 240 bp, Haemophilus influenzae
  n 231, 232, 233, 234, 235: n is any nucleotide
  Name: NTH0577
atggttactgctgcagcgagaatggatattcaggaaaatgaattagaagattttattcgcttaaatacccaaatggcaacagcatttgatgcagaaaaccccgatgaattagtagagttatttggtaaagtacagaaaaactttaaattaaccaccaaagatgccaaagagctagccgatactattaactatttagatgataatgcctttcaaaggggacagggggtctcnnnnnttaat

SEQ ID NO: 1046 - protein, 80 aa, Haemophilus influenzae
  Xaa 78, 79: Xaa is any amino acid
  Name: NTH0577
MVTAAARMDIQENELEDFIRLNTQMATAFDAENPDELVELFGKVQKNFKLTTKDAKELADTINYLDDNAFQRGQGVSXXN

SEQ ID NO: 1047 - DNA, 303 bp, Haemophilus influenzae
  Name: NTH0579
gtgcgaacggatcaaattaaaaatcaagaagccgcattgaaaaaactcaacgcaaaacaagccgcttataatcaataccgtgggcaagttgagaaacttaaagatatcagtggtaaagcacaaatcattggtgcacaggcaacagctgcaggtacaacaatgactgcaccaattgtcaattccattcgagattttatgtcgtttgaagatgttatggcgggggttgctcgccaagttccagggctaaaagacaaatttgggcaatttacccctaaatacgatgaatggaaaaacaagattaaa

SEQ ID NO: 1048 - protein, 101 aa, Haemophilus influenzae
  Name: NTH0579
VRTDQIKNQEAALKKLNAKQAAYNQYRGQVEKLKDISGKAQIIGAQATAAGTTMTAPIVNSIRDFMSFEDVMAGVARQVPGLKDKFGQFTPKYDEWKNKIK

SEQ ID NO: 1049 - DNA, 480 bp, Haemophilus influenzae
  Name: NTH0580
atgaaaaatttagagcttacagtcttattaaatgccattgataaaatatctgctccagttcgcagtgcatctaaaagcgttcatgagctatcggcaaaactaaaagaaagcaaatcgattcatcgacaactaaatcagcaaaataagcagcatcaagctgcaatgaaacaatatgcttctgctatcaacccattgaaatcaaaattagattcgctgaatcaagaattagagcaagcaaaacaaaaagccgcatcttatgctcaatatatgaagaacgctcaacatcctactgcaggatttcaaaaggaagtagagaaagcaaaaagtgcggtaaaaaaactcaagcaagaacaaattgatgcagcaaataaattacagcaagcacgccaagaattagcaaaatcaggcatttctgcagaaaaactcgcgcaaaagcaaagggaactacagaaaaacaccaaaagtgcgaacggatcaaat

SEQ ID NO: 1050 - protein, 160 aa, Haemophilus influenzae
  Name: NTH0580
MKNLELTVLLNAIDKISAPVRSASKSVHELSAKLKESKSIHRQLNQQNKQHQAAMKQYASAINPLKSKLDSLNQELEQAKQKAASYAQYMKNAQHPTAGFQKEVEKAKSAVKKLKQEQIDAANKLQQARQELAKSGISAEKLAQKQRELQKNTKSANGSN

SEQ ID NO: 1051 - DNA, 336 bp, Haemophilus influenzae
  Name: NTH0581
atgaacaaacttaacagggagagaacgatggaaatttttgttttgctcattggtttgccaattattgttggtttacttattgcatttggtactgcagtattagccgcatttagttatatttttgttggcgcattatctttagcgattaatttctggtatatcacgttagcagtaatgcttgttttgcttgcacctcttatttatttaaatagttggttattttggattttggctgcactcgttattttctttactgttgcttggttttttggtggcgataccgaacaaatcaaagcagaaattgaacgtaaacgtattgctaaagagcataaattg

SEQ ID NO: 1052 - protein, 112 aa, Haemophilus influenzae
  Name: NTH0581
MNKLNRERTMEIFVLLIGLPIIVGLLIAFGTAVLAAFSYIFVGALSLAINFWYITLAVMLVLLAPLIYLNSWLFWILAALVIFFTVAWFFGGDTEQIKAEIERKRIAKEHKL

SEQ ID NO: 1053 - DNA, 147 bp, Haemophilus influenzae
  Name: NTH0582
gtgcatcaatacggtttaacggcacgaccatctaacaataaagatttcaaagtgcaatatgcccagcgtgaattactgggctttgcggaagaagatattgaaatgattgaaagatttgtgcttagagctatagcgggtaaagaattt

SEQ ID NO: 1054 - protein, 49 aa, Haemophilus influenzae
  Name: NTH0582
VHQYGLTARPSNNKDFKVQYAQRELLGFAEEDIEMIERFVLRAIAGKEF

SEQ ID NO: 1055 - DNA, 108 bp, Haemophilus influenzae
  Name: NTH0583
gtgccgttaaaccgtattgatgcactgcgaactggagcagacattttatcaagggcatttaataagacggtaagttgtaaattattcattttttcgccttatttttat

SEQ ID NO: 1056 - protein, 36 aa, Haemophilus influenzae
  Name: NTH0583
VPLNRIDALRTGADILSRAFNKTVSCKLFIFSPYFY

SEQ ID NO: 1057 - DNA, 399 bp, Haemophilus influenzae
  n 386, 387, 388, 389, 390: n is any nucleotide
  Name: NTH0584
atgaaaaacaaaagaacatctcgcacgttgatcatgctaaacattgctatgtggagccttgttattatttccacctgtttacattatcaatttaatcctttttcatttatctggtttgatgttatcgcaccagttggtcatttttttgcagtcgttttttctgctttatctagttttactgtttcaatgtatgaactttttaaaccagaaacattttgggggtgggtatggtttgtaatgtttgtcgtgccaatcatttgtttgcctctttatgtggttttattggtattgtttgctggtaaactttcacatcatgatacggtggttccacttcttattaaagtaatagctttgctaatgggtaccgagtccgaattcgaaaacannnnnttaattaat

SEQ ID NO: 1058 - protein, 133 aa, Haemophilus influenzae
  Xaa 129, 130: Xaa is any amino acid
  Name: NTH0584
MKNKRTSRTLIMLNIAMWSLVIISTCLHYQFNPFSFIWFDVIAPVGHFFAVVFSALSSFTVSMYELFKPETFWGWVWFVMFVVPIICLPLYVVLLVLFAGKLSHHDTVVPLLIKVIALLMGTESEFENXXLIN

SEQ ID NO: 1059 - DNA, 822 bp, Haemophilus influenzae
  Name: NTH0585
gtggatgggcgaaataaaatcacccgaaatatcaaagaaatagagcaactttatcccttaatagagaaaatagaaaaatctggaaaaagtcttgaaatttcctatgcaaaatatatttctcttcaattaattaaaaaaataattcgcatcctcaataaaaaaagagcgagtaataaatgggatgaatatgatgtaaattcatttattttatctctaatcaaactaagaatgacaatcaaggaattatatttaattgaagttaagggtgaattaagaacagaagaagaactcaatgctattgctgcagatatatccaaagcaaaattgaatttagaagagcacatctcacttgaagagcaattagtagagaataaaaaggagttcgaaaatttaaaaaactcactgattacactcaaaaaatcttataacgacgcacaagaacaaataactgaaatttcccagtggcacgaacagtcagagaaattaagtggcgacatttcgaactatgaattcaccgcacaaaataatcttactaaaattacgacattagcaaccacagcggaaaccaataaaccccaaatcgaaaaatatcatgaagatattgaaggtatgattaaattattcaataaacaaaaagaggagattgaaatgattattgaagacgccaaccgagcaagcatggcaggttcgtttaaaactcaatctgaaaatatcgatagtaaaatgaaagctgtagataaaattttgctttgggtcacttgttgcaacatctgttatttcattggtcaattattcaacaagcctgagtgcagcagacagcct

SEQ ID NO: 1060 - protein, 274 aa, Haemophilus influenzae
  Name: NTH0585
VDGRNKITRNIKEIEQLYPLIEKIEKSGKSLEISYAKYISLQLIKKIIRILNKKRASNKWDEYDVNSFILSLIKLRMTIKELYLIEVKGELRTEEELNAIAADISKAKLNLEEHISLEEQLVENKKEFENLKNSLITLKKSYNDAQEQITEISQWHEQSEKLSGDISNYEFTAQNNLTKITTLATTAETNKPQIEKYHEDIEGMIKLFNKQKEEIEMIIEDANRASMAGSFKTQSENIDSKMKAVDKILLWVTCCNICYFIGQLFNKPECSRQP

SEQ ID NO: 1061 - DNA, 417 bp, Haemophilus influenzae
  Name: NTH0586
ttggtcaattattcaacaagcctgagtgcagcagacagccttaatattttacaatttcttgctaagtccattgtgacaatcccgttacttgtcatcgcctggttaaaagcaaaagaacgggcttatctctttagattaagggaggattataactacaaatattcctcagcaatggcatttgaaggttataagaaacaagtacaagaacaagaccctaaattacatcagcaacttctgcaaattgccgtggataatttggggataaatccaaccaaagtctttgacaaagatttaaaaagcacaccacttgaaacaattatcgatggagtaggaaaacgcctggataaagctgttgatggtattaaaggagaggtgaatgacattccaaagaaaacaaaagaattaattgatgatgaa

SEQ ID NO: 1062 - protein, 139 aa, Haemophilus influenzae
  Name: NTH0586
LVNYSTSLSAADSLNILQFLAKSIVTIPLLVIAWLKAKERAYLFRLREDYNYKYSSAMAFEGYKKQVQEQDPKLHQQLLQIAVDNLGINPTKVFDKDLKSTPLETIIDGVGKRLDKAVDGIKGEVNDIPKKTKELIDDE

SEQ ID NO: 1063 - DNA, 159 bp, Haemophilus influenzae
  Name: NTH0587
atgacacacttaaacttaattcctgtttttaatggcttaatccaaaatcaacccgctcaactttgcaacgctcgcgaacttcacgcattcccacaaagcaaacagcacttcactgatcggatcaaaaaccgccatcaacgaacatggcttcattcaaga

SEQ ID NO: 1064 - protein, 53 aa, Haemophilus influenzae
  Name: NTH0587
MTHLNLIPVFNGLIQNQPAQLCNARELHAFPQSKQHFTDRIKNRHQRTWLHSR

SEQ ID NO: 1065 - DNA, 243 bp, Haemophilus influenzae
  n 230, 231, 232, 233, 234: n is any nucleotide
  Name: NTH0588
atgcatcccctttctgtgttcccccccttatccccatatatcggcgcaaaacctagaatttccttccctcccctaacccccccatcccatttcattccccccactccccttccccccctcgcctccttatctcctttctcacccccccctttgcctcccgcttttttgtcccccccccctccccttcctcccctccccctttttcctttttctcccccccctccctcccnnnnnttaattaat

SEQ ID NO: 1066 - protein, 81 aa, Haemophilus influenzae
  Xaa 77, 78: Xaa is any amino acid
  Name: NTH0588
MHPLSVFPPLSPYIGAKPRISFPPLTPPSHFIPPTPLPPLASLSPFSPPPLPPAFLSPPPPLPPLPLFPFSPPPPSXXLIN

SEQ ID NO: 1067 - DNA, 501 bp, Haemophilus influenzae
  Name: NTH0589
atgccattacttgatagttttaaagtggatcacacaaaaatgaacgcacctgcagtacgcattgcaaaaacgatgtgcacgccaaaaggcgataatattactgtttttgatttacgtttttgtattccaaacaaagaaattctttccccaaaaggcattcatacacttgaacatttatttgctggatttatgcgcgatcatttaaatggcgatagcatagaaattattgatatttctccgatgggatgtcgcacgggattttatatgtctttgattggcacaccaaatgaacaggaagtgtctgaggcttggttagcttcaatgcaagatgttttaggtgtacaagatcaagcttctattcccgaattaaatatctatcaatgcggaagctatacggaacattccttagaagatgcacacgaaattgccaaaaatgttatcgcacgcggtataggtgtaaataaaaatgaagatttgtcactcgataattccttattaaaa

SEQ ID NO: 1068 - protein, 167 aa, Haemophilus influenzae
  Name: NTH0589
MPLLDSFKVDHTKMNAPAVRIAKTMCTPKGDNITVFDLRFCIPNKEILSPKGIHTLEHLFAGFMRDHLNGDSIEIIDISPMGCRTGFYMSLIGTPNEQEVSEAWLASMQDVLGVQDQASIPELNIYQCGSYTEHSLEDAHEIAKNVIARGIGVNKNEDLSLDNSLLK

SEQ ID NO: 1069 - DNA, 471 bp, Haemophilus influenzae
  Name: NTH0590
atggatattttttcattttttagtgctgatttttggcaggctaatagcttatgctttatgtttatcagcgcgtttttgagtgcaacagtattaccaggtaattcagaagttatatttgttgcgcttgctgtacctaaattaatgttaggttctttatttaacgcagatatattagctctaatattgattgcaaccgctggaaatagcttaggaagtttaaccacttacggaattggacgatggatgccaaaattcgatcccaaaaattaccgcactttatgggcaataaatcagctacggcgttatggggcgattgttttacttttgagctggctgcctgtagttggcgatttattttgtgccatagctggttggttaagattaaattttgtaacgagtagtctctttatctttctgggaaaaatggttcgttatgttgcgttattgtttttgagtacaccattcttatta

SEQ ID NO: 1070 - protein, 157 aa, Haemophilus influenzae
  Name: NTH0590
MDIFSFFSADFWQANSLCFMFISAFLSATVLPGNSEVIFVALAVPKLMLGSLFNADILALILIATAGNSLGSLTTYGIGRWMPKFDPKNYRTLWAINQLRRYGAIVLLLSWLPVVGDLFCAIAGWLRLNFVTSSLFIFLGKMVRYVALLFLSTPFLL

SEQ ID NO: 1071 - DNA, 600 bp, Haemophilus influenzae
  Name: NTH0591
atgttagattacgagatcttcaatccatatgaaggattgatttttgatatggatggaactttaattgatacaatgcccgtgcatgcgcaggcttggacaatggtgggaaagaaatttggctatgaatttgattttcaaattatgtataacttcggcggggcgacggttcgaactatcgcgggggaaatgatgaaagcggcgaatatgccactagatcgaattgaggatgtgctggctgcaaaacgtgagttgtcttatcaacttattccgacccaatcaaagttattgccaacctttgaaattgttaaatccttccatcagaaaaagccgattgctttaggttctggctcacaccgtaaaattattgatatgttgatggataaactggctatcgcaccttactttaatgccattgtcagtgcagatgatgtaaaagaacataaaccacatccagaaacttttttacgctgtgcggagttaattcaagcaaatccaagtcgttgtatcgtatttgaagatgcggatttaggcgtgcaagcaggattaagtgcgggaatggatgtgtttgatgttcgcacacgagaaattatttcgccaaga

SEQ ID NO: 1072 - protein, 200 aa, Haemophilus influenzae
  Name: NTH0591
MLDYEIFNPYEGLIFDMDGTLIDTMPVHAQAWTMVGKKFGYEFDFQIMYNFGGATVRTIAGEMMKAANMPLDRIEDVLAAKRELSYQLIPTQSKLLPTFEIVKSFHQKKPIALGSGSHRKIIDMLMDKLAIAPYFNAIVSADDVKEHKPHPETFLRCAELIQANPSRCIVFEDADLGVQAGLSAGMDVFDVRTREIISPR

SEQ ID NO: 1073 - DNA, 1386 bp, Haemophilus influenzae
  n 1381, 1382, 1383, 1384, 1385: n is any nucleotide
  Name: NTH0592
ttggctgatgaagatttaattgatcgtattgaagaatgtcgtgaacaattagatattgcagagcaagatgaatattttattcgtcaatatggcgtaacgttgtcacaattagagccgattgccaatagtttacaaagtgatccagaaaattacgacggcttaaaaaatgaattaactcaagcgattgagcgtcaaaaacaagttcaacaacgtgtatttgcgttagctgatgttgtacaacgtaaacatcattttggttatgaagatgcagggcaggctaaaacttctgaactcaacgaaaaacttcgccaacgtttagaacaaatgcaggctcagcgagatatgcaacgtgagcaagttcgtcaaaaacaaagtcaatttgctgaatataatcgcgtattgattcagttacaaagctcttacgatagtaaatatcagcttttaaatgaattgattagtgaaattagcgatcttggcgtgagagctgatgatggtgctgaagaacgcgcgcgtatccgtcgtgatgaattacatcaacaactttcaacgagccgtcagcgtcgttcttatgtagaaaaacaactcacattaattgaaagtgaagcggacaacttaaatcgtctaatccgcaaaactgaacgcgattataagactcaacgtgaattagtggtagcagcgaaagtgagttggtgtgtagttttacgtctatcacgtaattctgatatggaaaaacgcctcaatcgccgagagctcgcttatttatctgcagatgagttacgttcaatgtcggataaagcattaggtgcgttgcgtacagcggtggcagataatgaatatctacgtgatagcctaagagtgtcggaagatagtcgcaaacctgaaaataaagtgcggttctttattgcggtgtatcagcatttacgtgaacgtattcgtcaagacatcattaaaacggatgatccaattgatgccattgaacaaatggaaattgagctttctcgtttaacggctgaattaactggccgtgagaaaaaattggcgatcagttctgaaagtgttgcaaatattatgcgtaaaacgattcagcgtgaacaaaatcgtattcgtatgctcaatcaaggtttgcaaaacatctcgtttggtcaagtaaaatctgttcgtttggtagtgaatattcgtgatacccatgccatgttgttggacgcactttctggtcagcaagatgaatatcaagacttatttaacgacaactgcatcaccttttctgaagctatggcgaagctctatcaacgtatcaatccacatattgatatgggacaacgcacagcacaaacaatcggcgaagaattgttagattaccgtaattatcttgaacttgagnnnnnt

SEQ ID NO: 1074 - protein, 462 aa, Haemophilus influenzae
  Xaa 461, 462: Xaa is any amino acid
  Name: NTH0592
LADEDLIDRIEECREQLDIAEQDEYFIRQYGVTLSQLEPIANSLQSDPENYDGLKNELTQAIERQKQVQQRVFALADVVQRKHHFGYEDAGQAKTSELNEKLRQRLEQMQAQRDMQREQVRQKQSQFAEYNRVLIQLQSSYDSKYQLLNELISEISDLGVRADDGAEERARIRRDELHQQLSTSRQRRSYVEKQLTLIESEADNLNRLIRKTERDYKTQRELVVAAKVSWCVVLRLSRNSDMEKRLNRRELAYLSADELRSMSDKALGALRTAVADNEYLRDSLRVSEDSRKPENKVRFFIAVYQHLRERIRQDIIKTDDPIDAIEQMEIELSRLTAELTGREKKLAISSESVANIMRKTIQREQNRIRMLNQGLQNISFGQVKSVRLVVNIRDTHAMLLDALSGQQDEYQDLFNDNCITFSEAMAKLYQRINPHIDMGQRTAQTIGEELLDYRNYLELEXX

SEQ ID NO: 1075 - DNA, 174 bp, Haemophilus influenzae
  Name: NTH0593
atgaaatttacagacaaaaccactcaagcagctacacaaagaaccatcactaaagatggttttttagttgtgcccgcaaccatttctaaagttggggtatttgattaccttgctacagaactaggcttaaaagaagacggcattaaaaaggtcgctcgcacagagaaatcattg

SEQ ID NO: 1076 - protein, 58 aa, Haemophilus influenzae
  Name: NTH0593
MKFTDKTTQAATQRTITKDGFLVVPATISKVGVFDYLATELGLKEDGIKKVARTEKSL

SEQ ID NO: 1077 - DNA, 1179 bp, Haemophilus influenzae
  Name: NTH0594
atgaccgatgatgtagaaagagctatgcaacaaccgcaaggctctttttttatggatgatgcgaaagggttccaggcgattagtgcgaaagcgctgatgaaagtattagaaaagtacgaaaaatctgaccgcacttctcaagctgaaaatatcgccaatggcttcgttggtcgtggtgatgcacaaaaccatgctgaagtatcaaccaatttgaaaaaccaaactggcatcgatttatccgcttatttacgcaatagtccaaatattgctgaaagagtgaatgcattgaccgctggtaatatccagttaatcaagtctattcgctcgcaatatcttgataaagtgcaaaataccgtcatgcaagcaatggttcggggttctttaaataaagaccttgcagcacaagtaaaagacttaggtaaaacaaccgaaaaacgagcgatgtttattgctcgagaccagtcctcaaaattaaatgccgccttaacgcaagcgagacatgaagaggttggtataaaaaaatacatgtggtcaacatcgggtgatgagcgtgtgcgagaaagccatgcggaaaaagatgggcagatattcgaatatgccaatccgcctgccgatactggtcaccctggtcatgatgttaattgtcgatgcgttcagattccagtgcttgatgatgtagttaacttaaaatcagaagaaaccgaattaagctaccaggccgcagaacctaataagacagggaaaatggatctcgatgagttatttgaaagctctatcggtggaggtggtaataagtcattttctaactttggtggggttaattctgaattaattacgttagcgaaagagagtattggtttggatattacagattggcaacacagtattgatgaatcaagcatccgacacatattgaaacaacatggaaacgaaaaagcggaaaataaacgagggcaaagagccgttacaaaaaaagacattttattattgcctttggttgtctccgcatttgatagcattgagtacactgggacaagcgattcagggaatgaaacgtttttgattaaaaaagagattgatgacgaaatattcagcgtgcaggaagttaggaagagacacaagaagattgcagttaaaacaatgtggattaaaaggaaaaagaaagccacaagctccgca

SEQ ID NO: 1078 - protein, 393 aa, Haemophilus influenzae
  Name: NTH0594
MTDDVERAMQQPQGSFFMDDAKGFQAISAKALMKVLEKYEKSDRTSQAENIANGFVGRGDAQNHAEVSTNLKNQTGIDLSAYLRNSPNIAERVNALTAGNIQLIKSIRSQYLDKVQNTVMQAMVRGSLNKDLAAQVKDLGKTTEKRAMFIARDQSSKLNAALTQARHEEVGIKKYMWSTSGDERVRESHAEKDGQIFEYANPPADTGHPGHDVNCRCVQIPVLDDVVNLKSEETELSYQAAEPNKTGKMDLDELFESSIGGGGNKSFSNFGGVNSELITLAKESIGLDITDWQHSIDESSIRHILKQHGNEKAENKRGQRAVTKKDILLLPLVVSAFDSIEYTGTSDSGNETFLIKKEIDDEIFSVQEVRKRHKKIAVKTMWIKRKKKATSSA

SEQ ID NO: 1079 - DNA, 93 bp, Haemophilus influenzae
  Name: NTH0595
atgtttgagctacttggtgtaaaaaaagttcgcttaatgaccaacaacccagaaaaagtagaaaccattgaaaaaagcaggtatcaacgtggt

SEQ ID NO: 1080 - protein, 31 aa, Haemophilus influenzae
  Name: NTH0595
MFELLGVKKVRLMTNNPEKVETIEKSRYQRG

SEQ ID NO: 1081 - DNA, 171 bp, Haemophilus influenzae
  Name: NTH0596
ttgaaaaaagcaggtatcaacgtggttgaacgagtaccgcttaatgtaggcgaaaaccgctacaacacaaaatatcttgatacaaaagcgaaaaaaatggggcattacattgtgcataacaatgacgaacaacatttaatgacctgtccacattgccaggaagagattatt

SEQ ID NO: 1082 - protein, 57 aa, Haemophilus influenzae
  Name: NTH0596
LKKAGINVVERVPLNVGENRYNTKYLDTKAKKMGHYIVHNNDEQHLMTCPHCQEEII

SEQ ID NO: 1083 - DNA, 1035 bp, Haemophilus influenzae
  Name: NTH0597
ttgtttgctgaaaatgaccgcactttacgcatcgaattagataaagcatcgccatatttaccttctatgctggcacatgtcagtcttttgcctcactatgctaaatcgactgaaatatttatcagtaatggcgcatatcagttacaaagtcaggctgaaaatcagcatattttaactaccaatccttattattgggcgaaagaaaaagtgatatttcagcaagtgaagtatcaaaaaattgcagcagatgcagatttgtctgattttgatgttgtaatgaatccgaaaaaagtcgatcagaatatccaagattatccgcaactttgtacttacttctatgagtttaatctttccgatcctgtgttacaaaaaagtgcggtaagaaaagcgattgtttcgatgatttctaccaataatttggttgcagatattgctcatctttatcctaacaatacttttttgccaaaatctatgctaggtgagcaagaatctgtttgggagccagttgttgcagaacagctcttttcccaaaatcaaattagtgaaactcgtccattgaaattacgtattcgttatgatgattcatctctgaatcaaaccattgcaatgcgattaaatcatcaattatcacaatctgatttattacgagttgaaaatcaagggatgagctggcaagaattgcaaacggcccgcacaaaaggcgattttcaattaattcgttctggctggtgtgctgattttaatgatcctgcagcatttctaaatttattctattcaaaaagcccagataacaaaaatggctataaaaatgcggaatttgatcgtttatttgaaagtgcaatgacgacgacatccggaaaagtgcggttagaaaattacgcaaaattaaaagggatagttcaacaagagcatttagtgttacccatttttcaatatagtacgcctgtttatcttgcaccgagtataatgggtgctcaagtaaattctgtcggtgtcatttacagtaaagatttgtggagaaaggttcaaagtcaa

SEQ ID NO: 1084 - protein, 345 aa, Haemophilus influenzae
  Name: NTH0597
LFAENDRTLRIELDKASPYLPSMLAHVSLLPHYAKSTEIFISNGAYQLQSQAENQHILTTNPYYWAKEKVIFQQVKYQKIAADADLSDFDVVMNPKKVDQNIQDYPQLCTYFYEFNLSDPVLQKSAVRKAIVSMISTNNLVADIAHLYPNNTFLPKSMLGEQESVWEPVVAEQLFSQNQISETRPLKLRIRYDDSSLNQTIAMRLNHQLSQSDLLRVENQGMSWQELQTARTKGDFQLIRSGWCADFNDPAAFLNLFYSKSPDNKNGYKNAEFDRLFESAMTTTSGKVRLENYAKLKGIVQQEHLVLPIFQYSTPVYLAPSIMGAQVNSVGVIYSKDLWRKVQSQ

SEQ ID NO: 1085 - DNA, 96 bp, Haemophilus influenzae
  Name: NTH0599
ttgcgtaaaacggataaaggtcacaatgacaagcctaacgctgcctcaaattttgtccaatcttggcgaacactttctcgttcggaaagcccacat

SEQ ID NO: 1086 - protein, 32 aa, Haemophilus influenzae
  Name: NTH0599
LRKTDKGHNDKPNAASNFVQSWRTLSRSESPH

SEQ ID NO: 1087 - DNA, 720 bp, Haemophilus influenzae
  n 711, 712, 713, 714, 715: n is any nucleotide
  Name: NTH0601
atggaattgacttatatggctaaattgcctaaagaagaatttgaggaacgtcgcacacgagtattcgctcaaatgcaacctaattcagcattattgcttttttctgaaatcgaaaaacgccgtaataatgattgtacctatcctttccgtcaagatagctatttttggtatttaacaggctttaatgaaccgaatgcagcactgttattactgaaaacagaacaagtagaaaaagccattatttttcttcgtccatgcgatccgttacttgaaacgtggaatggtcgccgattaggtgttgagcgtgcaccacagcaacttaatgtaaatgaagcctattctattgaagaattcgctaccgtactgccaaaaatactgaaaaatttgaccgcactttaccatgtgccagaaattcatacttggggtgatacattggtgtcagaaagtgcggtgaattttagcgagattttagattggcgaccaatgctcagcgaaatgcgccttataaaatcgccgaatgaaatccgcttaatacaacaagcgggacaaattacggcacttgggcatattaaagcgatgcaaacaacacgcccaaatcgctttgaatatgaaattgaaagcgatattttgcatgaatttaatcgccattgcgcaagatttccttcttacaattccattgttgcaggaggaagtaacgcctgtttttgcacnnnnnttaat

SEQ ID NO: 1088 - protein, 240 aa, Haemophilus influenzae
  Xaa 238, 239: Xaa is any amino acid
  Name: NTH0601
MELTYMAKLPKEEFEERRTRVFAQMQPNSALLLFSEIEKRRNNDCTYPFRQDSYFWYLTGFNEPNAALLLLKTEQVEKAIIFLRPCDPLLETWNGRRLGVERAPQQLNVNEAYSIEEFATVLPKILKNLTALYHVPEIHTWGDTLVSESAVNFSEILDWRPMLSEMRLIKSPNEIRLIQQAGQITALGHIKAMQTTRPNRFEYEIESDILHEFNRHCARFPSYNSIVAGGSNACFCTXXN

SEQ ID NO: 1089 - DNA, 546 bp, Haemophilus influenzae
  Name: NTH0602
atgctcatttctcattgtgaccttaaccaacaacttaaatctgctggaatcggctttaatgcaacagaactacacggctttttaagcggtttactttgtggtggattaaaagatcaaagttggctgccgctcttatatcaattcagcaatgataatcacgcttacccaacagcattagttcaacccgttacagaactttatgaaaaaattagtcaaaccttatcagatgttgaaggatttacctttggacttggtttaaccgaagatgaaaatgtctttgcacaagcggatagcctatctgactgggcaaaccaattcttacttggtcttggcttagcacaacctgaattagcaaaagaaaaaggtgaaattggcgaagcggtagatgatttacaagatatttgccaacttggttataatgaagatgataatgaagaagagcttgcggaagcactagaagaaatcattgaatatgttcgcaccattgcaatgttattctattctcatttcaacgaaggagaaattgagagcaaacctgtattacat

SEQ ID NO: 1090 - protein, 182 aa, Haemophilus influenzae
  Name: NTH0602
MLISHCDLNQQLKSAGIGFNATELHGFLSGLLCGGLKDQSWLPLLYQFSNDNHAYPTALVQPVTELYEKISQTLSDVEGFTFGLGLTEDENVFAQADSLSDWANQFLLGLGLAQPELAKEKGEIGEAVDDLQDICQLGYNEDDNEEELAEALEEIIEYVRTIAMLFYSHFNEGEIESKPVLH

SEQ ID NO: 1091 - DNA, 120 bp, Haemophilus influenzae
  Name: NTH0603
atgtcattaccagatcttaaattaggttcatttctagcgttaaaagcagtgacgcccccccagcctcttaatctatttaattggtcaagcgatggctttattatgtccaaaggtttacgc

SEQ ID NO: 1092 - protein, 40 aa, Haemophilus influenzae
  Name: NTH0603
MSLPDLKLGSFLALKAVTPPQPLNLFNWSSDGFIMSKGLR

SEQ ID NO: 1093 - DNA, 111 bp, Haemophilus influenzae
  Name: NTH0604
atggcaaattacggcggaattcaaaaagcaagcgagcaatattatcaatggacagaggttaaatttaataaaccatttttttatataaaatgtcattaccagatcttaaat

SEQ ID NO: 1094 - protein, 37 aa, Haemophilus influenzae
  Name: NTH0604
MANYGGIQKASEQYYQWTEVKFNKPFFYIKCHYQILN

SEQ ID NO: 1095 - DNA, 585 bp, Haemophilus influenzae
  Name: NTH0605
gtgtgtttttcattacagtcagagcatggtgatcaaggttttcctggtaatgtggatgtgtctgtaacctatacgctaacagatgataatagcgtaaaaattgaatatgcagggatttgtgataaggatactgcattgaacctaacgaatcatgcttatttcaatttagaaaatgcagcgcaaggcagtgacgtgcgtgaacatacattacgtttaaatgctgatttttatctgcctgtagataatgaggggattcctaattctccattaaagcacgtggtgaatacaagttttgacttccgtattgctaaacccatcaagcaagattttttacaaggggatcagcaagcaacaaaaggttacgatcattcctttattgtcaataaagcttggcaaaagccttgtgtgttactaacctctccaactggcgatttaagtttggaagtaagaacctcgcaagctgcattgcaggtttatacgggtaattatcttgcaggtacaccaacgagaaatggcgaattatatgccgatttttctggcatagcactagaaacccaatggttaccagatacgcctaaatcatcc

SEQ ID NO: 1096 - protein, 195 aa, Haemophilus influenzae
  Name: NTH0605
VCFSLQSEHGDQGFPGNVDVSVTYTLTDDNSVKIEYAGICDKDTALNLTNHAYFNLENAAQGSDVREHTLRLNADFYLPVDNEGIPNSPLKHVVNTSFDFRIAKPIKQDFLQGDQQATKGYDHSFIVNKAWQKPCVLLTSPTGDLSLEVRTSQAALQVYTGNYLAGTPTRNGELYADFSGIALETQWLPDTPKSS

SEQ ID NO: 1097 - DNA, 138 bp, Haemophilus influenzae
  n 133, 134, 135, 136, 137: n is any nucleotide
  Name: NTH0606
atgaacgatattcaagtagcaaaagaatctttagataaaattataaagaaagcaagagtacatttatacaagcctatacagattgctgaaattttttatcaagcaagagtaaggggtaccgagccgatatacnnnnnt

SEQ ID NO: 1098 - protein, 46 aa, Haemophilus influenzae
  Xaa 45, 46: Xaa is any amino acid
  Name: NTH0606
MNDIQVAKESLDKIIKKARVHLYKPIQIAEIFYQARVRGTEPIYXX

SEQ ID NO: 1099 - DNA, 954 bp, Haemophilus influenzae
  Name: NTH0607
atgaaagaatataaaacaatagatttgtttgctggaattggtggcattcgtctaggttttgaagcatttggatgtaaaaacgtattttcatcagaatgggataagtatgctcaaagtatgtatgaagtaaattttggcgaaaaaccttttggagatattaatgatatatctcctagcgatataccagatcatgatattttacttgctggatttccttgccaaccatttagtattgctggtaaaggattgggctttgctgatactagaggaacattattttttaatatagaagcaattttgaaagctaaaaaaccaaaagcttttttgctggaaaatgtaaaaagattaacaacacatgataatggtaatacatttaaagttattaacgataaattaaataagttaggatatacggtatatcataaagtattaaatacccttgattttggattaccacaaaaaagagagcgaatttacattgtgggttttttagataaattgcattttgaatttccaaagcctataggaaagtatgaagaactttctaatatattagagagtgatgatgttgttcctaataattattttctttcagatgaactaaaacggaaaagattaagttcaattactaaagatgtgccttatccttcaatttggcatgaaaatatttcaggaaatgtttctgctcttccatactcttgtgcattaagagctgggggaagttataattatctagttgtaaatggggtacgtcgattaactgggcgagaaatgctaagattacaaggatttccagatacttttgaaattaatataccttattctcaggtacgtaaagttgctggcaattcagttagtattcctgtaattagggctattgctggttcaatgattaatagtttaaatatggcaacgcctaaaataaatcaagcaattcaactttcattattggac

SEQ ID NO: 1100 - protein, 318 aa, Haemophilus influenzae
  Name: NTH0607
MKEYKTIDLFAGIGGIRLGFEAFGCKNVFSSEWDKYAQSMYEVNFGEKPFGDINDISPSDIPDHDILLAGFPCQPFSIAGKGLGFADTRGTLFFNIEAILKAKKPKAFLLENVKRLTTHDNGNTFKVINDKLNKLGYTVYHKVLNTLDFGLPQKRERIYIVGFLDKLHFEFPKPIGKYEELSNILESDDVVPNNYFLSDELKRKRLSSITKDVPYPSIWHENISGNVSALPYSCALRAGGSYNYLVVNGVRRLTGREMLRLQGFPDTFEINIPYSQVRKVAGNSVSIPVIRAIAGSMINSLNMATPKINQAIQLSLLD

SEQ ID NO: 1101 - DNA, 312 bp, Haemophilus influenzae
  n 23: n is any nucleotide
  Name: NTH0608
ttgctgcctgcggtcgactctangagacccccatacgaatccctttctgatttacacgatcaaattgtagagcatatgcaaggcttactgattgcttatcgtgaaaataaccgtccgattgatttgagtttagtgttaaaagaacaactggaaaattatccactttctcgtcattttgatgtggctcgaatcattgttgatcaagcagtacgccttggtatggcgaatgatgatttatcgggtatttatccagattggcaagcaattaataaacgtggtgctgaagtgcaagcgcatgtgattgataagtat

SEQ ID NO: 1102 - protein, 104 aa, Haemophilus influenzae
  Xaa 8: Xaa is any amino acid
  Name: NTH0608
LLPAVDSXRPPYESLSDLHDQIVEHMQGLLIAYRENNRPIDLSLVLKEQLENYPLSRHFDVARIIVDQAVRLGMANDDLSGIYPDWQAINKRGAEVQAHVIDKY

SEQ ID NO: 1103 - DNA, 432 bp, Haemophilus influenzae
  n 423, 424, 425, 426, 427: n is any nucleotide
  Name: NTH0609
atgaaccgcatttttccagagcaactaaatcatcatcttgcgcaaagcttggctagagtttatctcttgcaagggcaagatcctttattacttagtgaaactgaggatacactttgtcaagtggcaaaccagcaaggttttgatgaaaaaaatactattcaggttgatagccaaactgattgggcgcaacttatagaatcttgtcaatctatagggttgttttttagtaaacaaatactaagcttgaatttacctgaaaatttcaccgcacttttgcagaaaaatctgcaagaacttatatccgtattgcataaagatgtcttgcttattttacaggtagcaaaattggctaaagggattgaaaagcaaacgtggtttattacacttaatcaatatgaaccaaatacaatactgataaatgtnnnnnttaat

SEQ ID NO: 1104 - protein, 144 aa, Haemophilus influenzae
  Xaa 142, 143: Xaa is any amino acid
  Name: NTH0609
MNRIFPEQLNHHLAQSLARVYLLQGQDPLLLSETEDTLCQVANQQGFDEKNTIQVDSQTDWAQLIESCQSIGLFFSKQILSLNLPENFTALLQKNLQELISVLHKDVLLILQVAKLAKGIEKQTWFITLNQYEPNTILINVXXN

SEQ ID NO: 1105 - DNA, 207 bp, Haemophilus influenzae
  Name: NTH0611
atgttggaagtagaagccactttccgccttgctaatggcgaaagctatccaatcaatgcgaaagtaaaccgtactttctttgataatgcacgtgcagcattagccaaatcagaagaacgagaggtaatttggaatgatatgcgcgagcaagtagcgcgtcaattaatcgtaaaaataattgcgttacaaaatcaaataaaaaggaaa

SEQ ID NO: 1106 - protein, 69 aa, Haemophilus influenzae
  Name: NTH0611
MLEVEATFRLANGESYPINAKVNRTFFDNARAALAKSEEREVIWNDMREQVARQLIVKIIALQNQIKRK

SEQ ID NO: 1107 - DNA, 678 bp, Haemophilus influenzae
  Name: NTH0612
atgattttatttgctggtgatccgcacggaagctatgatcacatttacccttttataaaagaacaggaaaatgtcgcactgataattttaggcgatttacagctcacgacagcagatgagttggataaacttgcgcaacattgtgatatttggtttattcatggaaatcatgatagcaaaaccattagtgcttttaatgcaatttggggttctaagtggcaatcacgcaatttacacaatcgcatagttgatattcaaggaactcgcattgcgggattaggcggtgtattccgtgggcaaatttggatgccaccaaatcgccccatgttttttgatcctattcattattgccaatatagcccacaggagaagatttggcgaggcggtgtgcctttgcgtcatcgcacgtcaatttttccatcagatattgaaatcttagaaaaccaacaagcagatgtgttgatttgtcacgaagcccctaaaccacatccgatgggtttccaagtaattaatgatttggcaatgaagatgggggttaagctagtattccacggacatcatcacgaaaactttacttatcgaacaaagtatccctacaaaatcacgaatgtaggtttccgcagtcttgctgatgcagagggaaattatttgctgcaaaccatcgatgatcgtgaaaaa

SEQ ID NO: 1108 - protein, 226 aa, Haemophilus influenzae
  Name: NTH0612
MILFAGDPHGSYDHIYPFIKEQENVALIILGDLQLTTADELDKLAQHCDIWFIHGNHDSKTISAFNAIWGSKWQSRNLHNRIVDIQGTRIAGLGGVFRGQIWMPPNRPMFFDPIHYCQYSPQEKIWRGGVPLRHRTSIFPSDIEILENQQADVLICHEAPKPHPMGFQVINDLAMKMGVKLVFHGHHHENFTYRTKYPYKITNVGFRSLADAEGNYLLQTIDDREK

SEQ ID NO: 1109 - DNA, 225 bp, Haemophilus influenzae
  Name: NTH0613
gtggatgatggcttgcgcagcttaggctcacaaaaacaacgccaacaatttcagcaactactcaaaaaactgttagataaatataaagttccttatatagagattgaatctccaagttatcttgatcgctataaccaagttaaagcagtcattgagaaagtgttaaatgaagaggaaatcagtgaattacaaaacacaacctttcctataaaagggacatctcaa

SEQ ID NO: 1110 - protein, 75 aa, Haemophilus influenzae
  Name: NTH0613
VDDGLRSLGSQKQRQQFQQLLKKLLDKYKVPYIEIESPSYLDRYNQVKAVIEKVLNEEEISELQNTTFPIKGTSQ

SEQ ID NO: 1111 - DNA, 930 bp, Haemophilus influenzae
  Name: NTH0614
atgcgagctaagtataacgcaaaatacctaggcactaaatcagaacgtgaaaaatatttccatttagcctacaataaacacactcaattcttacgctatcaagagcagattatgtcaaaaacaaaagagaaaaaagtcggtgtcattttcgggaaattttatcctgtacacacaggtcatataaatatgatttatgaagcgttcagtaaagtcgatgaactacacgttatcgtgtgtagtgacacggtgcgcgatttgaaattattttacgatagtaaaatgaaacgcatgccaaccgtgcaagatcgtttgcgttggatgcagcaaattttcaaatatcaaaaaaatcagatttttattcatcatttgattgaagacggtattccaagttatccaaacggctggcaatcttggagtgaagcagttaaaaccctatttcatgaaaaacattttgaaccttcaatcgtatttagtagcgagcctcaagataaagcgccttacgagaaatacttaggtttagaagtatcgttagtcgatcctgaccgcactttctttaatgtgtccgcaaccaaaattcgcaccactccattccaatattggaagtttattccgaaagaagctcgtcctttctttgccaaaacggtggcgattttagggggagaaagcagtggtaaaagcgtgctagttaataagttagccgccgtatttaataccacttctgcgtgggaatacgggcgtgaatttgtatttgaaaagctcggtggcgacgagcaagcgatgcaatattctgactatccgcaaatggcgcttggtcatcaacgatacattgattatgccgtgcgccattctcataaaattgcatttattgatacggatttcattaccacgcaagcgttctgcattcaatatgaaggaaaagctcatcctttt

SEQ ID NO: 1112 - protein, 310 aa, Haemophilus influenzae
  Name: NTH0614
MRAKYNAKYLGTKSEREKYFHLAYNKHTQFLRYQEQIMSKTKEKKVGVIFGKFYPVHTGHINMIYEAFSKVDELHVIVCSDTVRDLKLFYDSKMKRMPTVQDRLRWMQQIFKYQKNQIFIHHLIEDGIPSYPNGWQSWSEAVKTLFHEKHFEPSIVFSSEPQDKAPYEKYLGLEVSLVDPDRTFFNVSATKIRTTPFQYWKFIPKEARPFFAKTVAILGGESSGKSVLVNKLAAVFNTTSAWEYGREFVFEKLGGDEQAMQYSDYPQMALGHQRYIDYAVRHSHKIAFIDTDFITTQAFCIQYEGKAHPF

SEQ ID NO: 1113 - DNA, 96 bp, Haemophilus influenzae
  Name: NTH0615
gtgaaattccctaccgggggtaaagcccacgagcgtttaaaagtgcggtcaatttttgccaaatttttcctgcgaaattgtcctgattttcacttt

SEQ ID NO: 1114 - protein, 32 aa, Haemophilus influenzae
  Name: NTH0615
VKFPTGGKAHERLKVRSIFAKFFLRNCPDFHF

SEQ ID NO: 1115 - DNA, 207 bp, Haemophilus influenzae
  Name: NTH0616
atgttacatttctgtgaaaatccaggaaaattgcaaacgcgcgaagaattgctgaaaaaaatgacgggacgagagttaaaacctcaggatcgtaccgtagatgtcacaattcgacgtatcagaaaacattttgaagatcatccaaatactccaaatatcattatgactatacatggagaaggctatcgcttttgcggagatattgaa

SEQ ID NO: 1116 - protein, 69 aa, Haemophilus influenzae
  Name: NTH0616
MLHFCENPGKLQTREELLKKMTGRELKPQDRTVDVTIRRIRKHFEDHPNTPNIIMTIHGEGYRFCGDIE

SEQ ID NO: 1117 - DNA, 243 bp, Haemophilus influenzae
  Name: NTH0617
atggcagggactgttactggacgaacccttggagagatccattttagaaatggacgccgaaggcgcaaaagagcggttaatttttcaatcgtttttcaaacgctcaggcaaaaggacaggggcaaaagacaatctattgtaagtgtggaaattattcatttttttaccgcactttcttttcacattgtatcttttcgtcttcttgtcgtgtttatttttgatttaaacgacgaggaatcacaa

SEQ ID NO: 1118 - protein, 81 aa, Haemophilus influenzae
  Name: NTH0617
MAGTVTGRTLGEIHFRNGRRRRKRAVNFSIVFQTLRQKDRGKRQSIVSVEIIHFFTALSFHIVSFRLLVVFIFDLNDEESQ

SEQ ID NO: 1119 - DNA, 1104 bp, Haemophilus influenzae
  Name: NTH0618
atgacaattgagtcaattctttcagctattgatagctttatttggggcgcacctctacttatattattatctggtacaggactctatttaacgttacgcttaggctttattcaaattcgctacttaccgcgtgcgctaggttatttatttaaaaaagataaaggtggaaaaggagacgtttcctcttttgctgcactttgtactgcattagcagcaacaattggaacgggtaatattgtgggcgttgcaactgcggtacaagcaggtgggccaggggctattttttggatgtggctggttgctttgttaggaatggcaacaaaatatgctgaatgtttactcgctgttaaataccgtgttcgcgataaaaatggctttatggctggcggcccgatgtattacattgaacgcggactaggtatcaaatggctagcaaaattatttgcattatttggtgtgatggtggcctttttcgggatcggcacattcccacaggtcaatgcgattacccatgcaatgcaagatacttttaatattccagttttagttactgcaattattgtgacgcttttagtcggcttaattattcttggcggtgtaaaacgtattgcaaccgcatcatcggtaattgtgccgtttatggcgattttatacgtcacgacttcactggttattatccttttaaatatagaaaaagtaccagatgcgattttattaattattgatagtgcttttgatccgcaagcagcattaggcggtgccgtagggcttactgtgatgaaagcgattcaatcaggcgttgcgcgcggcattttctccaatgaatctggtttaggaagcgcaccaattgcagctgcagcggcacaaactcgtgaacctgtgcgacaaggcttaatttccatgacaggtacattcttagataccatcatcgtctgtacaatgacaggtattgtattggtattaacgggagcgtggaacaatcctgaattagcgggtgctaccgtcacaaactatgcctttgcacaaggcttaggcacatcaattggtgcaacgattgtaacagttggtttattattttttgcattcacgactatcttaggttgg

SEQ ID NO: 1120 - protein, 368 aa, Haemophilus influenzae
  Name: NTH0618
MTIESILSAIDSFIWGAPLLILLSGTGLYLTLRLGFIQIRYLPRALGYLFKKDKGGKGDVSSFAALCTALAATIGTGNIVGVATAVQAGGPGAIFWMWLVALLGMATKYAECLLAVKYRVRDKNGFMAGGPMYYIERGLGIKWLAKLFALFGVMVAFFGIGTFPQVNAITHAMQDTFNIPVLVTAIIVTLLVGLIILGGVKRIATASSVIVPFMAILYVTTSLVIILLNIEKVPDAILLIIDSAFDPQAALGGAVGLTVMKAIQSGVARGIFSNESGLGSAPIAAAAAQTREPVRQGLISMTGTFLDTIIVCTMTGIVLVLTGAWNNPELAGATVTNYAFAQGLGTSIGATIVTVGLLFFAFTTILGW

SEQ ID NO: 1121 - DNA, 909 bp, Haemophilus influenzae
  Name: NTH0619
atgattactggtgcggcacaaatggatggtgctattttagtagtagcagcaacagatggtcctatgccacaaactcgtgaacacatcttattaggtcgccaagtaggtgtaccatacatcatcgtattcttaaacaaatgcgatatggtagatgatgaagagttattagaattagtagaaatggaagtgcgtgaacttctatctcaatatgacttcccaggtgacgacacgccaatcgtacgtggttcagcattacaagcattgaacggcgtagcagaatgggaagaaaaaatcctagaattagcaggtcacttagatacttatattccagaaccagaacgtgcgattgaccaaccgttccttcttccaatcgaagatgtgttctcaatctcaggtcgtggtactgtagtaacaggtcgtgtagaacgtggtatcatccgtacaggtgatgaagtagaaatcgtcggtatcaaagatacagcgaaaactactgtaactggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtactatcgaattaccagaaggcgtggaaatggtaatgccaggcgataacatcaagatgacagtaagcttaatccacccaatcgcgatggatcaaggtttacgtttcgcaatccgtgaaggtggccgtacagtaggtgctggcgttgttgcgaaaatcatcaaa

SEQ ID NO: 1122 - protein, 303 aa, Haemophilus influenzae
  Name: NTH0619
MITGAAQMDGAILVVAATDGPMPQTREHILLGRQVGVPYIIVFLNKCDMVDDEELLELVEMEVRELLSQYDFPGDDTPIVRGSALQALNGVAEWEEKILELAGHLDTYIPEPERAIDQPFLLPIEDVFSISGRGTVVTGRVERGIIRTGDEVEIVGIKDTAKTTVTGVEMFRKLLDEGRAGENIGALLRGTKREEIERGQVLAKPGSITPHTDFESEVYVLSKDEGGRHTPFFKGYRPQFYFRTTDVTGTIELPEGVEMVMPGDNIKMTVSLIHPIAMDQGLRFAIREGGRTVGAGVVAKIIK

SEQ ID NO: 1123 - DNA, 285 bp, Haemophilus influenzae
  Name: NTH0620
atgctttatacattttctcaatcagattatcccaaaactgaactagatgactatttttcatatattacagaaaaagatgcggtagtactatggcaagacggtgtgttattggcaataaaatatcctgattattttgccaaatgtaaagggaattgcatgatattaaaacaagatattttagcaagaaatctcaccgcacttttacctcaaagtagcaagataaaattaatatcaatagaagaacttgttggaatcactgaaaattatttaccacagctatcacta

SEQ ID NO: 1124 - protein, 95 aa, Haemophilus influenzae
  Name: NTH0620
MLYTFSQSDYPKTELDDYFSYITEKDAVVLWQDGVLLAIKYPDYFAKCKGNCMILKQDILARNLTALLPQSSKIKLISIEELVGITENYLPQLSL

SEQ ID NO: 1125 - DNA, 108 bp, Haemophilus influenzae
  Name: NTH0621
ttgcagaaatttaaattagataatagagaacttatcctatcttgtgaaaaaattgaccgctctttattgctagaaaagcttaatcaagcagaaaaattgtttactttc

SEQ ID NO: 1126 - protein, 36 aa, Haemophilus influenzae
  Name: NTH0621
LQKFKLDNRELILSCEKIDRSLLLEKLNQAEKLFTF

SEQ ID NO: 1127 - DNA, 654 bp, Haemophilus influenzae
  Name: NTH0622
gtgaaccaattttttatcacatctattaatataataaaaaagcaggaacaaatggaatttttaattggattttttactgaatatggttattgggctgttctttttgttttaattatttgtggatttggtgtgccgattccagaagatatcacgttagtttctggcggtgtcattgcggggctttatccagaaaatgtcaattctcatttgatgttgctggttagtatgattggtgtgcttgctggcgattcctgtatgtattggcttggtcgaatttatggcacgaaaattttacgtttccgaccaatacgtagaatcgtaacattacagcgtttaagaattgtgcgtgaaaaattcagtcaatatggcaatcgagtactgtttgttgcacgatttttacccggtttacgtgctccaatttatatggtatcaggtattacacgccgtgtaagttatgttcgttttgttttaatagatttctgtgctgcgattatttctgtacctatttggatttatcttggggaattgggggctaaaaatttagattggctacatacacaaattcaaaaaggtcaaattgtgatttatatatttgttgggttacttgtactattctttttttggaaatggaaaaaatctaaaaaatcaacgcaa

SEQ ID NO: 1128 - protein, 218 aa, Haemophilus influenzae
  Name: NTH0622
VNQFFITSINIIKKQEQMEFLIGFFTEYGYWAVLFVLIICGFGVPIPEDITLVSGGVIAGLYPENVNSHLMLLVSMIGVLAGDSCMYWLGRIYGTKILRFRPIRRIVTLQRLRIVREKFSQYGNRVLFVARFLPGLRAPIYMVSGITRRVSYVRFVLIDFCAAIISVPIWIYLGELGAKNLDWLHTQIQKGQIVIYIFVGLLVLFFFWKWKKSKKSTQ

SEQ ID NO: 1129 - DNA, 450 bp, Haemophilus influenzae
  Name: NTH0624
ttgttagtttttaagccgaataaacaggagaatattatggaaaattggacaaatgaaatttgggtagcaattggtatcgcttttattgttgggttatttattggttacattattgtgcgtttaaccaaaggctcggtaaaacatcaagctaaaacagaggctgaattaaaaacagtcaaaacccagcttgatacacaaaaggcgcaaatcgaaaaacattttgcagaaagtgctgagttattcaaaaccttaattaacgattatcaaaaactttatcgccactacgcaacttcctccaataatttactgggcgaaaaagatcacaaaggtttattcacccaacagttaattactgcaacagataaatctcaaaatgaacagcctagagattattcggatggtgcatcaggcttatttaaagaaaataaagaagaaaataaagaagaaaat

SEQ ID NO: 1130 - protein, 150 aa, Haemophilus influenzae
  Name: NTH0624
LLVFKPNKQENIMENWTNEIWVAIGIAFIVGLFIGYIIVRLTKGSVKHQAKTEAELKTVKTQLDTQKAQIEKHFAESAELFKTLINDYQKLYRHYATSSNNLLGEKDHKGLFTQQLITATDKSQNEQPRDYSDGASGLFKENKEENKEEN

SEQ ID NO: 1131 - DNA, 123 bp, Haemophilus influenzae
  Name: NTH0625
atgtcaattaaatcaagctgggatgaatgggtcgatcatgttagccccccaagtcgagcgacagtggaagctaaattagcggatcctcgttggaaagttgaaattgttattattgcaacttgt

SEQ ID NO: 1132 - protein, 41 aa, Haemophilus influenzae
  Name: NTH0625
MSIKSSWDEWVDHVSPPSRATVEAKLADPRWKVEIVIIATC

SEQ ID NO: 1133 - DNA, 492 bp, Haemophilus influenzae
  n 429: n is any nucleotide
  Name: NTH0626
atgcgtggctatctctttggcatactgtccgctgtattttgggcattatctggattgttatataatgaattgccattaagtgaatatgatgcattagggaaaataatttcattgctttttttaattgatttttgctcgttattagttatcggcataacattatggcgaaaaagtgcggtagattttcaaggcgttttttggcaacctgcgttatctggcgtattaggtgggccaataggaatgtctgcctatttattaagcattcattatttaacgatctattatgcggcaccgctttcatctctctttcctgttttcgctgcgttaatgtcttattggattctaaaagaaaaaatctctagaacagcgcagtttggatttggattggcggttattgcttctgcattgttggctattgaagccgggcanaaagcaaacttcaatacaagcgggctcatttttttagccatttgcatattaggggtgggcatc

SEQ ID NO: 1134 - protein, 164 aa, Haemophilus influenzae
  Xaa 143: Xaa is any amino acid
  Name: NTH0626
MRGYLFGILSAVFWALSGLLYNELPLSEYDALGKIISLLFLIDFCSLLVIGITLWRKSAVDFQGVFWQPALSGVLGGPIGMSAYLLSIHYLTIYYAAPLSSLFPVFAALMSYWILKEKISRTAQFGFGLAVIASALLAIEAGXKANFNTSGLIFLAICILGVGI

SEQ ID NO: 1135 - DNA, 963 bp, Haemophilus influenzae
  Name: NTH0627
atgttaagcattcattccatccatccattcattcaatcaatcaatcaatcaatcaatcaatcaatcaatcaaattgtaggatttgttaaaacttgctacaagcctgaagaagtatttcattttcttcatcagcattccattcctttttcctccattggaggaatgaccaatcaaaatgttctacttaatatttctggagttaagtttgtattacggatccctaatgccgtaaatttatcacttataaatcgagaatatgaggcattcaataatgctcaggcatatcgtgctggcttgaatgtagaaactcccgtattagatgccaaaagtggcgtaaaactgactcgttatttagaaaatagtaatactttaagccagatacaattaaacgaacaaagttgtttgtctcaagttgtgaataatttatatcgtttacacaatagtgaatttgttttccgtaatgtatttagcgtattcgatgagtttcgccaatatttttcattgctagaaaacaaatccgctttttatcaagctgattctagaatggataaactttcagctgtattttggcaatttgaagaaatcaataaagagataattttacgtccgtgccacaatgatttagtccctgaaaatatgttattacaagatgatcggctattttttatcgattgggaatattcgggcttaaatgatccgctatttgatatagctactatcattgaggaagctcatttatcgaaagaagctgctgattttctattagaaacctattgcaatcagacaaataaatatcacaagacagaatttcaaatcgctcacaaacggttaaaaatccatcgcttttgccaaaatgtattgtggtttttatggacaaaagtaaaagaagaacacggcgagaattttggcgattatgcattaaaacgcttagacgcagcatttaaactgttagaggaattgcca

SEQ ID NO: 1136 - protein, 321 aa, Haemophilus influenzae
  Name: NTH0627
MLSIHSIHPFIQSINQSINQSINQIVGFVKTCYKPEEVFHFLHQHSIPFSSIGGMTNQNVLLNISGVKFVLRIPNAVNLSLINREYEAFNNAQAYRAGLNVETPVLDAKSGVKLTRYLENSNTLSQIQLNEQSCLSQVVNNLYRLHNSEFVFRNVFSVFDEFRQYFSLLENKSAFYQADSRMDKLSAVFWQFEEINKEIILRPCHNDLVPENMLLQDDRLFFIDWEYSGLNDPLFDIATIIEEAHLSKEAADFLLETYCNQTNKYHKTEFQIAHKRLKIHRFCQNVLWFLWTKVKEEHGENFGDYALKRLDAAFKLLEELP

SEQ ID NO: 1137 - DNA, 705 bp, Haemophilus influenzae
  n 692, 693, 694, 695, 696: n is any nucleotide
  Name: NTH0628
atgcaaaatttacaaccttttcacactttccacattcagtctaatgctcgtgaaattattgaagcacatagtatcgaacagctacaacaagtgtgggcgaattctaaatcagaaaatttacccgtactttttttaggtcaaggcagtaatgttctgtttctggatgattttaatggcgtggtggttttaaatcgtttaatggggattacgcacgaacaagatgcaaattttcactatcttcacgtcaatggcggcgaaaattggcataaattggtggaatggtctattaataatggtatttatggcttagaaaatctggctttaattcctggctgtgcaggatctgcgcctattcaaaatatcggtgcttatggcgttgaatttaaagatgtgtgcgattatgtggatgtacttaatttaaacacgaatgaaacctttagactcgacacagaacaatgtgaatttggttatcgtgaaagtacttttaaacatcgttatcagcaaggttacgtgattacagcggttggattaaagcttaaaaaagattggcagcctattctaaaatatggttcgcttgtagacttcgatccaaaaactatcacggctaaacaaatttttgatgaagtctgtcatatccgtcaaagtaaattacctgatccaaatgaaacgggtaatgcagggagtttccttannnnnttaattaat

SEQ ID NO: 1138 - protein, 235 aa, Haemophilus influenzae
  Xaa 231, 232: Xaa is any amino acid
  Name: NTH0628
MQNLQPFHTFHIQSNAREIIEAHSIEQLQQVWANSKSENLPVLFLGQGSNVLFLDDFNGVVVLNRLMGITHEQDANFHYLHVNGGENWHKLVEWSINNGIYGLENLALIPGCAGSAPIQNIGAYGVEFKDVCDYVDVLNLNTNETFRLDTEQCEFGYRESTFKHRYQQGYVITAVGLKLKKDWQPILKYGSLVDFDPKTITAKQIFDEVCHIRQSKLPDPNETGNAGSFLXXLIN

SEQ ID NO: 1139 - DNA, 537 bp, Haemophilus influenzae
  n 16, 29: n is any nucleotide
  Name: NTH0629
ttgctcaaacataacntgaagaaagaagncgaacaatcaaaagaaaagagtttggcaattattgccaattttgaacaagccctttctggtggttatgcacagttacgtgagcttttagccactttccgtttaactatacaagaagcgaatttacagcttgcactaaaacaagtgattgattcattacgctcacaaacaacaatgcaaatgaatgtgaattgtcaattaccatcgcaaagtttgaaccctcaacagctggttcacgttctgcaaattgtacgtgaagccaccaccaatgcgatcaaacattctcaaggcacggtaattgaaattagcgcaagaattaatgcggaaggcgagtatgaaattttagttgaagatgatggggttggcattccaaaccttgaggagcctgaagggcattacggcttgaatattatggcggaacgttgccgtcagcttaatgcacaattgcatattcatcgccgagaacaaggcggcacacaagtcaaaattaccttgccacatacattatat

SEQ ID NO: 1140 - protein, 179 aa, Haemophilus influenzae
  Xaa 6, 10: Xaa is any amino acid
  Name: NTH0629
LLKHNXKKEXEQSKEKSLAIIANFEQALSGGYAQLRELLATFRLTIQEANLQLALKQVIDSLRSQTTMQMNVNCQLPSQSLNPQQLVHVLQIVREATTNAIKHSQGTVIEISARINAEGEYEILVEDDGVGIPNLEEPEGHYGLNIMAERCRQLNAQLHIHRREQGGTQVKITLPHTLY

SEQ ID NO: 1141 - DNA, 453 bp, Haemophilus influenzae
  Name: NTH0630
atgacaaagaaaaaagtaaaacccaattcaaatactatcgcactgaataaacgtgcaagacacgattattttattgaagatgaaattgaagcaggtcttgaattacaaggctgggaagtcaaatctatgcgcgcaggcaaggcaaatattagtgatagttatgttatttttaaaaatggcgaagcctttttattcggcgcaagcattcagccattaaatgttgcatcaacgcatattgtttgtgatccaactcgcactcgtaagttattgttaaataaacgcgaattagcatccctatttggcaaagcaaaccgagacggttttaccatagttgcactttctctttactggaaaagtgcgggggcaaaagtcaaatcgtctacccacagcgtcaatctcaggatctccgggctggtctcattgacgcgattggtatgtacaatgatcgcttta

SEQ ID NO: 1142 - protein, 151 aa, Haemophilus influenzae
  Name: NTH0630
MTKKKVKPNSNTIALNKRARHDYFIEDEIEAGLELQGWEVKSMRAGKANISDSYVIFKNGEAFLFGASIQPLNVASTHIVCDPTRTRKLLLNKRELASLFGKANRDGFTIVALSLYWKSAGAKVKSSTHSVNLRISGLVSLTRLVCTMIAL

SEQ ID NO: 1143 - DNA, 162 bp, Haemophilus influenzae
  Name: NTH0631
gtgttagtgatttatatagtgaataaaggattattccaaacgttttgccactttaagccaatcagccttaaatacacgctgcatattattaatggcatcaataatatcgtgatgaacgagttgttcattttggatacctacgcaatagccgcctttgccttg

SEQ ID NO: 1144 - protein, 54 aa, Haemophilus influenzae
  Name: NTH0631
VLVIYIVNKGLFQTFCHFKPISLKYTLHIINGINNIVMNELFILDTYAIAAFAL

SEQ ID NO: 1145 - DNA, 159 bp, Haemophilus influenzae
  Name: NTH0632
atgggcgcatacgcagtagatttattgctacaaggcaaaggcggctattgcgtaggtatccaaaatgaacaactcgttcatcacgatattattgatgccattaataatatgcagcgtgtatttaaggctgattggcttaaagtggcaaaacgtttggaa

SEQ ID NO: 1146 - protein, 53 aa, Haemophilus influenzae
  Name: NTH0632
MGAYAVDLLLQGKGGYCVGIQNEQLVHHDIIDAINNMQRVFKADWLKVAKRLE

SEQ ID NO: 1147 - DNA, 870 bp, Haemophilus influenzae
  Name: NTH0633
atgattaaaaaaattgcagttttaacaagtggtggcgatgcgccgggtatgaatgccgcaattcgtggcgtagtacgctctgcacttgcagaaggcttagaagtgtttggtatctatgatggttaccaaggtttatacaataataaaatcaaacaattaaatcgctatagcgtatctgatgtaattaatcgtggcggtacttttttaggttctgcacgctttcctgaatttaaagatccaaatgttcgtgcaaaatgtgcagaaattttacgttctcacggcattgatgcacttgtggttatcggtggtgacggttcttatatgggagctaaattattaaccgaagaacacggtttcccttgtgttggcttacccggtactattgataatgatgttgcaggtactgactataccatcggctatcaaaccgcattacaaactgcagtggatgcaatcgaccgtttacgtgatacatcaagctcacaccaacgtatttctatcgttgaaattatgggtcgccattgtagtgacttaacgatttctgcgggcattgctggcggttgtgaatatatcgtcgcatcagaaattgaatttaatcgcgaacaattaattcaacaaattgaacgtagcattattcgcggtaaacgccacgctattattgctatcactgaacttttaactgatgttcattctctggcaaagaaaattgaagctcgcgtaggtcacgaaacctcgcgcaaccgttttagggcatattcaacgtggtggttctccttgggcttttgccggtattcttgcctcacgtatgggcgcatacgcagtagatttattgctacaaggcaaaggcggctattgcgtaggtatccaaaa

SEQ ID NO: 1148 - protein, 290 aa, Haemophilus influenzae
  Name: NTH0633
MIKKIAVLTSGGDAPGMNAAIRGVVRSALAEGLEVFGIYDGYQGLYNNKIKQLNRYSVSDVINRGGTFLGSARFPEFKDPNVRAKCAEILRSHGIDALVVIGGDGSYMGAKLLTEEHGFPCVGLPGTIDNDVAGTDYTIGYQTALQTAVDAIDRLRDTSSSHQRISIVEIMGRHCSDLTISAGIAGGCEYIVASEIEFNREQLIQQIERSIIRGKRHAIIAITELLTDVHSLAKKIEARVGHETSRNRFRAYSTWWFSLGFCRYSCLTYGRIRSRFIATRQRRLLRRYPK

SEQ ID NO: 1149 - DNA, 534 bp, Haemophilus influenzae
  n 70: n is any nucleotide
  Name: NTH0634
gtgcaacttaggctggcccaattaaaatgtgctaccgcaggtagaatatatgggccaacattatggactntctggcagccaagatttaggaacccatgcacgctatgcgtaatatctaagccagatacgctagaaaattggcaatctgaaattgaaattctctttgatcgcaatcaatccgaccgttctattaaagaacgtattgcattaagagaacgcatttatcgcaatacagacgtgaaagattttcattttgatactattccagaaaattcgaccaatccaaatgaattaaatggatatgtcatctattcgccaacaaaggaaaatccatcttggcaagtcaatgtgatgaaaggacgacaattgccccaatgtggctttgtgcaatttcaatattcgcagaaaatacagcaaccaacgcattctaaacatttatctgtcgataaagtacaacaacatttgcaaaaatacattgtggatatagaaagaaaacatttacaaaatttgaaatggcaactgttttgtgaaaaa

SEQ ID NO: 1150 - protein, 178 aa, Haemophilus influenzae
  Xaa 24: Xaa is any amino acid
  Name: NTH0634
VQLRLAQLKCATAGRIYGPTLWTXWQPRFRNPCTLCVISKPDTLENWQSEIEILFDRNQSDRSIKERIALRERIYRNTDVKDFHFDTIPENSTNPNELNGYVIYSPTKENPSWQVNVMKGRQLPQCGFVQFQYSQKIQQPTHSKHLSVDKVQQHLQKYIVDIERKHLQNLKWQLFCEK

SEQ ID NO: 1151 - DNA, 1065 bp, Haemophilus influenzae
  n 1056, 1057, 1058, 1059, 1060: n is any nucleotide
  Name: NTH0635
atgctgaccgagtcgcaaaactttattgagcaaaaatatccgctatctgaatcacaaggcgagcgttccatctttttgtttggtaaagaaaccaatgatgaaacctatgccatttgtaaatctgacatgatgattaaaggtgataatcccgaaaacatcaaagtcggctcaacccttgctacagatagcttccaaggtaatcactttgactttatgctttccaacccgccatatggcaaaagctggagcaaagatcaagcctatatcaaagacggcaatgaggttatcgacagtcgctttaaagttaccttaccagattactggggcaatgtagaaacccttgatgctaccccacgctccagcgatggacagctgctattcctaatggaaatggtcagcaaaatgaaatcgccgaatgacaacaaaatcggcagccgagtggcctccgtgcataacggctcaagcctgtttaccggcgatgcaggttcaggagaaagcaacattcgtcgccatattattgaaaaagatttgctcgaagccatcgtacagctgcctaacaacctgttttataacacaggtattaccacttatatttggttgctgtccaacaacaaacctgaagcacgcaaaggcaaagttcagctcattgatgccagcctcttattccgcaaattgcgtaaaaaccttggcgataaaaactgcgaatttgtacctgaacatatcgccgaaattacccaaaactatcttgatttcactgccaaagcgcgcgaaaccgacagccaaaatgaagcagtcggcctggcttcgcagatttttgacaatcaagatttcggctattacaaagtcaccatcgaacgcccggatcgccgttctgcccaatttaccgccgaaaatatctcgcctttacggtttgacaaggctttgtttgagccgatgcaatatctttatcggcaatatggcgaacaaatttacaacgccggatttttagcccaaaccgagcaagaaattaccgcttggtgcgaagcgcagggcatagccttaaacaacaaaaacaannnnnttaat

SEQ ID NO: 1152 - protein, 355 aa, Haemophilus influenzae
  Xaa 352, 353, 354: Xaa is any amino acid
  Name: NTH0635
MLTESQNFIEQKYPLSESQGERSIFLFGKETNDETYAICKSDMMIKGDNPENIKVGSTLATDSFQGNHFDFMLSNPPYGKSWSKDQAYIKDGNEVIDSRFKVTLPDYWGNVETLDATPRSSDGQLLFLMEMVSKMKSPNDNKIGSRVASVHNGSSLFTGDAGSGESNIRRHIIEKDLLEAIVQLPNNLFYNTGITTYIWLLSNNKPEARKGKVQLIDASLLFRKLRKNLGDKNCEFVPEHIAEITQNYLDFTAKARETDSQNEAVGLASQIFDNQDFGYYKVTIERPDRRSAQFTAENISPLRFDKALFEPMQYLYRQYGEQIYNAGFLAQTEQEITAWCEAQGIALNNKNXXXN

SEQ ID NO: 1153 - DNA, 474 bp, Haemophilus influenzae
  n 469, 470, 471, 472, 473: n is any nucleotide
  Name: NTH0636
atgttaaatcttaatgaattaaaatctggtttccactattttgtgatgggctggcatttcatcacacaaaaaggtttgcgtcggtttgttattattccaattttgctcaataccattttgctttgtggtttattttggctttttattagccaaatcagcagtgctattgattgggtgatgaattttattccagattggcttagttttctcagtgtcattttactgacactttcgattttaacgattttattgctcttttattttacttttaccacgttttctggctttatcgcagccccctttaatggtttgttggcggaaaaagtagaaaaaatgctgacggaggaaaatattaatgatgatagtctcgtggatataatgagggatgtgcctcgtatgcttgctcgagagtggcaaaaattacgttatagggggtcctatagagtcgactgcaggcagcaagctggcnnnnnt

SEQ ID NO: 1154 - protein, 158 aa, Haemophilus influenzae
  Xaa 157, 158: Xaa is any amino acid
  Name: NTH0636
MLNLNELKSGFHYFVMGWHFITQKGLRRFVIIPILLNTILLCGLFWLFISQISSAIDWVMNFIPDWLSFLSVILLTLSILTILLLFYFTFTTFSGFIAAPFNGLLAEKVEKMLTEENINDDSLVDIMRDVPRMLAREWQKLRYRGSYRVDCRQQAGXX

SEQ ID NO: 1155 - DNA, 93 bp, Haemophilus influenzae
  Name: NTH0637
gtgaaaaaatacttcaaagtgtggaattttaaaggaaaagtgcggtctgttttaagcatatttttattgaaaggaaagaaaaatgttaaatct

SEQ ID NO: 1156 - protein, 31 aa, Haemophilus influenzae
  Name: NTH0637
VKKYFKVWNFKGKVRSVLSIFLLKGKKNVKS

SEQ ID NO: 1157 - DNA, 984 bp, Haemophilus influenzae
  Name: NTH0638
atggatttaaatacaattttgattattgtgggtatcgtagcacttgtcgccttaatcgtacacggattatggtcaaatcgtcgtgagaaatcaaaatattttgataaagccaataaatttgaccgcacttctccaacatctagatcccatacgcaagaagaaatggtacagccaaacaatatttcgccgaatacctatgtggaaaatgggcatacaccaatttctcaaccgaccacagaaaaattaccatcagaagctgaattgatcgattatcgccaaagcgataaaagtgtggatgacatcaaaatttctattcctaacacgcaacctatttatgatatggggaatcatcgttccgagccaatacaaccaacgcaacctcaatacgatatgccaaccgcaaataatgtcgcaagtatgaccttagaacaacttgaagcacaaagtcaaaatgttggttttaatggcattaattcatcatcgccagaattaagagtgcagcttgcagaattatctcacgaagaacatcaagtagactacaacctctcgttcaatgaaccaaaagcagaaacgacagctcagccaaaacaaacaactggctatattcaactttatcttattccaaaatctagcgaagaatttaatggtgctaaattggtgcaggctcttgaaaacttgggttttatcttgggtaaagatgaaatgtatcatcgtcacttagatttaagtgtggcaagtcccgtgctttttagtgtggcaaatttagaacaacccggcacattcaatgcttataacttagcggaatttaacaccataggaattgtattatttatgcaattgccctctccaggtaataatcttgctaatttacgtatgatgatgcgtgctgcccatacattagccgaagatttacaaggtgttatactgactgaagaacaagaaatttttgatgcaaatgcagagcaagcctatcttgctcgagtg

SEQ ID NO: 1158 - protein, 328 aa, Haemophilus influenzae
  Name: NTH0638
MDLNTILIIVGIVALVALIVHGLWSNRREKSKYFDKANKFDRTSPTSRSHTQEEMVQPNNISPNTYVENGHTPISQPTTEKLPSEAELIDYRQSDKSVDDIKISIPNTQPIYDMGNHRSEPIQPTQPQYDMPTANNVASMTLEQLEAQSQNVGFNGINSSSPELRVQLAELSHEEHQVDYNLSFNEPKAETTAQPKQTTGYIQLYLIPKSSEEFNGAKLVQALENLGFILGKDEMYHRHLDLSVASPVLFSVANLEQPGTFNAYNLAEFNTIGIVLFMQLPSPGNNLANLRMMMRAAHTLAEDLQGVILTEEQEIFDANAEQAYLARV

SEQ ID NO: 1159 - DNA, 366 bp, Haemophilus influenzae
  n 361, 362, 363, 364, 365: n is any nucleotide
  Name: NTH0640
atggcaactatcaaccagctagtacgcaaaccgcgtgtgaaaaaggttgtaaaaagcaacgttcctgcattagaggcttgcccgcagaaacgtggtgtatgtactcgtgtatatactacaactcctaaaaaaccaaactcagcgttacgtaaagtatgtcgtatccgcttaactaacggttttgaagtaacttcttatattggtggtgaaggtcacaaccttcaagagcacagtgttgtattaatccgtggtggtcgtgttaaagacttaccgggtgtgcgttaccacacagtacgcggtgcattagactgtgcaggcgttaaagatcgtaaacaaggtcgttctaaatacggcgttaaannnnnt

SEQ ID NO: 1160 - protein, 122 aa, Haemophilus influenzae
  Xaa 121, 122: Xaa is any amino acid
  Name: NTH0640
MATINQLVRKPRVKKVVKSNVPALEACPQKRGVCTRVYTTTPKKPNSALRKVCRIRLTNGFEVTSYIGGEGHNLQEHSVVLIRGGRVKDLPGVRYHTVRGALDCAGVKDRKQGRSKYGVKXX

SEQ ID NO: 1161 - DNA, 1038 bp, Haemophilus influenzae
  Name: NTH0641
gtgatgcgttttgcggatcgtaattcacatcaaatctatttggaaccagaaggattaaccagtaacgaagtgtatccaaatgggatttctaccagtttgccgtttgacgtacaaatgggcattgtgaattccatgaaaggtttggaaaaagctcgcatcattaaaccgggttatgccattgaatatgattattttgatccacgtgatttaaaaccaacgttagaaacaaaagctatttcaggtttattcttcgcaggccaaattaacggtacaaccggttatgaagaagcagcggcacaaggcttattggcggggattaacgcaggtctttatgtacaagagaaagaggcatggtatccacgtcgtgatcaatcttatactggagtattggttgatgacctttgtacgctcggtacgaaagaaccgtatcgtgtattcacttctcgtgctgaataccgtttgttattacgtgaagacaatgcagatattcgtttaacgccaattgcccatgaattaggtttgattgatgaggctcgctgggcacgctttaatcaaaaaatggaaaagattgagcaagaacgccagcgcttacgcagcatttggctgcatccgcgttctgaatatttagaagaagccaataaagtgcttggcagtccacttgtgcgtgaagccagcggtgaagatttattacgccgtccagaaatgacctacgatattttgacttctttaacgccatacaagcccgcaatagaagatagagaagccgtagaacaagtggaaattgctattaagtatcaaggctatattgagcatcaacaagaagaaattgaaaaacaaaaacgccatgaaaatacggctattcctgctaattttgattatagtaaagtgtctggattatctaatgaagtacgtgcgaagttagaacaacatcgtccggtttccattggacaagcgagccgaatttcaggtataacgcctgctgctatttcaattattctggttaatttgaaaaaacaaggcatgctaaaacgtggggaa

SEQ ID NO: 1162 - protein, 346 aa, Haemophilus influenzae
  Name: NTH0641
VMRFADRNSHQIYLEPEGLTSNEVYPNGISTSLPFDVQMGIVNSMKGLEKARIIKPGYAIEYDYFDPRDLKPTLETKAISGLFFAGQINGTTGYEEAAAQGLLAGINAGLYVQEKEAWYPRRDQSYTGVLVDDLCTLGTKEPYRVFTSRAEYRLLLREDNADIRLTPIAHELGLIDEARWARFNQKMEKIEQERQRLRSIWLHPRSEYLEEANKVLGSPLVREASGEDLLRRPEMTYDILTSLTPYKPAIEDREAVEQVEIAIKYQGYIEHQQEEIEKQKRHENTAIPANFDYSKVSGLSNEVRAKLEQHRPVSIGQASRISGITPAAISIILVNLKKQGMLKRGE

SEQ ID NO: 1163 - DNA, 897 bp, Haemophilus influenzae
  n 892, 893, 894, 895, 896: n is any nucleotide
  Name: NTH0642
ttgcgaattagcaattatataaagctcggttcaagttcagtctatattgccttactcgtttggctcatcattatgtttatcggtgtccctgtaggttggtccttatttattgctaccctactttatttttctatgacacgttggaacgtcgtaaatgccgcaactgaaaaattagtctatagcctagacagctttccattacttgccgtgccgttttatattttaacgggtattctaatgaatactggtgggattaccgaacgtatttttaatttcgctaaatccttactcggtcattacacaggaggaatgggacacgttaatatcggcgcaagtttattattttcaggtatgtcaggatccgcattagctgatgcaggcggtttaggtcagcttgagattaaagcaatgcgtgatgctggttatgacgatgatatttgcggaggaattactgctgcttcttgtattattgggccattagttccaccaagtattgcaatgattatttacggtgtcatcgccaatgaatctatcgcaaaactctttattgcaggttttattcccggtgtattaattactttagctttaatggcaatgaattatcgcattgcaaaaaaacgaggttatccacgtacaccaaaagccacaagagaacaactttgcagcagctttaaacaatctttttgggcaatcttaacgccattattaattatcggcggtattttttcaggcttattcagtccaacagaatctgccattgttgcagcagcatactctataattattggtaaatttgtgtataaagaattaaccttaaaaaccttatttaatagttgcatagaagcaatggcaattacaggcgtggtcgccttaatgattatgaccgtgactnnnnnt

SEQ ID NO: 1164 - protein, 299 aa, Haemophilus influenzae
  Xaa 298, 299: Xaa is any amino acid
  Name: NTH0642
LRISNYIKLGSSSVYIALLVWLIIMFIGVPVGWSLFIATLLYFSMTRWNVVNAATEKLVYSLDSFPLLAVPFYILTGILMNTGGITERIFNFAKSLLGHYTGGMGHVNIGASLLFSGMSGSALADAGGLGQLEIKAMRDAGYDDDICGGITAASCIIGPLVPPSIAMIIYGVIANESIAKLFIAGFIPGVLITLALMAMNYRIAKKRGYPRTPKATREQLCSSFKQSFWAILTPLLIIGGIFSGLFSPTESAIVAAAYSIIIGKFVYKELTLKTLFNSCIEAMAITGVVALMIMTVTXX

SEQ ID NO: 1165 - DNA, 123 bp, Haemophilus influenzae
  n 112: n is any nucleotide
  Name: NTH0643
atgacgcatcattcccctattgatgctttagggggcatttctgaaaaatggattttcgctgcactacctgttatcgcaatattaatgatgtttcgctttatccaagcgcaancccataaactt

SEQ ID NO: 1166 - protein, 41 aa, Haemophilus influenzae
  Xaa 38: Xaa is any amino acid
  Name: NTH0643
MTHHSPIDALGGISEKWIFAALPVIAILMMFRFIQAQXHKL

SEQ ID NO: 1167 - DNA, 90 bp, Haemophilus influenzae
  n 85, 86, 87, 88, 89: n is any nucleotide
  Name: NTH0644
ttgaaaaattcttttactatcttcttattattctttatgtatcttttagatagattacccaatcagtacaatattggggatatcnnnnnt

SEQ ID NO: 1168 - protein, 30 aa, Haemophilus influenzae
  Xaa 29, 30: Xaa is any amino acid
  Name: NTH0644
LKNSFTIFLLFFMYLLDRLPNQYNIGDIXX

SEQ ID NO: 1169 - DNA, 129 bp, Haemophilus influenzae
  Name: NTH0645
ttggggagtgaatttggcaaagagggagatggtttctttcgtatgaatgtcgctatgcctagaaaaaaattattagaagcattgaatcgaatcaaaaatgggttttgtttattaaacaatagggagatt

SEQ ID NO: 1170 - protein, 43 aa, Haemophilus influenzae
  Name: NTH0645
LGSEFGKEGDGFFRMNVAMPRKKLLEALNRIKNGFCLLNNREI

SEQ ID NO: 1171 - DNA, 771 bp, Haemophilus influenzae
  n 719: n is any nucleotide
  Name: NTH0646
atgaaaaccactcatcgcacaagaatgccaacaacattagaagctttttcaccaatcattgtgatgctattactgttagggcttgggtatgctttatttgatttgccagcagagccattaatgattatttcaacggtatttgctggttttttagttattaaattaggtcattgctatttagatattttagacgccatttcagaaaaaatagctaaaacaatgcctgcgctattaattttaattactgtaggattattaattggaacttggattagtggaggaacaattcctatgatgatctactacggactaaaagcaatatcaccagaatatctttatgtgacagccttattccttactgctattgtttccatttgtactggaacctcttgggggtcagcagggactgtcggtgtggcatttatgggagttgcgattggattagacgccaatttggctgctacggcaggtgctgtggtcgctggtgcgtattttggagataaattatcgccattatctgatacaaccaatattgcatccgcagctgctggcgtagatttatatgagcatatagttcacttactttatacaacattaccatcttttattctttcggctactgtctatgtggtatatggtttaaactacgatttttctaatgtagcgactccagaaaaagtaaatacaatgattcatgagttagagcaagtttatcattntaactttctattacttattccagtcgctattgtattatgggggatctattac

SEQ ID NO: 1172 - protein, 257 aa, Haemophilus influenzae
  Xaa 240: Xaa is any amino acid
  Name: NTH0646
MKTTHRTRMPTTLEAFSPIIVMLLLLGLGYALFDLPAEPLMIISTVFAGFLVIKLGHCYLDILDAISEKIAKTMPALLILITVGLLIGTWISGGTIPMMIYYGLKAISPEYLYVTALFLTAIVSICTGTSWGSAGTVGVAFMGVAIGLDANLAATAGAVVAGAYFGDKLSPLSDTTNIASAAAGVDLYEHIVHLLYTTLPSFILSATVYVVYGLNYDFSNVATPEKVNTMIHELEQVYHXNFLLLIPVAIVLWGIYY

SEQ ID NO: 1173 - DNA, 111 bp, Haemophilus influenzae
  Name: NTH0647
ttgtattatgggggatctattactaagaaaccgactattccagtgatgttattatcagcatttatcgcaattattaatgctatcttaattcaaaattctctctatctgatg

SEQ ID NO: 1174 - protein, 37 aa, Haemophilus influenzae
  Name: NTH0647
LYYGGSITKKPTIPVMLLSAFIAIINAILIQNSLYLM

SEQ ID NO: 1175 - DNA, 1086 bp, Haemophilus influenzae
  Name: NTH0648
atgttaattttaaaaggtaacaaaatgaaattattaaaccgtttagtgagcgtatttgcgattgtacttgctgttgaaagcaatgcattcgctggcgatgaagtacgcattgtcattgatgaaggggttgatggtgcgcgccctattgctgtcgtgccatttgttggttctgcaccagaagatattagcaaaatagttgcagatgatttacgtaacagtggtaagtttaatcctattgcggtgtctcaaatgcctcaacgcccaacttcagcagcagaggtaaatcctgaggcttggtcgaatattggaattgacgcaattgtaattggacaagtggttccatcgggtaatggttatagtattacttatcaattaattgatacggttggtgcatcaggtacgccaggggctgtattaatgcaaaatagctatacagtgacaaataaatggttacgctatggagcgcatactgtgagtgatgaagtttttgaaaaattaactgcgatccgtggtgcctttagaactcgtatcgcttatgttgtgcaaaaaaatggcggttcgcaaccttatgaagttcgtgtagcagattatgatggctataatcaatttatcgtcaatcgtagtgcccaaccaattatgtctccagcttggtctccagacggccagcgtttggcttatgtatcgtttgaaaataaaaaatcacaacttgttgtacaggatttaaattctggcgcacgtaaagtagtggcatcttttcaagggcataatggcgcaccagccttttcgccagatggttctcgtttagcttttgcttcttctcgtgatggtgttctgaatatttacgttatgggagcaaatggcggtacacctactcaattgacgagtggtgcgggtaataatactgaaccagcgtggtcgccagacggaaattcaattttatttacatccgatagaagtggttcgccacaagtttatcgaatggatgcaagcggaggtagtgcaacagcagtgggtggtcgcggcagcgcgcaaattagtgcagatggaaaaacacttgtgatgattaatggtaacaataatgtagtt

SEQ ID NO: 1176 - protein, 362 aa, Haemophilus influenzae
  Name: NTH0648
MLILKGNKMKLLNRLVSVFAIVLAVESNAFAGDEVRIVIDEGVDGARPIAVVPFVGSAPEDISKIVADDLRNSGKFNPIAVSQMPQRPTSAAEVNPEAWSNIGIDAIVIGQVVPSGNGYSITYQLIDTVGASGTPGAVLMQNSYTVTNKWLRYGAHTVSDEVFEKLTAIRGAFRTRIAYVVQKNGGSQPYEVRVADYDGYNQFIVNRSAQPIMSPAWSPDGQRLAYVSFENKKSQLVVQDLNSGARKVVASFQGHNGAPAFSPDGSRLAFASSRDGVLNIYVMGANGGTPTQLTSGAGNNTEPAWSPDGNSILFTSDRSGSPQVYRMDASGGSATAVGGRGSAQISADGKTLVMINGNNNVV

SEQ ID NO: 1177 - DNA, 1491 bp, Haemophilus influenzae
  n 1429, 1486, 1487, 1488, 1489, 1490: n is any nucleotide
  Name: NTH0650
atgcgtaatgcgaatgaacgccgtggcaatattgaggctgcattagaatctcgtcgcgagtggtataaagcaaaagcagagcagaatttatctcaacatcgtttagttgatttaagtcgagaagcggctgaattggcagaaaatgaacgtactttagaagttgatcaccaaagtgcggttgatcatcttaacttagtgttaaacgctttgcgtcaccaagaaaaaatcacgcgctatcaagaagatattgcagaactcaccgagcgtttagaagaacaaaaaatagtggttgaagatgcgaatgatgcgttagaagaaagccaagcccaatttgagcaaactgaaattgaaattgacgctgtacgagcgcaattagcagattatcaacaagcattagatgcccaacaaactcgcgcacttcaatatcaacaagccattactgcactcgaaaaggctaaaaccttgtgtggcttagctgatttaagtgttaaaaatgtagaagattatcacgcagaatttgaagcccatgctgaaagtttaacggaaactgtgcttgaacttgagcacaaaatgtctatttctgaagcggcaaaatctcagttcgataaagcgtaccaattagtatgcaaaattgccggcgaaattccacgctcgagcgcgtgggaaagtgcgaaagaattattacgtgaatatccaagccaaaaattgcaggcacaacaaacgccacaacttcgcacaaaattacatgaacttgagcaacgttatgcacaacaacaaagtgcggtcaaattacttaatgattttaatcaacgtgctaatttaagtttacaaacggcagaagaattagaggattatcacgcagagcaagaagcgttgattgaagatatttcagcaagactttcagaacaagtggaaaaccgttctacgcttcgtcaaaaacgtgaaaatttaaccgcactttatgatgaaaatgcgcgtaaagcaccagcatggctgacagctcaagctgcattagaacgtttagagcaacaaagtggcgagacgtttgaacatagccaagatgtgatgaactttatgcaatcacaacttgtgaaagaacgtgaactcacgatgcaacgtgatcaacttgaacaaaaacgtttgcaattagatgagcaaatttctcgtttaagtcagccagatggttcagaagatccgcgtttaaatatgctggcagaacgttttggtggtgtactgctttcagagctttacgatgacgtaaccattgaagatgcgccttatttctccgcactttacggacctgcacgtcatgctattgttgtgcgtgatctcaatgcagtgcgtgaacaacttgcgcaattagaagattgccctgatgatttatatttaattgaaggcgatcctaccgcatttgacgacagcgtattgnccgcacaagaacggggtcctcctagagtcgaacctgcaggccagcaaagtcaaggcnnnnnt

SEQ ID NO: 1178 - protein, 497 aa, Haemophilus influenzae
  Xaa 477, 496, 497: Xaa is any amino acid
  Name: NTH0650
MRNANERRGNIEAALESRREWYKAKAEQNLSQHRLVDLSREAAELAENERTLEVDHQSAVDHLNLVLNALRHQEKITRYQEDIAELTERLEEQKIVVEDANDALEESQAQFEQTEIEIDAVRAQLADYQQALDAQQTRALQYQQAITALEKAKTLCGLADLSVKNVEDYHAEFEAHAESLTETVLELEHKMSISEAAKSQFDKAYQLVCKIAGEIPRSSAWESAKELLREYPSQKLQAQQTPQLRTKLHELEQRYAQQQSAVKLLNDFNQRANLSLQTAEELEDYHAEQEALIEDISARLSEQVENRSTLRQKRENLTALYDENARKAPAWLTAQAALERLEQQSGETFEHSQDVMNFMQSQLVKERELTMQRDQLEQKRLQLDEQISRLSQPDGSEDPRLNMLAERFGGVLLSELYDDVTIEDAPYFSALYGPARHAIVVRDLNAVREQLAQLEDCPDDLYLIEGDPTAFDDSVLXAQERGPPRVEPAGQQSQGXX

SEQ ID NO: 1179 - DNA, 1173 bp, Haemophilus influenzae
  Name: NTH0651
atgaaattccctgaattgttgaaatcagtggagaaagtagacgataacacaattcgtattaccttaaacaagacagatgcgactttcttggctagtcttggtatggattttatttctatttattctgcagaatatgctgattcaatgctgaaagcgggtaaaccagaaacacttgatagtcgcccagtggggacaggcccttttgtttttgtggattataaaacagatcaagccatacaatatgttgcgcatgaaaattattggaaaggtagaacacctttagatcgtttagtcattagcattgtgcctgatgcaacaacacgttatgcaaaattacaggcgggtacttgcgatttaattttattcccaaatgtagcggatttagccaaaatgaaaaccgatccaaaagtacaacttttggaacaaaaaggtttgaacgtagcgtatatcgcattcaataccgaaaaagcaccgtttgataatgtcaaagtgcgccaagcgttgaattacgcagtggataaaaaagcgattattgaagcggtttatcaaggcgcaggaatatcagctaaaaacccacttcctccaacaatttggagttataatgatgaaatccaagattatccgtacgatccagaaaaagcaaaacaacttttagcagaagcgggttatccaaatggttttgaaactgatttctggattcaacctattattcgtgcttctaatccaaatccaaaacgtatggctgaattaattatggcggattgggcgaaaattggtgtaaaaactaacccagtgacttatgaatgggctgattatagaaaacgagcaaaagagggagaattaactgcgggtatctttggttggtctggcgacaatggcgatcctgataatttcttatccccattattaggtagctcaaatataggtaattctaatatggcacgtttcaataattcagaatttgatgctttactcaatgaggctattggattaaccaataaggaagaacgtgcgaaactttataaacaagctcaagttattgtccataatcaagcaccttggattccagttgcccactctgttggttttgcgccacttagtcctcgtgtaaaaggttatgtacaaagcccatttggctatgacgctttttatggtgtgagtgttgatggtaaa

SEQ ID NO: 1180 - protein, 391 aa, Haemophilus influenzae
  Name: NTH0651
MKFPELLKSVEKVDDNTIRITLNKTDATFLASLGMDFISIYSAEYADSMLKAGKPETLDSRPVGTGPFVFVDYKTDQAIQYVAHENYWKGRTPLDRLVISIVPDATTRYAKLQAGTCDLILFPNVADLAKMKTDPKVQLLEQKGLNVAYIAFNTEKAPFDNVKVRQALNYAVDKKAIIEAVYQGAGISAKNPLPPTIWSYNDEIQDYPYDPEKAKQLLAEAGYPNGFETDFWIQPIIRASNPNPKRMAELIMADWAKIGVKTNPVTYEWADYRKRAKEGELTAGIFGWSGDNGDPDNFLSPLLGSSNIGNSNMARFNNSEFDALLNEAIGLTNKEERAKLYKQAQVIVHNQAPWIPVAHSVGFAPLSPRVKGYVQSPFGYDAFYGVSVDGK

SEQ ID NO: 1181 - DNA, 234 bp, Haemophilus influenzae
  Name: NTH0652
atgaagaaacaagatcttatgagcatagacgagatccagatactagcagatccagatatgcaaaaagttaatcaaaatattcttgctcagcttaattcagatgtaccgctaataggacagttaggtttttatattgttcaaggtggtggtaagcggatccgcccgttgatcgcagttctcgcagcacgctctttaggtttggaagatctaattcattacttgtgctacttttgg

SEQ ID NO: 1182 - protein, 78 aa, Haemophilus influenzae
  Name: NTH0652
MKKQDLMSIDEIQILADPDMQKVNQNILAQLNSDVPLIGQLGFYIVQGGGKRIRPLIAVLAARSLGLEDLIHYLCYFW

SEQ ID NO: 1183 - DNA, 129 bp, Haemophilus influenzae
  Name: NTH0653
atgctcataagatcttgtttcttcatttttcatcatttatcagtcaaaagtgcggtgcattttacccgaattttcagactttctgaaatcaatccgcaaatgaagggaatttttttattttattataaa

SEQ ID NO: 1184 - protein, 43 aa, Haemophilus influenzae
  Name: NTH0653
MLIRSCFFIFHHLSVKSAVHFTRIFRLSEINPQMKGIFLFYYK

SEQ ID NO: 1185 - DNA, 309 bp, Haemophilus influenzae
  Name: NTH0654
atgtacgcagttttccaaagtggcggtaaacaacaccgtgtgagcgaaggtcaagttgttcgtttagaaaaacttgaacttgcaactggcgcaacagttgagttcgattctgtgttgatggtcgttaatggtgaagatgttaaaattggtgcaccagtagttgctggcgcaaaagtagtggctgaagtaattgcacaaggtcgtggcgagaaagttaaaatcgttaaattccgtcgtcgcaaacacagccgtaaacaacaaggtcatcgtcagtggttcacagaagtgaaaatcactgggattcaagca

SEQ ID NO: 1186 - protein, 103 aa, Haemophilus influenzae
  Name: NTH0654
MYAVFQSGGKQHRVSEGQVVRLEKLELATGATVEFDSVLMVVNGEDVKIGAPVVAGAKVVAEVIAQGRGEKVKIVKFRRRKHSRKQQGHRQWFTEVKITGIQA

SEQ ID NO: 1187 - DNA, 255 bp, Haemophilus influenzae
  Name: NTH0655
atggcaactaaaaaagctggtggttcaactcgtaacggtcgcgattctgaagctaaacgccttggtgttaaacgtttcggtggcgaatctgtattagcaggtagcattattgttcgccaacgtggtactaaattccacgcaggtaacaacgtaggaatgggaagagatcacaccttattcgcaactgcagatggcacagccccactcgaagtaaaaggcgagaaaagccgtatattcgtaagtattgttactgaa

SEQ ID NO: 1188 - protein, 85 aa, Haemophilus influenzae
  Name: NTH0655
MATKKAGGSTRNGRDSEAKRLGVKRFGGESVLAGSIIVRQRGTKFHAGNNVGMGRDHTLFATADGTAPLEVKGEKSRIFVSIVTE

SEQ ID NO: 1189 - DNA, 918 bp, Haemophilus influenzae
  Name: NTH0656
atgaaacaacaacctttattaggctttacctttgcgcttattaccgctatggcttgggggtcattgcctattgccttgaaacaagttttgtctgtaatgaatgcgcaaactatcgtatggtatcgtttcattattgctgcagtttcattattggctttacttgcttataaaaaacaattacctgaattaatgaaagttcgccaatatgcgtggattatgcttattggagtaattggtcttactggcaattttctattatttagtagctcgctgaattacattgaaccgtcagttgcacaaatttttattcatttatcctcttttggaatgctcatctgtggtgtactgattttcaaagaaaaattagggttgcaccaaaagatcgggcttttcttattgttaattggtctaagtttattctttaataatcgttttgctgtattttctggactaaatcagtattcaacaggtgtcattttaagtatagggggcgctcttatttgggtcgcttatggaatggcgcaaaaattaatgttacgtaaatttaattcacaacaaatcttgctaatgatgtatttaggttgtgccatagtctttatgccgatggctgaattctcgcaagtgcaagaactcacacctttagctctgatttgttttatttactgctgtttaaataccttaattggatacggctcttatgcggaggcacttaatcgttgggatgtatcaaaagtcagtgttgttatcacacttgtacctcttttcacgatcctattttcacatattgcccattattttagcccagtagattttgcagcaccagaattgaataatattagctatattggcgcatttgttgtagtatgcggggcaattttatccgcgattggacataaattattaccgcataaaaatcat

SEQ ID NO: 1190 - protein, 306 aa, Haemophilus influenzae
  Name: NTH0656
MKQQPLLGFTFALITAMAWGSLPIALKQVLSVMNAQTIVWYRFIIAAVSLLALLAYKKQLPELMKVRQYAWIMLIGVIGLTGNFLLFSSSLNYIEPSVAQIFIHLSSFGMLICGVLIFKEKLGLHQKIGLFLLLIGLSLFFNNRFAVFSGLNQYSTGVILSIGGALIWVAYGMAQKLMLRKFNSQQILLMMYLGCAIVFMPMAEFSQVQELTPLALICFIYCCLNTLIGYGSYAEALNRWDVSKVSVVITLVPLFTILFSHIAHYFSPVDFAAPELNNISYIGAFVVVCGAILSAIGHKLLPHKNH

SEQ ID NO: 1191 - DNA, 249 bp, Haemophilus influenzae
  n 154, 202: n is any nucleotide
  Name: NTH0657
atgaaatttattgatgaatcccttattcgaattgaggctggggatggtggtaacggttgcgtaagtttccgtcgagagaaatttattccgaaaggcggccctgatggtggcgacggtggcgatggtggcgatgtctatttacaagccgatgaanacctcaataccttaatcgattatcgctttaataaacgctttgccgcanagcgtggagagaatggacggagttcatattgtacaggacgtcgcggg

SEQ ID NO: 1192 - protein, 83 aa, Haemophilus influenzae
  Xaa 52, 68: Xaa is any amino acid
  Name: NTH0657
MKFIDESLIRIEAGDGGNGCVSFRREKFIPKGGPDGGDGGDGGDVYLQADEXLNTLIDYRFNKRFAAXRGENGRSSYCTGRRG

SEQ ID NO: 1193 - DNA, 225 bp, Haemophilus influenzae
  Name: NTH0658
atggcgaatttgccagatattttagtttatgctcgagtaggaaatggcatggtaagccgccgtcgtggcgtcaatcaagctaaagcagaaatggcgtttgttcaaattgaaataccgtttgggaattcagggtttgttatctggattatttacttttgcattgcgttttggttctcgtttattgccaacctcgttattgaaaaaactttatcaaacttttttacg

SEQ ID NO: 1194 - protein, 75 aa, Haemophilus influenzae
  Name: NTH0658
MANLPDILVYARVGNGMVSRRRGVNQAKAEMAFVQIEIPFGNSGFVIWIIYFCIAFWFSFIANLVIEKTLSNFFT

SEQ ID NO: 1195 - DNA, 165 bp, Haemophilus influenzae
  Name: NTH0659
gtggcgtcaatcaagctaaagcagaaatggcgtttgttcaaattgaaataccgtttgggaattcagggtttgttatctggattatttacttttgcattgcgttttggttctcgtttattgccaacctcgttattgaaaaaactttatcaaacttttttacgtaaa

SEQ ID NO: 1196 - protein, 55 aa, Haemophilus influenzae
  Name: NTH0659
VASIKLKQKWRLFKLKYRLGIQGLLSGLFTFALRFGSRLLPTSLLKKLYQTFLRK

SEQ ID NO: 1197 - DNA, 765 bp, Haemophilus influenzae
  Name: NTH0660
atgaaaaacaccgaaattttactcacgattaaacttcaacaagcactttttatcgatccaaaacgagttcgtttactcaaagaaattcaacaatgcggttcgattaatcaagcagcgaaaaatgcaaaagtgagctataaaagtgcgtgggatcatttagaagccatgaataaaatcagccctcgcccattgctggaacgaaatacaggtggaaaaaatggcggaggcacggtgcttaccacttatgccgagcgtttgctccagctttatgatttattagaacgtacgcaagaacacgcgtttcatattctacaagatgaatccgtaccgttagatagtttactcacggcaaccgcacgtttttctttacaaagtagcgcacgcaatcaattttttgggcgagtggcacaacaacgaatcattgactctcgttgcgttgtggatgtgaatgtgcaaggattaccaacgccgttgcaagtttctattaccacaaaaagctcggctcgtttgaaactgattacggaaaaagaagtgatgctgatgttcaaggcaccttgggtaaaaatcagtgaacaaccattagtaaatcaaccgaatcagttctctgtaaatatcaaatcactcaatgaagaggaagccatccttcaatttgctgaaagcaacattgaattttgtgccacggtccaccagccaaatcaatggcaaatcgggcaacaggtttggattcacattgatcaagagcaaattatattagcgacgctggga

SEQ ID NO: 1198 - protein, 255 aa, Haemophilus influenzae
  Name: NTH0660
MKNTEILLTIKLQQALFIDPKRVRLLKEIQQCGSINQAAKNAKVSYKSAWDHLEAMNKISPRPLLERNTGGKNGGGTVLTTYAERLLQLYDLLERTQEHAFHILQDESVPLDSLLTATARFSLQSSARNQFFGRVAQQRIIDSRCVVDVNVQGLPTPLQVSITTKSSARLKLITEKEVMLMFKAPWVKISEQPLVNQPNQFSVNIKSLNEEEAILQFAESNIEFCATVHQPNQWQIGQQVWIHIDQEQIILATLG

SEQ ID NO: 1199 - DNA, 102 bp, Haemophilus influenzae
  n 97, 98, 99, 100, 101: n is any nucleotide
  Name: NTH0661
atgaaaaaattaactaaaatttcaaccgcacttttaatcgcgggattaggctttttttttgcggcatccgctaaagtgactgtatttgcagccgctnnnnnt

SEQ ID NO: 1200 - protein, 34 aa, Haemophilus influenzae
  Xaa 33, 34: Xaa is any amino acid
  Name: NTH0661
MKKLTKISTALLIAGLGFFFAASAKVTVFAAAXX

SEQ ID NO: 1201 - DNA, 114 bp, Haemophilus influenzae
  n 105, 106, 107, 108, 109: n is any nucleotide
  Name: NTH0662
gtggctgtttattttgttgatgttggacttggtttgtcatctcgcccctccattaatctgggtcataatcattcattctgtcgtgcaattcacgctctgcgattnnnnnttaat

SEQ ID NO: 1202 - protein, 38 aa, Haemophilus influenzae
  Xaa 35, 36, 37: Xaa is any amino acid
  Name: NTH0662
VAVYFVDVGLGLSSRPSINLGHNHSFCRAIHALRXXXN

SEQ ID NO: 1203 - DNA, 846 bp, Haemophilus influenzae
  Name: NTH0663
gtgcaaaataagattaaggaacttgttggcaaaaatgcggcaacctttgcaacaagtgttatgcaaattgccaatagcaatgcaatgcttaaaacagcagacccaatgagcatttttaacgccgcttgtatggcagcgacattgaatttgccactacaaaatggcttaggctttgcctacatcgtccctttcagaaacaacaaggaaaagaaaaccgaagcgcaattccaaattggctataaaggctttatccaactggcacagcgtagtgggcaatttaaacgcttagtcgcattgcctgtgtacaaaaagcaacttatcaaaaaagatttcatcaatggttttgagttcgactgggagcaagagcctgaacaaaacgaaaatccaatcggctattacgcctattttaaactggtaaacgatttttcggctgaactctatatgagtcacgatgacatcgtcaaacacgctcaacgctacagccaaacattcaaaaaaggctatggcgtatggcacgataacttcgaggcaatggcattaaaaactgtaactaagttattgctatcaaaacaagctccactctctgttgaaatgcaacaagccgtattagccgaccaagccgttgtgaaagatgtagaaaatcaagagttcaactacaccgacaatattcaagaagcggaatttttagcggttgttgatgaagccacattcgaacaatgcaaacaaagcattgctaacggcgaaaccaccctacaagagctttgtgatagtggggcttatgaatttagccaagagcagattgcggagttggaggcgattgagaatggaaatgtaccaactcaaagc

SEQ ID NO: 1204 - protein, 282 aa, Haemophilus influenzae
  Name: NTH0663
VQNKIKELVGKNAATFATSVMQIANSNAMLKTADPMSIFNAACMAATLNLPLQNGLGFAYIVPFRNNKEKKTEAQFQIGYKGFIQLAQRSGQFKRLVALPVYKKQLIKKDFINGFEFDWEQEPEQNENPIGYYAYFKLVNDFSAELYMSHDDIVKHAQRYSQTFKKGYGVWHDNFEAMALKTVTKLLLSKQAPLSVEMQQAVLADQAVVKDVENQEFNYTDNIQEAEFLAVVDEATFEQCKQSIANGETTLQELCDSGAYEFSQEQIAELEAIENGNVPTQS

SEQ ID NO: 1205 - DNA, 693 bp, Haemophilus influenzae
  Name: NTH0664
atgaatttagccaagagcagattgcggagttggaggcgattgagaatggaaatgtaccaactcaaagctaaatgctctggcttggctgatttaatggtaaagcctaaaagcggtaatggaatatctgctacagcaaaaagtgcggtgagaaagatagtgaaatttgatttattcggttatcgagattttgaggggaataaatacaccgagaaaggcattgcactagaagaacaagccattaagttaagcggtcgtaaacgtggattacctcttaaaaagaacacggaaagacgtgaaaacgattggattacaggcgagtgcgatatttatgtgccaagccgaaaattaatcatagatactaaatgttcttgggatattggctcacaccctttttttgctgatgaggcggaagaaaaagccaaaaaagcggggtatgacgcacaaatgcaaggctatatgtggctatgggattgtagtgaggcgcaaattgattttgtcctcctccccaccccttacgaccaattatcaagctatgatgacccaagtcgatacattgacttagttgagcaaatcccccaagaaaaacgtatcaccaccgtcacaattaaacgtgatgagaaagtcatcgagaaaatcaaagaacgagtagaaattgctcaagaatattatcaacaacttatacaggagatgcgc

SEQ ID NO: 1206 - protein, 231 aa, Haemophilus influenzae
  Name: NTH0664
MNLAKSRLRSWRRLRMEMYQLKAKCSGLADLMVKPKSGNGISATAKSAVRKIVKFDLFGYRDFEGNKYTEKGIALEEQAIKLSGRKRGLPLKKNTERRENDWITGECDIYVPSRKLIIDTKCSWDIGSHPFFADEAEEKAKKAGYDAQMQGYMWLWDCSEAQIDFVLLPTPYDQLSSYDDPSRYIDLVEQIPQEKRITTVTIKRDEKVIEKIKERVEIAQEYYQQLIQEMR

SEQ ID NO: 1207 - DNA, 432 bp, Haemophilus influenzae
  Name: NTH0665
atggcacgtaataccaacaccgtgatattagtcggtcatttaggcagtgacccagaaatccgccaattccaaaatggtgggcaaattgccacatttaatctcgctatcggtgatgattaccgagataaacaaggtaatacagttaaacgtacgcattggatacctattgtggtgcatggcaattctgctgatgtagcaagacaatatctgcaaaaaggctcaaaaatctgtgtaacagggaaactggtacaggaaagctggcaagaccaaaacggcaataaccgcaccgcacttaaagtagcgacacaatcctttgaaatgctagacagcaaggcaaacaatgaaacacaacagccaagcaaagacaaagaaaaacccgacccattaagcgcagcggcagaacaagatgggtttgatgatgatattccgttt

SEQ ID NO: 1208 - protein, 144 aa, Haemophilus influenzae
  Name: NTH0665
MARNTNTVILVGHLGSDPEIRQFQNGGQIATFNLAIGDDYRDKQGNTVKRTHWIPIVVHGNSADVARQYLQKGSKICVTGKLVQESWQDQNGNNRTALKVATQSFEMLDSKANNETQQPSKDKEKPDPLSAAAEQDGFDDDIPF

SEQ ID NO: 1209 - DNA, 276 bp, Haemophilus influenzae
  Name: NTH0667
atggctgaagaaaacaaagaaattatagcttataaagggtttaagcaagactggacttgtcgaggttatcagtatgaggtaggcaaaacgtatgagcataaaggtaatgttaaggcttgtgagagtggattccacgcctgcgaatacccgcttgatgtgcttagctattacagtccagcggtaagtaaatttgctgtagttaaaatgagcggcgaaacatcaaaagatagtgatgatacaaaattgcatctgcaaaatcacgatcgaaaccgaaat

SEQ ID NO: 1210 - protein, 92 aa, Haemophilus influenzae
  Name: NTH0667
MAEENKEIIAYKGFKQDWTCRGYQYEVGKTYEHKGNVKACESGFHACEYPLDVLSYYSPAVSKFAVVKMSGETSKDSDDTKLHLQNHDRNRN

SEQ ID NO: 1211 - DNA, 96 bp, Haemophilus influenzae
  Name: NTH0668
ttgctccgcccaatcgcccttaatgaaacctgggctgcatcacattcacttttacttttatccattcaacggctttttttatcatttccggtaagt

SEQ ID NO: 1212 - protein, 32 aa, Haemophilus influenzae
  Name: NTH0668
LLRPIALNETWAASHSLLLLSIQRLFLSFPVS

SEQ ID NO: 1213 - DNA, 360 bp, Haemophilus influenzae
  Name: NTH0669
gtgataaaatgcttacctcgtttatttatagggaacattatggaaaccttagacaaaatcaaaaagcaaattagtgaaaatcccattcttatttatatgaaaggttcgccaaaattaccatcttgtggtttttctgctcgtgcatctgaggcattaatgcactgcaaagtgccttttggttatgtggatattttgcaacatccagatattcgcgctgaattaccaacatatgcaaattggccaactttcccacaattatgggttgagggagaattaattggtggttgtgatattattttagaaatgtatcaagcaggcgaattgcaaactttattagctgaagtggcagcaaagcacgct

SEQ ID NO: 1214 - protein, 120 aa, Haemophilus influenzae
  Name: NTH0669
VIKCLPRLFIGNIMETLDKIKKQISENPILIYMKGSPKLPSCGFSARASEALMHCKVPFGYVDILQHPDIRAELPTYANWPTFPQLWVEGELIGGCDIILEMYQAGELQTLLAEVAAKHA

SEQ ID NO: 1215 - DNA, 1098 bp, Haemophilus influenzae
  n 553: n is any nucleotide
  Name: NTH0670
atgcagtacattaacattgccaatcgtggcgtaaaatccttatcaccttaccaagctggtaaaccgattgaagaattagaacgagaaattggtatttccaatatcgttaaacttgcctcaaacgaaaacccatttggttttccagaaagtgcaaaaaaagcaattttcgaacaattagataaactgactcgttatccagatgcgaatggctttgaactaaaacaaactatcgcaaaaaaatttggcgttcaaccaaatcaaattacactcggtaatggctcaaatgatttattagaactttttgctcacactttcgcaacggaaggcgatgaaatcatttattcacaatatgcttttattgtttatcctttagtgactaaagcgataaatgcaattgcaaaagaaattccagctaaaaattggggacacgatttacaaggatttttaaccgcactttctgataaaacaaagctcatttacattgctaatcccaataatccaacgggtaattttttaacatcacaagaaattgaagattttttagcaaaagtcnccgaaaatgtaatcgtggtattagatgaagcctacacagaatttactagatctgaagaacgagtggactctttcagtttattaaaaaaatattcaaatttaattatttcacgcactctttctaaagcctatggcttggcaggcttacgcattggttatgcggtatctaatccagaaatcgcagatttattaaatcgagttagacagccatttaactgtaattctttggcattaaccgctgcagttgccgtaatgaatgacgatgaatttattgaaaaagtcgctgaaaataatcgaatagaaatgcgacgttatgaagacttttgtcaaaaaaatcaattggattatattccctctaaaggaaattttataaccattgatttcaaacaacctgccgcaccaatttatgatgcgttgttacgagaaggcgtaatcgttcgcccaattgctggttatggcatgccaaatcatttacgtataagtattggtttacctgaagaaaacgataaatttttcaccgcactttctaaggtattaaagtttgct

SEQ ID NO: 1216 - protein, 366 aa, Haemophilus influenzae
  Xaa 185: Xaa is any amino acid
  Name: NTH0670
MQYINIANRGVKSLSPYQAGKPIEELEREIGISNIVKLASNENPFGFPESAKKAIFEQLDKLTRYPDANGFELKQTIAKKFGVQPNQITLGNGSNDLLELFAHTFATEGDEIIYSQYAFIVYPLVTKAINAIAKEIPAKNWGHDLQGFLTALSDKTKLIYIANPNNPTGNFLTSQEIEDFLAKVXENVIVVLDEAYTEFTRSEERVDSFSLLKKYSNLIISRTLSKAYGLAGLRIGYAVSNPEIADLLNRVRQPFNCNSLALTAAVAVMNDDEFIEKVAENNRIEMRRYEDFCQKNQLDYIPSKGNFITIDFKQPAAPIYDALLREGVIVRPIAGYGMPNHLRISIGLPEENDKFFTALSKVLKFA

SEQ ID NO: 1217 - DNA, 93 bp, Haemophilus influenzae
  n 71: n is any nucleotide
  Name: NTH0671
atgcgcgcatctatttataatgcaatgtcgcaaaatggtgttgaggcactcatttcatttatgaaaaaatntgaagctgaaaatcttcctcaa

SEQ ID NO: 1218 - protein, 31 aa, Haemophilus influenzae
  Xaa 24: Xaa is any amino acid
  Name: NTH0671
MRASIYNAMSQNGVEALISFMKKXEAENLPQ

SEQ ID NO: 1219 - DNA, 93 bp, Haemophilus influenzae
  n 29: n is any nucleotide
  Name: NTH0672
atgaatgtcactttcatcacaggtaatcntgaattagatgcaaaatttgtcgcagaatctactgctacgggtttgcaagccttgaaagggtca

SEQ ID NO: 1220 - protein, 31 aa, Haemophilus influenzae
  Xaa 10: Xaa is any amino acid
  Name: NTH0672
MNVTFITGNXELDAKFVAESTATGLQALKGS

SEQ ID NO: 1221 - DNA, 150 bp, Haemophilus influenzae
  n 91, 121, 137, 138, 139, 140, 141: n is any nucleotide
  Name: NTH0673
atgcgcgcattccaccctaaaccttatgaccctttcaaggcttgcaaacccgtagcagtagattctgcgacaaattttgcatctaattcangattacctgtgatgaaagtgacattcatgntgaacgtttttctttnnnnnttaattaat

SEQ ID NO: 1222 - protein, 50 aa, Haemophilus influenzae
  Xaa 31, 41, 46, 47: Xaa is any amino acid
  Name: NTH0673
MRAFHPKPYDPFKACKPVAVDSATNFASNSXLPVMKVTFMXNVFLXXLIN

SEQ ID NO: 1223 - DNA, 420 bp, Haemophilus influenzae
  Name: NTH0674
gtgaaagcaggtgttgaagctggtcgcggtttatgggaatttcgtactgaaggtgaagaattcactttaggtcaagaaatcaatgtagacatcttcgcagatgttaaaaaagtagatgttactggtacttctaaaggtaaaggtttccaaggtggtgttaaacgttggaacttccgtactcaagatgctacacacggtaactctttatcacatcgtgtacttggttctattggtcaaaaccaaacaccaggtcgtgtgtttaaaggtaaaaaaatggcaggacatttaggtgctgaacgtgtaactgttcaatcacttgaagttgttcgtgtagatgctgagcgtaaattgctattagtaaaaggttctgtacctggtgctatcaatggcgatgttatcgttaagccggcagttaaagca

SEQ ID NO: 1224 - protein, 140 aa, Haemophilus influenzae
  Name: NTH0674
VKAGVEAGRGLWEFRTEGEEFTLGQEINVDIFADVKKVDVTGTSKGKGFQGGVKRWNFRTQDATHGNSLSHRVLGSIGQNQTPGRVFKGKKMAGHLGAERVTVQSLEVVRVDAERKLLLVKGSVPGAINGDVIVKPAVKA

SEQ ID NO: 1225 - DNA, 600 bp, Haemophilus influenzae
  Name: NTH0675
atggaattacaagttgtaggtgcaaacgcactcactgtttctgaaactaccttcggacgtgagtttaacgaagcgttgatccaccaagttgttgttgcttatgcagcaggtgcgcgtcaaggtactcgtgcgcaaaaaactcgtgctgaagtgtctggttcgggtaaaaaaccttggcgtcaaaaaggtacaggtcgtgctcgtgctggtgatattaaatcaccaatctggcgttctggtggtacaaccttcgcggctaaaccacaagatcacagccaaaaagtgaacaagaaaatgtaccgtggtgctatcaaaagcattctttctgaattagttcgtcaagaccgtttggttgtggtggaaaaatttgaattagatgcaccaaaaactaaagttttagtacaaaaattaaaagatttagccgttgaagatgcgttaattatcacagcaagtttagatgaaaatctattcttagccgcacgtaacttatataaagttgatgtacgtgatgttcaaggtatcgatccatttttcttaatcgctttcgataaagtgattgttactgttgatgctgtgaaacaaattgaggagatcctagca

SEQ ID NO: 1226 - protein, 200 aa, Haemophilus influenzae
  Name: NTH0675
MELQVVGANALTVSETTFGREFNEALIHQVVVAYAAGARQGTRAQKTRAEVSGSGKKPWRQKGTGRARAGDIKSPIWRSGGTTFAAKPQDHSQKVNKKMYRGAIKSILSELVRQDRLVVVEKFELDAPKTKVLVQKLKDLAVEDALIITASLDENLFLAARNLYKVDVRDVQGIDPFFLIAFDKVIVTVDAVKQIEEILA

SEQ ID NO: 1227 - DNA, 417 bp, Haemophilus influenzae
  n 328: n is any nucleotide
  Name: NTH0676
atgagtcaagaacgtttgctaagtgtgctacgtgcaccgcacatctctgaaaaagcaactaacaatgctgaaaaatctagcactgttgtacttatagttgctttagatgcgaccaaagctgaaattgctgctgcggctgctcaattatttgaagtaaaagtagattcagtccgtactgaggttgttaaagggaaaactaaacgccgcggaaacaaattgggtcgccgcaccgactgggaaaaagcttatgtaactttagccgaaggccaaaacttggacttcgtggacagtgcacagtcatcggaggagattagagaatggctatcgntaaatggaagccgacctccgctggtcgccgtcacgttgttaaaatcgggaacccctgtttacacaggggttaaccttacgcacctctgc

SEQ ID NO: 1228 - protein, 139 aa, Haemophilus influenzae
  Xaa 110: Xaa is any amino acid
  Name: NTH0676
MSQERLLSVLRAPHISEKATNNAEKSSTVVLIVALDATKAEIAAAAAQLFEVKVDSVRTEVVKGKTKRRGNKLGRRTDWEKAYVTLAEGQNLDFVDSAQSSEEIREWLSXNGSRPPLVAVTLLKSGTPVYTGVNLTHLC

SEQ ID NO: 1229 - DNA, 102 bp, Haemophilus influenzae
  Name: NTH0677
atggtcgtattactactcggcacattgggggcgggtcccaacagcactcccgtttatatgattcagaccgtacaagtacgcattccagcggtgggtgggcgg

SEQ ID NO: 1230 - protein, 34 aa, Haemophilus influenzae
  Name: NTH0677
MVVLLLGTLGAGPNSTPVYMIQTVQVRIPAVGGR

SEQ ID NO: 1231 - DNA, 1218 bp, Haemophilus influenzae
  n 1213, 1214, 1215, 1216, 1217: n is any nucleotide
  Name: NTH0678
atgaagcatggtggaatttctgagcgaatcattaattttgcaacaagtatggttggtcatattaaaggtggtttaggttatgttgcgatcatttctgggttgatatttgcagggttatctggttctgcggtagcggatacggccgcgttaggtgcaatactaattcctatgatgatttctaaaaaatatgatggtgctcgttccacaggattaatttgtgctgcaggtattatttcagttgttattcctccaagcattcctatgatcatttacggtattactgctggagcatccatcactaaattatttatggggggaactgtaccaggcttattaatggtcgttggattatgggttacttggaaaattttgtatagaaataatgatacaagtctagaaagaaaacaaactggcaaagaaagatgggttgcttttaaaaaagcattttggcctttattattacctatcattattattgtgggattaagaggagggatttttactccaacagaagcgggagttgttgctgcaatttatgctggcatagtaagtattgcttataaaggcttaacattttctaaattaaaagacgtcttcattggcaccatcaaaacaacatcaatggtaatgtttgttgctgcatcagcaatgatatctgcttttgcgattacagttgctcaaattccaacagaattagtccaaacgattaaaggattaactgatagtccgacaattttaatgtttattataatgctatttttattacttgttggatgtgtaatggatttaattcctgcggtattaatttttgttccagtcttattaccagtgttaagagcatataatattgatattgcgtattttggaatcatgatggtgattaatttatctataggattaataacaccgcctgtgggaacagttttgtatgtaggctcagggatatcaaaattagggataggagcattatccaaaggaattgctccattcttatttgtgtacgcaattattatgatgttgatcggattttttcctggaattggaaattgttccaatggattggttatcttgattattaagggaagttgcctcatgaaaaaattaccttttatcgggagtgtatggagggacttcgtgggaaccccttgtcggcaatgtggccaaattttggtgggggatacctctaattcgtcgatttatgttaggcgaggcnnnnnt

SEQ ID NO: 1232 - protein, 406 aa, Haemophilus influenzae
  Xaa 405, 406: Xaa is any amino acid
  Name: NTH0678
MKHGGISERIINFATSMVGHIKGGLGYVAIISGLIFAGLSGSAVADTAALGAILIPMMISKKYDGARSTGLICAAGIISVVIPPSIPMIIYGITAGASITKLFMGGTVPGLLMVVGLWVTWKILYRNNDTSLERKQTGKERWVAFKKAFWPLLLPIIIIVGLRGGIFTPTEAGVVAAIYAGIVSIAYKGLTFSKLKDVFIGTIKTTSMVMFVAASAMISAFAITVAQIPTELVQTIKGLTDSPTILMFIIMLFLLLVGCVMDLIPAVLIFVPVLLPVLRAYNIDIAYFGIMMVINLSIGLITPPVGTVLYVGSGISKLGIGALSKGIAPFLFVYAIIMMLIGFFPGIGNCSNGLVILIIKGSCLMKKLPFIGSVWRDFVGTPCRQCGQILVGDTSNSSIYVRRGXX

SEQ ID NO: 1233 - DNA, 153 bp, Haemophilus influenzae
  Name: NTH0679
ttgcaagagcttactaacgtaataatgaaaagttacccgaagattacaaaagatcgaattgttggacattgcgatatttcgccaggacgtaagatcgatcctggtcaatattttgattgggaacgttatttatccagtgtaaaacaaactgta

SEQ ID NO: 1234 - protein, 51 aa, Haemophilus influenzae
  Name: NTH0679
LQELTNVIMKSYPKITKDRIVGHCDISPGRKIDPGQYFDWERYLSSVKQTV

SEQ ID NO: 1235 - DNA, 117 bp, Haemophilus influenzae
  Name: NTH0680
atgataaaaagatcttttgtgaataaaactgttttaaaaattgtatttttttaccgcactttcttccattttgaatgtgaaaagtgcggtttatttttgtttaagatcttttggttg

SEQ ID NO: 1236 - protein, 39 aa, Haemophilus influenzae
  Name: NTH0680
MIKRSFVNKTVLKIVFFYRTFFHFECEKCGLFLFKIFWL

SEQ ID NO: 1237 - DNA, 117 bp, Haemophilus influenzae
  Name: NTH0681
gtgtttgatgtcttattgacggcgaaaaagtatcatattttaaaaaaaagagcaaaaagcgaaaagaggaaaatcaataaaaataactgcacattgggtttgaacctaaagtgcggt

SEQ ID NO: 1238 - protein, 39 aa, Haemophilus influenzae
  Name: NTH0681
VFDVLLTAKKYHILKKRAKSEKRKINKNNCTLGLNLKCG

SEQ ID NO: 1239 - DNA, 288 bp, Haemophilus influenzae
  Name: NTH0682
atgaacgacgaacagcaaaattcaaaccaacctgaaaatacgaaaaaaccttttttccaatctttattcggtcgcttttttcaaggcgaattaaaaaatcgtgaagaacttgtggaagtgattcgcgattcagaacaaaacgatctaattgatcaaaatacgcgtgaaatgattgaaggcgtgatggaaattgcggaacttcgtgttcgtgatattatgattcctcgttcacaaattatttttattggaagatcaacaagatttaaatacttgtttaaacacaattat

SEQ ID NO: 1240 - protein, 96 aa, Haemophilus influenzae
  Name: NTH0682
MNDEQQNSNQPENTKKPFFQSLFGRFFQGELKNREELVEVIRDSEQNDLIDQNTREMIEGVMEIAELRVRDIMIPRSQIIFIGRSTRFKYLFKHNY

SEQ ID NO: 1241 - DNA, 132 bp, Haemophilus influenzae
  n 127, 128, 129, 130, 131: n is any nucleotide
  Name: NTH0683
gtgattgccgatgccgatgaccgcgataataatcgtgggcattttgcacgcaaaagattattaaatttttacgtgaagatgccgaagcatttgattaatcttcttattgccccccgccggattggannnnnt

SEQ ID NO: 1242 - protein, 44 aa, Haemophilus influenzae
  Xaa 43, 44: Xaa is any amino acid
  Name: NTH0683
VIADADDRDNNRGHFARKRLLNFYVKMPKHLINLLIAPRRIGXX

SEQ ID NO: 1243 - DNA, 624 bp, Haemophilus influenzae
  Name: NTH0684
gtgttgttacttgatgagtctttatctgcaatggattacaaattgcgtaaacaaatgcaacaagaactcaaaatgttacaacgtcagcttggcattacctttatttttgtcacccacgatcaagaagaagcgattacaatgtctgatcgtattgtattattgcgtaaaggtaaaatcgcacaggatggttctccacgtgaaatctatgaagatccagctaacttattcgttgctcgtttcattggcgaaattaacgtatttgaagccactgtgattgaacgaaaatcagaacaagttgtactggcaaatgttgaaggtcgtatttgtgatatttatacggatatgcctgtggaaaaagatcaaaaacttcaagtactccttcgccctgaagatattgtgattgaagaattagatgaaaatgaacattctaaagcaattatcggtcatattattgaccgcacttataaaggaatgacattagaatcaacggtagagtttgatcataacggaatgcgtgtccttgtaagtgaattctttaatgaagatgatccacatatggatcatagcataggacaacgcgtaggtatcacatggcacgaaggctggggaggttgtactcaacga

SEQ ID NO: 1244 - protein, 208 aa, Haemophilus influenzae
  Name: NTH0684
VLLLDESLSAMDYKLRKQMQQELKMLQRQLGITFIFVTHDQEEAITMSDRIVLLRKGKIAQDGSPREIYEDPANLFVARFIGEINVFEATVIERKSEQVVLANVEGRICDIYTDMPVEKDQKLQVLLRPEDIVIEELDENEHSKAIIGHIIDRTYKGMTLESTVEFDHNGMRVLVSEFFNEDDPHMDHSIGQRVGITWHEGWGGCTQR

SEQ ID NO: 1245 - DNA, 156 bp, Haemophilus influenzae
  Name: NTH0685
ttgcctactcgagaaattgatgaacgctttcttgctgccttagaagcgggtatgccagatgcttcaggtgtcgcattaggaatagatcgtttaatgatgatcgctttagattgtgaaaaaattaatgacgtcatttcttttgctgtggacaatgct

SEQ ID NO: 1246 - protein, 52 aa, Haemophilus influenzae
  Name: NTH0685
LPTREIDERFLAALEAGMPDASGVALGIDRLMMIALDCEKINDVISFAVDNA

SEQ ID NO: 1247 - DNA, 681 bp, Haemophilus influenzae
  Name: NTH0686
atgtcaaaactcttactcgttgatgatgatattgaattaactgaactactttctacacttttagaacttgagggttttgacgttgaaactgcaaataatggattagaagcattacaaaaactcaatgaaagctataaactggttttacttgatgtaatgatgccaaagttaaatggtatcgaaacattaaaagaaattcgtaaagtctctaacgtgccagtgatgatgctaacagcaagaggcgaagacattgatcgcgtattaggcttagaattgggagcggatgattgtttacccaagccttttaacgatcgtgagcttattgcaagaattaaggcgattttgcgtcgtagtgtatctccttcaaataataccgcaaatgtagaaatcctttcttttgacggaattactctccacttttctcacggaattgcaacctataatgaagaaaatctaaatttaacggattatgaatttaagattctttgtttattgcttaaatctaagggaaatgtggtaagtcgagaagaattaagtttagaagtgatggaaaaaccactcactccatttgaccgttctcttgatatgcacatctctaatttaagacgcaaattaccagaacgaaaaaacaagccctcttggtttaaaactttacgcggaaaaggatacgctttagtcacc

SEQ ID NO: 1248 - protein, 227 aa, Haemophilus influenzae
  Name: NTH0686
MSKLLLVDDDIELTELLSTLLELEGFDVETANNGLEALQKLNESYKLVLLDVMMPKLNGIETLKEIRKVSNVPVMMLTARGEDIDRVLGLELGADDCLPKPFNDRELIARIKAILRRSVSPSNNTANVEILSFDGITLHFSHGIATYNEENLNLTDYEFKILCLLLKSKGNVVSREELSLEVMEKPLTPFDRSLDMHISNLRRKLPERKNKPSWFKTLRGKGYALVT

SEQ ID NO: 1249 - DNA, 126 bp, Haemophilus influenzae
  Name: NTH0687
ttgaaaacctttaccacaggtttcacaacaagggcgaaaataacaccattattgaaacaggtgagaaaccaaaatcaagctggtggaaattctggaaataatctttttattttcaccgcactacaa

SEQ ID NO: 1250 - protein, 42 aa, Haemophilus influenzae
  Name: NTH0687
LKTFTTGFTTRAKITPLLKQVRNQNQAGGNSGNNLFIFTALQ

SEQ ID NO: 1251 - DNA, 768 bp, Haemophilus influenzae
  Name: NTH0688
gtgttagcgcgagtattagcaaaactttctcaaaatcaaccgcactttgctctctctgatattcgtggtggctcaattcgtaatgcaattcctcgagaagcagcagctgtgttagcctttaatggcgatgtaaaaaccatagaaagtgcggtagaaaatctcgcggttgtgcttaaagaagaattagcaattgcagaacctaatttcacactttttgtagaatccgcagaaaaagcccctaccgtattcaccgcacaaagcactcaaacggttattaacgcactcaacgtattaccaaatggcgtaatccgcaatagtgatgtagttaaaaatgttgtagaaagttcattaagcgttggcgtattgaaaacagaaggtaatgttgtaaaaagcactattttagttcgttcattaattgaaagcggtaaatattacgtaactgaaatgctcagctcacttgcaatcttagcaaatgcaaaagtcgagttttctgcaccttatccgggctggcaacctgtaaatgactcaactatcttagacgttactcgcaaacattatgctgaagtgctaggcgagcaacctgtagtgaaagtcattcacgcaggattagaatgtggtcttttaaaagaacattatccaaacattgaaatgatttctgttgggccaacaatccgaaatgctcactcaccagatgaaaaagtggaaatcgcaacagtacaaacctattgggatttattgacaagagtacttgccgatattcctgcgaag

SEQ ID NO: 1252 - protein, 256 aa, Haemophilus influenzae
  Name: NTH0688
VLARVLAKLSQNQPHFALSDIRGGSIRNAIPREAAAVLAFNGDVKTIESAVENLAVVLKEELAIAEPNFTLFVESAEKAPTVFTAQSTQTVINALNVLPNGVIRNSDVVKNVVESSLSVGVLKTEGNVVKSTILVRSLIESGKYYVTEMLSSLAILANAKVEFSAPYPGWQPVNDSTILDVTRKHYAEVLGEQPVVKVIHAGLECGLLKEHYPNIEMISVGPTIRNAHSPDEKVEIATVQTYWDLLTRVLADIPAK

SEQ ID NO: 1253 - DNA, 555 bp, Haemophilus influenzae
  Name: NTH0689
atggatggcgagcaaattcaacaattgcttgccaacgatagcaaagaacctattgatattcgtgatcgtgctattttggaattaatgtatagttcaggtttgcgtttatctgaattacaaggcttagatttaaacagcattaatacccgtgtgcgggaagtacgcgttattggaaaaggtaacaaagaacgagttgtgccgtttggacgttatgcttcgcatgctattcaagaatggttaaaagtgcgggcattatttaacccaaaagatgaggcattatttgttagccagcttggaaatcgtatttctcatcgagccattcaaaaacgtttagaaacttggggtattcgtcaaggcttaaatagccatcttaatccgcacaaattacgtcattcttttgcgacgcatatgttggaagccagttctgatttacgcgccgtgcaagaattgcttgggcatagcaacctttccaccacacaaatttatactcacttaaatttccaacatctagcagaagtgtacgatcaggcgcacccaagagcgaaacgaaaaaaa

SEQ ID NO: 1254 - protein, 185 aa, Haemophilus influenzae
  Name: NTH0689
MDGEQIQQLLANDSKEPIDIRDRAILELMYSSGLRLSELQGLDLNSINTRVREVRVIGKGNKERVVPFGRYASHAIQEWLKVRALFNPKDEALFVSQLGNRISHRAIQKRLETWGIRQGLNSHLNPHKLRHSFATHMLEASSDLRAVQELLGHSNLSTTQIYTHLNFQHLAEVYDQAHPRAKRKK

SEQ ID NO: 1255 - DNA, 540 bp, Haemophilus influenzae
  Name: NTH0690
atgagctattccttcacattctatccggggtcagaaacgtggaacttgaaaaaacttgctggcgtatcttattcgccgttaatggaaggcgaatacttagcttgctcgaagaaaaacgcaacgacatttgagaaatttaacgatagctttgcggtaacgcaaggcggcaaagtcgcagctggggaatggatcgatattatccgtttccgtgattggttggtgcaggaagtgcaaattaatgtgacatccgtcttaatcaatgcttacggtaaagtgccttacaccgataaaggtattcaattaattggtgcagcagtgcgtcaggcgttagatttaggtgtagcacgtggcggtattgcgccgacagaattggatgataataacaaggaaattccaagttatgtgatttcccttccactggcggcaaaggtatcgaataacaataaaggtaagcgtttattgcaagatgtgaaatttacggcacgtttagccggtgctattcacttgacagaaatcaagggcaatctggcttacagtctt

SEQ ID NO: 1256 - protein, 180 aa, Haemophilus influenzae
  Name: NTH0690
MSYSFTFYPGSETWNLKKLAGVSYSPLMEGEYLACSKKNATTFEKFNDSFAVTQGGKVAAGEWIDIIRFRDWLVQEVQINVTSVLINAYGKVPYTDKGIQLIGAAVRQALDLGVARGGIAPTELDDNNKEIPSYVISLPLAAKVSNNNKGKRLLQDVKFTARLAGAIHLTEIKGNLAYSL

SEQ ID NO: 1257 - DNA, 330 bp, Haemophilus influenzae
  Name: NTH0691
atggctttagcaacttatgcgcccgatgaagtaagcattgtgatcggggcgagtattgtttctggctttgcagatggaacctttattgatattgaagaaatgtctgacggcgtatcatctgttgctggtgcagatggcgaagtagcacgtgcaaccagtgccgatccacgtaaaaaagtcacattaacgttattacaaaccagtgataccaatgatgtgttaagtgaactctatgcagcggataaagtgagtaaaaacgcaacctttccaattgcggtaaaagacttgcgtggtcgctcattattcgctgcaagcacggcgtggggtggt

SEQ ID NO: 1258 - protein, 110 aa, Haemophilus influenzae
  Name: NTH0691
MALATYAPDEVSIVIGASIVSGFADGTFIDIEEMSDGVSSVAGADGEVARATSADPRKKVTLTLLQTSDTNDVLSELYAADKVSKNATFPIAVKDLRGRSLFAASTAWGG

SEQ ID NO: 1259 - DNA, 99 bp, Haemophilus influenzae
  Name: NTH0692
gtggttaaatcggcgaaacttgagcttggaaaagaagtgggttctcgcgagtggacgcttgaaactgcggacggtaaattatttgtagggggaaatgac

SEQ ID NO: 1260 - protein, 33 aa, Haemophilus influenzae
  Name: NTH0692
VVKSAKLELGKEVGSREWTLETADGKLFVGGND

SEQ ID NO: 1261 - DNA, 480 bp, Haemophilus influenzae
  Name: NTH0694
atggcacgcagtgaaattcaaattggcgaaagcactttttttgtgcaaaagttttcggtaatggatcagttacgcatttttggcgatttgcagaaaacccttgtaccgtcactggcgaaagtaatcggatttagcgatgaaaaaccgaaagatgcaacgtcagctcagttagccgaattagcacagaaaagtgcggcgaattttgcgcaaggtttacaagatttaagccagcaattaagcggccaagagttagttaaactagctgatatgctaatcaaacctgaactagtgacggtgcagcgtgatgatttcaacaatgggacagataaaaaacttagcaaaactgattttgatttggtgtttgatgatatgtcggagcttatcgagttggtaattttcatcttacaacttaatttcagcagtttttttacgaaatttcttgcccgtcttgggtcggtgcaagagcttgtgaagaaagcg

SEQ ID NO: 1262 - protein, 160 aa, Haemophilus influenzae
  Name: NTH0694
MARSEIQIGESTFFVQKFSVMDQLRIFGDLQKTLVPSLAKVIGFSDEKPKDATSAQLAELAQKSAANFAQGLQDLSQQLSGQELVKLADMLIKPELVTVQRDDFNNGTDKKLSKTDFDLVFDDMSELIELVIFILQLNFSSFFTKFLARLGSVQELVKKA

SEQ ID NO: 1263 - DNA, 150 bp, Haemophilus influenzae
  Name: NTH0695
atgatcgcttggcgtccttttttagccggtaaagttacactaacagagcttaatacggcaggattgacggatatgggcgagcttttgaagattaatcgcttactagatgcggtagatgcgatggaagcaaaacaaatggagaaaaaccga

SEQ ID NO: 1264 - protein, 50 aa, Haemophilus influenzae
  Name: NTH0695
MIAWRPFLAGKVTLTELNTAGLTDMGELLKINRLLDAVDAMEAKQMEKNR

SEQ ID NO: 1265 - DNA, 1470 bp, Haemophilus influenzae
  n 1449, 1453, 1457, 1458, 1459, 1460, 1461: n is any nucleotide
  Name: NTH0696
atgaatgctatacgtgagctggtaacgttattgcgttataaagtcgataattccggtttaaaggcttatgttgttcaaactcaacaggcggcaaaaggcattcgtagcaacctgaataatgcagtcgatggattacgcgctaaattctcagaggctgccgtgagcgcgaaaggcgtcggtaataatctgaaagacgctaaaaatcaaatactttctctacgtaactttgttgctggttattttgcgatgattgcaggcggcaatgtgattaagattgcggacgattgggctgcggtggatagtcgtgtgaaattagcgacaaaatccgctgaagaacataaatatgcattgagtcagattttcgatctttcgcaacgttccggacaagactatctcgccagtgcggatttattctcaaaagtgaatcgaagtgcgggtgatttggggttaagtcttgatgatacgttaaatttaacggaaatcattgggcaaacgatgactattggcggcggcgatcagggggcgcagcaagccgccttgatgcagcttggtcaagccttaggctcgggtgcattacgtggcgatgagctgaactcaattattgaacaagccccacgtttagcgaatgccattgctgatagttttggcgtgccgattgggcaattaaaagatctaggtaaagaaggtaagctcacatcaaaagaactcgcacaaggtctgctaaaacaagcggataaaatccaaaaagaatttgatcagatgccgaaaacttttgggcgcggtatgacgattctgaaaaataaagccggtcaattgattgatgtggcggtcaataaagtctctaaactcggcgcggctttctataatgctgctgaatgggtgacagaaaacattcgtttagtgggctttttagctggtacggtaatcggtggtaagctgatgtttgcgctggcagcgtcgaaaaagagcttgcgtcaattgttaatgatgggcgcacgtgcggtggcaccttacttagcgatggctgcggcggcgggtgtcgttgccttagtgttagaagacatttatggttggacgcagggagatttatcctttactggggcattagtcggacgctatgaagtttgggcggataaattcgccgcgctaggtaaactggcggataagctctggatcaatgttcgtggtttattaaaagatttaagccggatggcgggcgttgagattaattttgactcttggcaggcttttgcaactgatgttttagaatatattattgccgccgtgaggaatctcattaatacggtaagcggtatggtgcggattattcgcgcattaattaatggggattatgccggtgcttggtctagtgcgggcgatatgattgatggattaagcttgaaattcctaccgctttattttgttgggctaatggtgctgggcggtatntttnccgnnnnnttaattaat

SEQ ID NO: 1266 - protein, 490 aa, Haemophilus influenzae
  Xaa 483, 485, 486, 487: Xaa is any amino acid
  Name: NTH0696
MNAIRELVTLLRYKVDNSGLKAYVVQTQQAAKGIRSNLNNAVDGLRAKFSEAAVSAKGVGNNLKDAKNQILSLRNFVAGYFAMIAGGNVIKIADDWAAVDSRVKLATKSAEEHKYALSQIFDLSQRSGQDYLASADLFSKVNRSAGDLGLSLDDTLNLTEIIGQTMTIGGGDQGAQQAALMQLGQALGSGALRGDELNSIIEQAPRLANAIADSFGVPIGQLKDLGKEGKLTSKELAQGLLKQADKIQKEFDQMPKTFGRGMTILKNKAGQLIDVAVNKVSKLGAAFYNAAEWVTENIRLVGFLAGTVIGGKLMFALAASKKSLRQLLMMGARAVAPYLAMAAAAGVVALVLEDIYGWTQGDLSFTGALVGRYEVWADKFAALGKLADKLWINVRGLLKDLSRMAGVEINFDSWQAFATDVLEYIIAAVRNLINTVSGMVRIIRALINGDYAGAWSSAGDMIDGLSLKFLPLYFVGLMVLGGXFXXXLIN

SEQ ID NO: 1267 - DNA, 378 bp, Haemophilus influenzae
  Name: NTH0697
atgatagaacaattaaaacaagctaaaaattgggaagatcgctatcgcctgattattcaagcaggcaaaaatttacctcgcccaagcgataatgaactcgctcaaatgcaacctattactggctgcgaagcacaaatgtggtttcaaattatgcctaaacatgaccgcacttttcaattcagcggatttagcgaagccagaattatgaatggcttgctttggattttattcaatcaaatcaatggcaaaacagcggatgaattgaatacatttgatattattgccttttttagcgaactcggcatttcacaacgtttaagtgaaatgcgtttaaacggcttaaaccaaatcagacagcaattaaaaaatttatgtatt

SEQ ID NO: 1268 - protein, 126 aa, Haemophilus influenzae
  Name: NTH0697
MIEQLKQAKNWEDRYRLIIQAGKNLPRPSDNELAQMQPITGCEAQMWFQIMPKHDRTFQFSGFSEARIMNGLLWILFNQINGKTADELNTFDIIAFFSELGISQRLSEMRLNGLNQIRQQLKNLCI

SEQ ID NO: 1269 - DNA, 1197 bp, Haemophilus influenzae
  Name: NTH0698
atggcttttgattatcaaacgttccgtcaagaatttccctatttccaacgtgaagattctgttatttatttagataacgccgccaccgcgttaaaacctcaagtgttaattgatcgcaccgctgaattttatgcgtctgcaggttcggtgcatcgcagccaatatgatgctgcccaaactgtgcaatatgaacaggctcgcacacaggttaaagaatgggttcatgcagaagataaacacgctgttatttggacttcgggtacaactcacgcaataaacttagtggcaaatggattgctgccgcaattaaacgccgaagatgaaattctgattagccaagcagatcatcatgccaattttgtcacttggcatgaaacggcgaaaaagtgcggtgcaaaaattcgagttttaccgattttagataattggctaattgatgaaaatgtgcttatttctaccctttctgaaaaaacaaaactcgttgcgctgaattttgtttcaaatgtcacgggcacagaacagccgattaaacgcctgattcaacttattagaaaacatagtcatgcgttggttttagtggatgcagcacaagcgattagtcatattaaaattgatttacaagatttagatgccgatttcctcgcattttctgcccataaaatttatggcccaaatggacttggcgttttaacaggaaaattgaccgcactttctcaacttcaaccgctcttttttggcggaaaaatggttgaacgtgtgtcaaataatcgtattacttttgccgaattgccttatcgtttagaagctggcacacccaatattgctggggttattggctttaatgctgtgctggattggctacaaaaatgggattttaccgcagcagaacagtacgctatatccttggctgaatccgtcaaagtgcggttaaaatcttacgagaattgccgattattcaattctcctcaagcaagcactgtcgtttgctttgtatttgacggcattgactgttctgatctttctacacttttgagcgaacaaaatattgcgcttcgtgtgggcgaacattgcgcccagccttatttagcacgcttaggcgaacgcaccacattgcgtctttcttttgcgccttataatacgcaaaaagatgtagaggcattctttaccgccttagataaagcactggatttattacaa

SEQ ID NO: 1270 - protein, 399 aa, Haemophilus influenzae
  Name: NTH0698
MAFDYQTFRQEFPYFQREDSVIYLDNAATALKPQVLIDRTAEFYASAGSVHRSQYDAAQTVQYEQARTQVKEWVHAEDKHAVIWTSGTTHAINLVANGLLPQLNAEDEILISQADHHANFVTWHETAKKCGAKIRVLPILDNWLIDENVLISTLSEKTKLVALNFVSNVTGTEQPIKRLIQLIRKHSHALVLVDAAQAISHIKIDLQDLDADFLAFSAHKIYGPNGLGVLTGKLTALSQLQPLFFGGKMVERVSNNRITFAELPYRLEAGTPNIAGVIGFNAVLDWLQKWDFTAAEQYAISLAESVKVRLKSYENCRLFNSPQASTVVCFVFDGIDCSDLSTLLSEQNIALRVGEHCAQPYLARLGERTTLRLSFAPYNTQKDVEAFFTALDKALDLLQ

SEQ ID NO: 1271 - DNA, 153 bp, Haemophilus influenzae
  Name: NTH0699
atggttaaacagggtatggcatgggcttataaacaatattcccatgatccgatttatcttcaagcgcaagaaaatgcacaagccaaaggaattggtctttgggcagataataatccgattgaaccaagtcaatggcgcagacaagagaaaaat

SEQ ID NO: 1272 - protein, 51 aa, Haemophilus influenzae
  Name: NTH0699
MVKQGMAWAYKQYSHDPIYLQAQENAQAKGIGLWADNNPIEPSQWRRQEKN

SEQ ID NO: 1273 - DNA, 2133 bp, Haemophilus influenzae
  Name: NTH0700
atgaaacaattatttgcaacgacttctcgtggctttgaagaattattaaaagttgaactcactgaacttggtgcgcaagaggcaaaagtggttcaaggtggcgttcattatcaagcagatgacgaaactttataccgcactttactttggtcacgccttgcttcacgcattttatttcctttgattgaaactaaaatttacagtgatttggatctttatgcggctgtttcaggctttaattggttagggctatttgatgaaagagttacattctttgtcgattttaatggaaccaaccaagaaattcgtcatactcaatttggtgcgatgcgcgttaaagatggaattgtcgattactttgaacgtcaaggtaaagctcgtcccgatgtagataaaattcagccggacgtgcgtatccatgcttatttgaatcgtgaaaatttagtgatttctttagatttaagtggggaagcattacatttacgaggctatcgtgaagatgcaggtcaagctcctttacgtgaaactctagctgcggcaattgttctgcgttcaggttggcaagtgggttctccattagtagatccaatgtgtggctctggcacgcttttaattgaggcggcacaaatggaagccaaaattgcaccgcaactttatcgtttacattggggatttgatttttggaaagcgcataatcaatcggcttgggaaaaagtaaaaaatgaagcgattgaattagcagaagaaaaacaacgtgaaattcaaccgcacttttatggatttgacctcgatcaccgcgtattaaaaaaggcgcaaaagaatgcacaaaatgcaggtgtttcacatttaattaaatggcagcaaggtgatgttgcagcgttgaaaaatcctcgtttaaatgaagtcggtacggttatctgtaatccaccttatggggaacgcttaggcacaaccccagcattgatcgcgctctattctgtatttgggcaaagacttaaaaaagaattttgtggttggaatgtttctgtttttagtagcgaatccacattacttgattgtttgagaatgcgtgccagccgacagtttaaagccaaaaatggcccattagattgtgtgcagaagaattatcaagtttcagaacgaaaatctgacgaaattaccgctgaaaatgaactagaatttaaccgcacttcggaggttgcaaccgattttgctaatcgattacaaaaaaatattaagaaaattagtaaatgggcaaagcaacaaggattagacgcttatcgtttatatgatgccgatttgccagaatataatttagccgttgatcgttatgcagattacattgttgtgcaagaatatgcagcaccgaaaaatattgatgaaaataaagcgcgtcagcgtttgttagatgcggttactgcaactttgcacgttacaggtgtagaaacgaataagttgatcctcaaagttcgtcagaaacaaaaaggtactaaccaatatgagaaattagccaataaaggcgaatacttttatgtgaatgaatatggcgcgcagctttgggtaaatttgacagattatttagacacgggcttatttttagatcaccgtttaacaagaaaaatgattggagcgttggcaaaaggtaaagatttcttaaatttatttgcttatactggttctgcaactgttcatgcggcacttggtggcgctaaatcgacaacgaccgttgatatgtccaatacttatcttaattgggcggagcaaaatcttattttgaatgatattgaaggtaaacaacataaattaattcaagcagattgccttcaatggttagaaaaatgtgatcgtcaatttgatttgatatttgtggatccaccgacgttttcaaattctaaacgtatggaagacagttgggatgtgcaacgagatcatgtgaaattaatgcgcaatctaaaacgagttttgtcgaataatggcacaattgttttctcgaataataaacgtggattcaaaatgaatttagttgcgttggaagaattaggtttaagtgcggtagaaatttcgcataaaaccttaccgttagattttgaacgtaataaacaaattcataattgttggatgattcaacatata

SEQ ID NO: 1274 - protein, 711 aa, Haemophilus influenzae
  Name: NTH0700
MKQLFATTSRGFEELLKVELTELGAQEAKVVQGGVHYQADDETLYRTLLWSRLASRILFPLIETKIYSDLDLYAAVSGFNWLGLFDERVTFFVDFNGTNQEIRHTQFGAMRVKDGIVDYFERQGKARPDVDKIQPDVRIHAYLNRENLVISLDLSGEALHLRGYREDAGQAPLRETLAAAIVLRSGWQVGSPLVDPMCGSGTLLIEAAQMEAKIAPQLYRLHWGFDFWKAHNQSAWEKVKNEAIELAEEKQREIQPHFYGFDLDHRVLKKAQKNAQNAGVSHLIKWQQGDVAALKNPRLNEVGTVICNPPYGERLGTTPALIALYSVFGQRLKKEFCGWNVSVFSSESTLLDCLRMRASRQFKAKNGPLDCVQKNYQVSERKSDEITAENELEFNRTSEVATDFANRLQKNIKKISKWAKQQGLDAYRLYDADLPEYNLAVDRYADYIVVQEYAAPKNIDENKARQRLLDAVTATLHVTGVETNKLILKVRQKQKGTNQYEKLANKGEYFYVNEYGAQLWVNLTDYLDTGLFLDHRLTRKMIGALAKGKDFLNLFAYTGSATVHAALGGAKSTTTVDMSNTYLNWAEQNLILNDIEGKQHKLIQADCLQWLEKCDRQFDLIFVDPPTFSNSKRMEDSWDVQRDHVKLMRNLKRVLSNNGTIVFSNNKRGFKMNLVALEELGLSAVEISHKTLPLDFERNKQIHNCWMIQHI

SEQ ID NO: 1275 - DNA, 459 bp, Haemophilus influenzae
  n 454, 455, 456, 457, 458: n is any nucleotide
  Name: NTH0701
ttgaataaacagcttcccttacccattcatcaaattaatgatgccacattagaaaacttttacggcgataataatcttttattgcttgattctttacgcaaaaattcatctgatttaaaacaaccgtttttctacatttggggagataaaggctctggtaaaacccatttacttagagcattcagtaacgaatatttaatcaatcaacgtactgctatttatgtaccccttagcaaatctcaatatttttctaccgcagttcttgaaaatttagaacagcaagaattggtatgcttagatgatttacaaagcgtcataggaaatgatgaatgggaattagctatttttgatctattcaatcgaattaaagcaagcggaaaaacgctgttactaattagtgcagataaatcgccttccgcactttctgtaaaattacctgatggggatccccctnnnnnt

SEQ ID NO: 1276 - protein, 153 aa, Haemophilus influenzae
  Xaa 152, 153: Xaa is any amino acid
  Name: NTH0701
LNKQLPLPIHQINDATLENFYGDNNLLLLDSLRKNSSDLKQPFFYIWGDKGSGKTHLLRAFSNEYLINQRTAIYVPLSKSQYFSTAVLENLEQQELVCLDDLQSVIGNDEWELAIFDLFNRIKASGKTLLLISADKSPSALSVKLPDGDPPXX

SEQ ID NO: 1277 - DNA, 837 bp, Haemophilus influenzae
  Name: NTH0702
atggggcttgcacctattgcggtggatatgtcattaggtaaaaccagtaactatgcttataacgacgcagtattagtttcaatggtaacgcttcttaccactttatctgtggctgtatttgccaaaggattgatgaaacttattccaataatgttcggtattaccgtaggctatattttgtgtttgtttctgggtttaattaatttccaaccagttattgatgcaccttggttcagtttgcccaaattaacgacacctgaatttaacctagaagctattctttatatgttaccaattgctattgcccctgccgtagaacacgttggtggtattatggcgattagctctgtgacaggtaaagattttctaaaaaaaccaggattacaccgcactttattaggcgatggcgtcgctactgctgcagcttctttagtgggcggtccgcctaatacgacttatgcggaagttactggtgctgtgatgctaacacgcaactttaacccaaatattatgacttgggctgctgtttgggctattgcgatttcattctgtggaaaagtaggcgcattcctatcaaccattccaacgattgtaatgggtggaattatgatgcttgttttcggttcaatcgcagtcgtgggcattagcaccttaattcgtggcaaagttgatgttaccgaagcgcgtaatctatgtattatttctgttgtaatgacatttggtatcggcaatatgtttgtagatgtgggtaacgtatcactaaaaggtatcagcttatgtgcgattgttgctatcatcttaaaccttgttttaccgaaagcaaaaaatgaagtagaa

SEQ ID NO: 1278 - protein, 279 aa, Haemophilus influenzae
  Name: NTH0702
MGLAPIAVDMSLGKTSNYAYNDAVLVSMVTLLTTLSVAVFAKGLMKLIPIMFGITVGYILCLFLGLINFQPVIDAPWFSLPKLTTPEFNLEAILYMLPIAIAPAVEHVGGIMAISSVTGKDFLKKPGLHRTLLGDGVATAAASLVGGPPNTTYAEVTGAVMLTRNFNPNIMTWAAVWAIAISFCGKVGAFLSTIPTIVMGGIMMLVFGSIAVVGISTLIRGKVDVTEARNLCIISVVMTFGIGNMFVDVGNVSLKGISLCAIVAIILNLVLPKAKNEVE

SEQ ID NO: 1279 - DNA, 387 bp, Haemophilus influenzae
  Name: NTH0703
atgacaaaccaaacttcttcttttccttcggaaaatcaaagcaaattaaaacaatctttcgttggcctacaaatgctcttcgtcgcatttggtgcgcttgttcttgtaccattaattacaggacttgattccaatacggcattattaacagcaggcgttggcactctacttttccaattttgtacaggcaaacaagtgcctattttcttggcatcatcttttgcctttatcgcgcccattcaatatggtgttcaaacttggggtattgcgactacgatgggcggtttagcgtttactgggcttgtttatttcgccttgagtacgttagtaaaattacggggagcagaagcactacaacgttttttcccaccagtggtgttgggccag

SEQ ID NO: 1280 - protein, 129 aa, Haemophilus influenzae
  Name: NTH0703
MTNQTSSFPSENQSKLKQSFVGLQMLFVAFGALVLVPLITGLDSNTALLTAGVGTLLFQFCTGKQVPIFLASSFAFIAPIQYGVQTWGIATTMGGLAFTGLVYFALSTLVKLRGAEALQRFFPPVVLGQ

SEQ ID NO: 1281 - DNA, 405 bp, Haemophilus influenzae
  Name: NTH0704
gtgccaattttacgtgctggtttaggtatgatggatggtgtacttgaacatgtaccaagcgcgcgtatcagtgtagtgggaatctaccgtaatgaagaaacccttaagccagtcccttattttcaaaaattagctagcgatttagaagaacgtcttgcaattgttgtcgatccaatgcttgcaacaggcggttctatgattgccaccctcgatcttttaaaagcaaaaggttgtaaacatatcaaagtattagtgttagtggctgcaccagaaggaattaaggctcttgaggctgcgcaccctgacattgaactctactgcgcttctattgatagccatttaaatgaacaaggttacattattccgggtcttggtgacgcgggcgataaaatttttgggacaaaa

SEQ ID NO: 1282 - protein, 135 aa, Haemophilus influenzae
  Name: NTH0704
VPILRAGLGMMDGVLEHVPSARISVVGIYRNEETLKPVPYFQKLASDLEERLAIVVDPMLATGGSMIATLDLLKAKGCKHIKVLVLVAAPEGIKALEAAHPDIELYCASIDSHLNEQGYIIPGLGDAGDKIFGTK

SEQ ID NO: 1283 - DNA, 1023 bp, Haemophilus influenzae
  n 1014, 1015, 1016, 1017, 1018: n is any nucleotide
  Name: NTH0705
atgatgagccatacagagacatctttgggtgcagaaaatacccgcactcataattttattacccaaattattgatgaagatttagcttcgggtaaacataaaagcgttcatacccgttttccgccagagccgaatggttatttgcatattggtcacgcaaagtctatttgcttgaattttggcttggcaaaagaataccaaggtttatgtaacctacgttttgacgataccaatccagtaaaagaagacgtggaatatgtagattctatcaaagcggatgtggaatggttaggttttaaatgggagggcgaaccgcgttatgcatctgattacttcgatgcgctttatggctatgccgctgaattaattaaaaaaggtttggcttatgttgatgagctttctccagatgaaatgcgtgaatatcgtggtaccttaaccgaacctggtaaaaacagcccatatcgtgaccgcactattgaagaaaacttagcgttatttgaaaaaatgaaaaatggcgaatttgccgagggtaaagcaagtttacgtgcaaaaattgatatggcttcgccatttatggtcatgcgtgatccagtaatttatcgtattaaatttgccagccatcaccaaacaggtgacaaatggtgtatttacccaatgtacgatttcacgcactgtatctctgatgcgattgagcgtattacacactcaatctgtacattagaattccaagataaccgtcgtttatatgactgggtgttggaaaatatcagtattgaacgtccattaccgcatcaatatgaattctcacgtttgaatttagaaggcactttaacctctaaacgtaaattattgaaattggtaaatgatgaaatcgtggatggttggaacgatccacgtatgccaaccatttcaggtttacgccgtcgtggttatacaccagcttcgttacgtgaattttgtcgtcgtatcggtgtgactaaacaagataacgtcgtagagtatcagcacttgaannnnnttaat

SEQ ID NO: 1284 - protein, 341 aa, Haemophilus influenzae
  Xaa 338, 339, 340: Xaa is any amino acid
  Name: NTH0705
MMSHTETSLGAENTRTHNFITQIIDEDLASGKHKSVHTRFPPEPNGYLHIGHAKSICLNFGLAKEYQGLCNLRFDDTNPVKEDVEYVDSIKADVEWLGFKWEGEPRYASDYFDALYGYAAELIKKGLAYVDELSPDEMREYRGTLTEPGKNSPYRDRTIEENLALFEKMKNGEFAEGKASLRAKIDMASPFMVMRDPVIYRIKFASHHQTGDKWCIYPMYDFTHCISDAIERITHSICTLEFQDNRRLYDWVLENISIERPLPHQYEFSRLNLEGTLTSKRKLLKLVNDEIVDGWNDPRMPTISGLRRRGYTPASLREFCRRIGVTKQDNVVEYQHLXXXN

SEQ ID NO: 1285 - DNA, 129 bp, Haemophilus influenzae
  Name: NTH0706
gtgcatttatacatcgccacgataatttcgtggcggttttttatggcaagtttttacaatcttttatttaaatctagtatttctatggcaagaacaggagatgaacctttattttcccttagatttgta

SEQ ID NO: 1286 - protein, 43 aa, Haemophilus influenzae
  Name: NTH0706
VHLYIATIISWRFFMASFYNLLFKSSISMARTGDEPLFSLRFV

SEQ ID NO: 1287 - DNA, 108 bp, Haemophilus influenzae
  Name: NTH0707
atgcaggcaaaaacagcaaaatttcctatcaaatgggagctggctgggtttggtaagctaaacattcaaaaaacttaccgcactttgtgcatttatacatcgccacga

SEQ ID NO: 1288 - protein, 36 aa, Haemophilus influenzae
  Name: NTH0707
MQAKTAKFPIKWELAGFGKLNIQKTYRTLCIYTSPR

SEQ ID NO: 1289 - DNA, 234 bp, Haemophilus influenzae
  Name: NTH0708
atgaatgtccaaactgtcaatggacgtggtcgggtgaaaactgttgagacagtttgctacgaaattatgcgtgaaattatcggggtgtatcatttattcagtagtgaccaatttgttgtttatgcctcgccagcagtttcagaatatcttattaatgaagaatctcacggtttactgccagaagtggaaatgtttattggaaaccgagtaaaagtaaaagcagtaccagtttta

SEQ ID NO: 1290 - protein, 78 aa, Haemophilus influenzae
  Name: NTH0708
MNVQTVNGRGRVKTVETVCYEIMREIIGVYHLFSSDQFVVYASPAVSEYLINEESHGLLPEVEMFIGNRVKVKAVPVL

SEQ ID NO: 1291 - DNA, 774 bp, Haemophilus influenzae
  n 765, 766, 767, 768, 769: n is any nucleotide
  Name: NTH0709
ttgaaaccagcaggtttacctattgatgttatgtttatgattatggctgtagtggcagccgcggcagcaatgcaagcagctggcggtttagactacatgatcaaaatcgcaaccaaaatcttacgtcgtaatcctaaacacattacgtttattgcgccagcagtaacttggttattcactctcttagcgggtactggtcacgtggcatattctgtattgccagttatcgctgaagtgagccgtcaaaacggtatccgtcctgaacgcccaatgtcaatggcggtaattgcatcacaatttgctatcgtagcaagcccaatcgctgcagcagtggtggctgtggttgcttaccttgagccacaaggtattcatcttggcgatgttttaatggtaaccattccttcaactattctaggacttttccttgcttgcttatttgttaataaaatgggtaaagaattaaaagatgatccagaatatcaacgtcgtttgaatgatccaaaatatgcagatatttttgcttctaccactttagtcaaagaagtagaagtgagcaaaacagctaaaatttctgtttctttattcttatttggagctttacttgtcgtgttaatgggtgcagctccttctattcgacctgtttttgatggaaaaccaatgggaatggcacataccattgaaattattatgctttctattggtgcattgattttcttaacttgggggatctccaagagtcgacctgccaggcatgccaagtctggnnnnnttaat

SEQ ID NO: 1292 - protein, 258 aa, Haemophilus influenzae
  Xaa 256, 257: Xaa is any amino acid
  Name: NTH0709
LKPAGLPIDVMFMIMAVVAAAAAMQAAGGLDYMIKIATKILRRNPKHITFIAPAVTWLFTLLAGTGHVAYSVLPVIAEVSRQNGIRPERPMSMAVIASQFAIVASPIAAAVVAVVAYLEPQGIHLGDVLMVTIPSTILGLFLACLFVNKMGKELKDDPEYQRRLNDPKYADIFASTTLVKEVEVSKTAKISVSLFLFGALLVVLMGAAPSIRPVFDGKPMGMAHTIEIIMLSIGALIFLTWGISKSRPARHAKSGXXN

SEQ ID NO: 1293 - DNA, 129 bp, Haemophilus influenzae
  Name: NTH0710
ttggccatcgtattaatgtgtatctttgtgggtgcacgtgtaggtggtatcggtttaggtgtatttggtggtttaggtcttgcccattctttcttttggctttggcttgaaaccagcaggtttacctat

SEQ ID NO: 1294 - protein, 43 aa, Haemophilus influenzae
  Name: NTH0710
LAIVLMCIFVGARVGGIGLGVFGGLGLAHSFFWLWLETSRFTY

SEQ ID NO: 1295 - DNA, 210 bp, Haemophilus influenzae
  Name: NTH0711
ttgttttctctactgattaagtacgtcaaaatagggctcaagtataaccgcacttgggttatctttcaaaaaaatattcaaaatatagaatacattaaattatctttatttcagctgatggaaaataacagaatttttcaacattatttattgatccaagttatggaatctctacctatttgttgctatattacacgccgtttcaacaaa

SEQ ID NO: 1296 - protein, 70 aa, Haemophilus influenzae
  Name: NTH0711
LFSLLIKYVKIGLKYNRTWVIFQKNIQNIEYIKLSLFQLMENNRIFQHYLLIQVMESLPICCYITRRFNK

SEQ ID NO: 1297 - DNA, 444 bp, Haemophilus influenzae
  Name: NTH0712
atgcaagaatttatctcaatggcaacagagtttgctcaaaaacatacgcttttagcagtttcttggtttgcgattttcgtgatggtgatttataccttctacaaaggcgcaacgagtaaatttaaagtaattacgcacaatgaagttattcggttaataaattccgatgaagccattgtggtagatttacgtagtcttgaagaatttcaacgtggacatatcattaatagtattaatgtgcttccaagcgaaattaaaaatcaaaatatcggaaaattagagtcgcataaagagaaagctcttatattagtcgatacaaatggtacttcagcctctgcttctgcagtatttttaaccaaacaaggttttaattctgtatttgtgttgaaagaaggcctttccgcgtgggtagcagcaaatttacctttagttaaaaaacataaa

SEQ ID NO: 1298 - protein, 148 aa, Haemophilus influenzae
  Name: NTH0712
MQEFISMATEFAQKHTLLAVSWFAIFVMVIYTFYKGATSKFKVITHNEVIRLINSDEAIVVDLRSLEEFQRGHIINSINVLPSEIKNQNIGKLESHKEKALILVDTNGTSASASAVFLTKQGFNSVFVLKEGLSAWVAANLPLVKKHK

SEQ ID NO: 1299 - DNA, 507 bp, Haemophilus influenzae
  Name: NTH0714
atgtcagaacaaaaacaagacgttgcagcaacagaagaacaacaacccgttctccaaattcaacgtatttatgtgaaagatgtgtcttttgaagctccaaatcttccacatattttccaacaagaatggaaaccaaaacttggttttgatttaagcaccgaaacaacccaagttggcgatgacttatatgaagtggtattaaacatttctgttgaaactacacttgaagatagtggtgatgtcgcatttatttgtgaagtaaaacaagcgggcgtattcactattagcggtttagaagatgttcaaatggcgcattgtttaacctctcaatgcccgaatatgcttttcccttatgcacgtgaattagtgtctaacctagtcaatcgcggtacgttccctgcattaaacttatctccagtaaactttgatgcattgtttgttgaatatatgaatcgccaacaagcagaaaatgcagaagaaaaatctgaggaagaacaaactaaacat

SEQ ID NO: 1300 - protein, 169 aa, Haemophilus influenzae
  Name: NTH0714
MSEQKQDVAATEEQQPVLQIQRIYVKDVSFEAPNLPHIFQQEWKPKLGFDLSTETTQVGDDLYEVVLNISVETTLEDSGDVAFICEVKQAGVFTISGLEDVQMAHCLTSQCPNMLFPYARELVSNLVNRGTFPALNLSPVNFDALFVEYMNRQQAENAEEKSEEEQTKH

SEQ ID NO: 1301 - DNA, 228 bp, Haemophilus influenzae
  n 219, 220, 221, 222, 223: n is any nucleotide
  Name: NTH0715
ttgatggctgatgctgggcatatggcaaatgatagtttatctatttttttagcatggattgggttatttttaagtctaaaatggcaaaaatggttagctttaatcaatggaatttcattagtttgggtcgctatttggatttttattgaggctgtaacacgttggcaggctccgatagaaatagccgctttgccaatgttaggtgtagctttactaggnnnnnttaat

SEQ ID NO: 1302 - protein, 76 aa, Haemophilus influenzae
  Xaa 74, 75: Xaa is any amino acid
  Name: NTH0715
LMADAGHMANDSLSIFLAWIGLFLSLKWQKWLALINGISLVWVAIWIFIEAVTRWQAPIEIAALPMLGVALLGXXN

SEQ ID NO: 1303 - DNA, 135 bp, Haemophilus influenzae
  Name: NTH0716
atgaaagaagtttctctagtaaaaaattatactcctaaagaatatcagcagcatgcatcttgccctcatagtcaaatttctaaaaataaaatggtattaggcatcagttttgcaattattaccttttatatggtg

SEQ ID NO: 1304 - protein, 45 aa, Haemophilus influenzae
  Name: NTH0716
MKEVSLVKNYTPKEYQQHASCPHSQISKNKMVLGISFAIITFYMV

SEQ ID NO: 1305 - DNA, 117 bp, Haemophilus influenzae
  Name: NTH0717
gtgaaaatgcgatcattttctttaaaaatcttgtgtgtaaaatggaaagttattaacaactttattttttctcaaagttatcaagtgagtaaaaacagttttatgacagattattta

SEQ ID NO: 1306 - protein, 39 aa, Haemophilus influenzae
  Name: NTH0717
VKMRSFSLKILCVKWKVINNFIFSQSYQVSKNSFMTDYL

SEQ ID NO: 1307 - DNA, 525 bp, Haemophilus influenzae
  n 516, 517, 518, 519, 520: n is any nucleotide
  Name: NTH0718
atgttttacactgaaacttatgatgtgattgtgatcggtggtggccatgcgggtacagaagctgcgcttgcaccagctcgaatgggattaaaaacccttttattaacacataatgtagatactttagggcaaatgtcttgtaatcctgcaattggtgggatcggtaaaggtcatttagtaaaagaagtagatgctatgggtggtttgatggcgcatgctgcagataaagcaggaattcaatttcgtactttaaatagtagtaaaggtccagcagtacgtgctactcgagctcaagctgacagagttttatatcgtcaagctgttcgtacagcattagaaaatcaacctaatttagatattttccaacaagaagcgacagatattctaattgagcaagatcgagttacaggcgttagcacaaaaatgggattaatttttcgtgctaaatcagtggtattaactgcaggtactttcttagccggtaaaatcatatttggtttggaaaattatgaaggnnnnnttaat

SEQ ID NO: 1308 - protein, 175 aa, Haemophilus influenzae
  Xaa 173, 174: Xaa is any amino acid
  Name: NTH0718
MFYTETYDVIVIGGGHAGTEAALAPARMGLKTLLLTHNVDTLGQMSCNPAIGGIGKGHLVKEVDAMGGLMAHAADKAGIQFRTLNSSKGPAVRATRAQADRVLYRQAVRTALENQPNLDIFQQEATDILIEQDRVTGVSTKMGLIFRAKSVVLTAGTFLAGKIIFGLENYEGXXN

SEQ ID NO: 1309 - DNA, 672 bp, Haemophilus influenzae
  Name: NTH0719
atgccaattattactttacctgacggttcccaacgtcaattcgatcgtcctgtttctgttcttgaagtcgcacaagatattggtgcgggtcttgctaaagccactatcgcaggccgtgtaaacggagaacgtcgcgatgcgtgcgatgttatcgagcaagatgcaacgttagaaattattactgcaaaagatgaagacggtttagagattatccgccattcttgcgctcacttgctcggacacgctattaaacaattattcccagatgtaaaaatggcaattggtccaactattgaaaacggcttctattatgatgtagatttagatcgctctttaacccaagaagatattgatgcaatcgaaaaacgtatgttggaattggcaaaaacaaattatgacgtcgtgaaaaaacgtgttacttggcaagaagcgcgtgatacctttgaaaaacgcggcgagccatacaaaatggcaattttagatgaaaacattgaacgtactgcaacgcctgcgttatatcatcacttagaatatattgatatgtgccgtggaccacacgtgccaaatatgcgtttcctgtcagcattttcaaattacaaaagtcgcttggtgcgtacctggcgtgcgacagcaaaacaaaatgttcacgtatcttggtacgggcttgggcga

SEQ ID NO: 1310 - protein, 224 aa, Haemophilus influenzae
  Name: NTH0719
MPIITLPDGSQRQFDRPVSVLEVAQDIGAGLAKATIAGRVNGERRDACDVIEQDATLEIITAKDEDGLEIIRHSCAHLLGHAIKQLFPDVKMAIGPTIENGFYYDVDLDRSLTQEDIDAIEKRMLELAKTNYDVVKKRVTWQEARDTFEKRGEPYKMAILDENIERTATPALYHHLEYIDMCRGPHVPNMRFLSAFSNYKSRLVRTWRATAKQNVHVSWYGLGR

SEQ ID NO: 1311 - DNA, 582 bp, Haemophilus influenzae
  Name: NTH0720
atgagcaacgtattagtattaaaatctagcatttcaggaaataactcgcaaactaatcaattagctgattatgttatcgaaaaattacaaggtaataacattgtagtacgcgatttatcccaacaacctcttccatattttgataccgcagctgcaattgctgtgcgtggagaaccaaaaacaacagaagaaaaacaacttctggcgttgtctgataaactaatcgaagaattaaaaaacgcacaaacattgataattggtgcgccgatgtataatttaaacgttccaacacaattaaaaagctattttgattttatcgcacgtccgcgcgttactttccaatatacagcaaacggctctgagggtttattaaaaggcaaaaaagccattgtgttatgtgcatttggtggattgtatgatgaagaaaatctagtgacacaatatatgaaatcaattttaggttttattggcatcacagatgtgcaatttgtttatgcacaaggcattggattcgggccagaggcgattgaaaaagcccaagcgtccgcaaaaaataaaattaatgaaattgtagcagccctt

SEQ ID NO: 1312 - protein, 194 aa, Haemophilus influenzae
  Name: NTH0720
MSNVLVLKSSISGNNSQTNQLADYVIEKLQGNNIVVRDLSQQPLPYFDTAAAIAVRGEPKTTEEKQLLALSDKLIEELKNAQTLIIGAPMYNLNVPTQLKSYFDFIARPRVTFQYTANGSEGLLKGKKAIVLCAFGGLYDEENLVTQYMKSILGFIGITDVQFVYAQGIGFGPEAIEKAQASAKNKINEIVAAL

SEQ ID NO: 1313 - DNA, 90 bp, Haemophilus influenzae
  Name: NTH0721
atggaaaatgggttgaacgaaagaaataagaagaaaagtgcggtaaaatcaccgcacttttttgtttttaatacattttcttatattttt

SEQ ID NO: 1314 - protein, 30 aa, Haemophilus influenzae
  Name: NTH0721
MENGLNERNKKKSAVKSPHFFVFNTFSYIF

SEQ ID NO: 1315 - DNA, 438 bp, Haemophilus influenzae
  Name: NTH0723
atgcatttaaaacttggtcgttttggcaagtatatgggatgtacaaattgtgataacacgcgcaaaattttgaaaagtggcgaggtcgcaccaccgaaagaagagccagtacatttccctgagttaaaatgcgaaaaatctgatgcatattttgtattgcgtgatggtgcgagtggggtatttatgtcagcacataacttcccaaaatcccgcgaaacacgcccagttaaaatcgctgaacttgtgcaatatcgcgagcgtttacctgaaaaattagcttatttagccgatgctccacaaaaagacccagaagagaatgaagcgattgttcgttttagtcgcaaagagaaaaaacaatatgtcacttctgaaaaagagggaaaagcgactaaatggattgttgatttcaccaatggaaaatgggttgaacgaaagaaa

SEQ ID NO: 1316 - protein, 146 aa, Haemophilus influenzae
  Name: NTH0723
MHLKLGRFGKYMGCTNCDNTRKILKSGEVAPPKEEPVHFPELKCEKSDAYFVLRDGASGVFMSAHNFPKSRETRPVKIAELVQYRERLPEKLAYLADAPQKDPEENEAIVRFSRKEKKQYVTSEKEGKATKWIVDFTNGKWVERKK

SEQ ID NO: 1317 - DNA, 207 bp, Haemophilus influenzae
  Name: NTH0724
atgaaacgctatgcaatttcttatcacttcgacggcaaaaggtgggcgacagatgtttacgcccattcattcgaagaagcggaagaaaagctaaaagcaatgtcccaaggtactgttgacggcgagattcacctttcagtttacattcctgaaaatccgctatcgaaagtatcaaggttgattacaagaatagctaaaaagtttatg

SEQ ID NO: 1318 - protein, 69 aa, Haemophilus influenzae
  Name: NTH0724
MKRYAISYHFDGKRWATDVYAHSFEEAEEKLKAMSQGTVDGEIHLSVYIPENPLSKVSRLITRIAKKFM

SEQ ID NO: 1319 - DNA, 156 bp, Haemophilus influenzae
  Name: NTH0725
atggaagaaaaacaagaaaaaagcctatctgataaagataaaaatctaatcaaacaggctgtattagaaagtgctgataaaaatacaaatttaacaccaagtgaattagctgagagtgtatgttcggcagtgatgtttattgattcttatgggcgt

SEQ ID NO: 1320 - protein, 52 aa, Haemophilus influenzae
  Name: NTH0725
MEEKQEKSLSDKDKNLIKQAVLESADKNTNLTPSELAESVCSAVMFIDSYGR

SEQ ID NO: 1321 - DNA, 264 bp, Haemophilus influenzae
  Name: NTH0726
atgagcgacggcgcaatatcagtcaaactggcccctgattatgaaatgggcgaagtgcagcaacagttaaatgattacgatacgtcagatgacattatcagtaatgatggtttcttccccgatatgtcactttcccaatttcgtaatcaataccgtgcagacggcaccattactacacaacgtttacaagatgccttaattgagggcatggcaagtgtcaatgccgaactctccacgtttaaacgcaaagcaaacgtgacagtt

SEQ ID NO: 1322 - protein, 88 aa, Haemophilus influenzae
  Name: NTH0726
MSDGAISVKLAPDYEMGEVQQQLNDYDTSDDIISNDGFFPDMSLSQFRNQYRADGTITTQRLQDALIEGMASVNAELSTFKRKANVTV

SEQ ID NO: 1323 - DNA, 648 bp, Haemophilus influenzae
  Name: NTH0728
atgcgcccaactaaacgccactttctggaagtttctgccgctatcgctaatgcggcagaaaccgaagatctaagcgactttacggaatatgaaaaaatgtgccgtattcttgctcgccatcgaaaggatttgaaaaacatccaatcgacggaacgcaaaggcgcatttaaaaagcaaattttgcctgactatctaccatggattgaaggggcgttatcggtcggaagtggtaaacaagataatgtcttgatgacatggtgcgtgtgggcgattgactgtggcgaatatcatctcgccttacaaattgccgattatgccgtatttcatgatttacgcttgcccgagccattcactcgaacacttggcaccttgttagcagaagaatttgccgaccaagccaaagccgcacaagctgccaataaaccgttcgaagtggcttacttagagcaagtccaacgcatcaccgccgattgcgatatgccagatgaaagccgagcgcgattattgcgtgaattgggtttgttattggttgaaaaacaccctgagcaagcactggcatatttagaacgtgctttgggtttagatcaaaaaattggcgtgaaaggcgacatcaagaaactaaaaaaacaattatcagcgactgaatgt

SEQ ID NO: 1324 - protein, 216 aa, Haemophilus influenzae
  Name: NTH0728
MRPTKRHFLEVSAAIANAAETEDLSDFTEYEKMCRILARHRKDLKNIQSTERKGAFKKQILPDYLPWIEGALSVGSGKQDNVLMTWCVWAIDCGEYHLALQIADYAVFHDLRLPEPFTRTLGTLLAEEFADQAKAAQAANKPFEVAYLEQVQRITADCDMPDESRARLLRELGLLLVEKHPEQALAYLERALGLDQKIGVKGDIKKLKKQLSATEC

SEQ ID NO: 1325 - DNA, 354 bp, Haemophilus influenzae
  Name: NTH0729
atgggtgagaaattagtagcggataaatacttcccattaatcaaccaagaaaaaccaagcgaaattttggcaggcgataccgtcattagccaaaaacgtgtgggtgggttacaagccgtatctgtcccattcttcccgaaaggcacagtgttagtcacatcgcttgataacttgtcaatctacgtgcaggaaggcaaagtacgtcgtcacttaaaagatgtaccagaacgcaatcgtgtggaagattatttatcgtcaaacgaagcctatgttgtggaaaactacgaggcagtcgccatggcgaaaaatatcaccattcttgaagcacctacgcctatttcgccagtggctgca

SEQ ID NO: 1326 - protein, 118 aa, Haemophilus influenzae
  Name: NTH0729
MGEKLVADKYFPLINQEKPSEILAGDTVISQKRVGGLQAVSVPFFPKGTVLVTSLDNLSIYVQEGKVRRHLKDVPERNRVEDYLSSNEAYVVENYEAVAMAKNITILEAPTPISPVAA

SEQ ID NO: 1327 - DNA, 402 bp, Haemophilus influenzae
  n 393, 394, 395, 396, 397: n is any nucleotide
  Name: NTH0730
atgggaagtatttatccgctactaatttctcacccattatcgttaccggttttttttattcccattctcgcagctttagttaatccctctttcgctgtgttccttcctcgcttttttttccccccgtctttttctttccactcgttttctcctctcttttttctccgtctcgtcccctttcctttcctcttcctgcttatcgtttgtcccccttcctctcttttcccctcttcttttactaaatcccctctgcgcgcttctttcctttgtttccccctttccctccccttttctcctatccccttctatcctaatctttccccgcccttatcttttccatttctcctttacacttttcccttccttttccctttatttttattccttttcttnnnnnttaat

SEQ ID NO: 1328 - protein, 134 aa, Haemophilus influenzae
  Xaa 131, 132, 133: Xaa is any amino acid
  Name: NTH0730
MGSIYPLLISHPLSLPVFFIPILAALVNPSFAVFLPRFFFPPSFSFHSFSPLFFLRLVPFPFLFLLIVCPPSSLFPSSFTKSPLRASFLCFPLSLPFSPIPFYPNLSPPLSFPFLLYTFPFLFPLFLFLFXXXN

SEQ ID NO: 1329 - DNA, 258 bp, Haemophilus influenzae
  Name: NTH0731
atgcaggaagaaatcgcacaactagaagtaacgggtgaatctggtgcaggtttagtgaaaatcacgattaatggtgcacataactgccgccgtattgacattgatccttctttaatggaagacgataaagaaatgttagaagatttaatcgcagctgcttttaacgatgcggtgcgtcgtgcagaagaattacaaaaagaaaaaatggcatcagttaccgctggaatgccattaccaccaggaatgaagtttccgttt

SEQ ID NO: 1330 - protein, 86 aa, Haemophilus influenzae
  Name: NTH0731
MQEEIAQLEVTGESGAGLVKITINGAHNCRRIDIDPSLMEDDKEMLEDLIAAAFNDAVRRAEELQKEKMASVTAGMPLPPGMKFPF

SEQ ID NO: 1331 - DNA, 600 bp, Haemophilus influenzae
  Name: NTH0732
atgcaaagcagtccacttttagaacaccttattgaaaacttacgttgtcttccaggcgtagggcctaaatctgcgcaacgtatggcttatcatcttttacagcgtaatcgtagcggtggaatgaatttagctcgagcactcacagaagctatgtctaaaattggtcattgttcacaatgtcgagactttacggaagaagacacttgcaacatttgcaataatccacgccgtcaaaattcaggtttgctttgtgtcgttgaaatgcccgcagatattcaagcgattgagcaaacggggcaattttcaggacgttattttgttttaatgggacatttgtctccacttgatggtattgggcctcgtgaaattggcttagatttactgcaaaaacgcttagtagaagaatctttccacgaagtgattcttgcaacaaatccaacagtggagggcgatgcgacggcaaactacattgctgaaatgtgccgccaacataatatcaaagtgagtcgtatcgctcacggtatccctgtcggtggtgaactagaaactgtggacggcacaacgcttactcactcttttctaggtcgtcgtcaaatcgac

SEQ ID NO: 1332 - protein, 200 aa, Haemophilus influenzae
  Name: NTH0732
MQSSPLLEHLIENLRCLPGVGPKSAQRMAYHLLQRNRSGGMNLARALTEAMSKIGHCSQCRDFTEEDTCNICNNPRRQNSGLLCVVEMPADIQAIEQTGQFSGRYFVLMGHLSPLDGIGPREIGLDLLQKRLVEESFHEVILATNPTVEGDATANYIAEMCRQHNIKVSRIAHGIPVGGELETVDGTTLTHSFLGRRQID

SEQ ID NO: 1333 - DNA, 606 bp, Haemophilus influenzae
  Name: NTH0733
atgcgtttatttatcgccgaaaaaccaagcctagctcgtgctattgcagatgtgctacccaaaccccatcaacgtggggatggttttattaaatgtggcgataatgatgtggtaacttggtgtgtagggcatttgctcgagcaagcagaacccgatgcctatgatcctaaattcaaacaatggcgtttagaacatctccctatcattcctgaaaaatggcaacttttaccgcgaaaagaagtaaaaaaacaactttctgtggtagaaaaactaatccatcaagcggatacacttgttaatgcaggagacccagatagagaaggacaattacttgtagatgaagtcttcagttatgccaatttatctgccgaaaaacgcgataaaattttacgctgcttgattagcgacctaaatccaagtgcggtagaaaaagcggttaaaaaattacaacccaaccgtaattttattcctcttgccacatccgcactcgcacgagctcgtgccgattggctttatggcattaatatgaccagagcttataccattcgaggtagacaaactggctatgatggcgtgctttctgttggacgagtgcaaaccctgtgc

SEQ ID NO: 1334 - protein, 202 aa, Haemophilus influenzae
  Name: NTH0733
MRLFIAEKPSLARAIADVLPKPHQRGDGFIKCGDNDVVTWCVGHLLEQAEPDAYDPKFKQWRLEHLPIIPEKWQLLPRKEVKKQLSVVEKLIHQADTLVNAGDPDREGQLLVDEVFSYANLSAEKRDKILRCLISDLNPSAVEKAVKKLQPNRNFIPLATSALARARADWLYGINMTRAYTIRGRQTGYDGVLSVGRVQTLC

SEQ ID NO: 1335 - DNA, 966 bp, Haemophilus influenzae
  n 957, 958, 959, 960, 961: n is any nucleotide
  Name: NTH0734
atgtctagctatttatttacatctgaatctgtctctgaagggcatccagataaaattgccgatcaaatttctgatgcagtacttgatgaaatcctaaaacaagatccaaaagcacgagtagcttgtgaaacttacgtaaaaaccggtatggcattggtgggtggggaaatcacaacctctgcgtgggttgatattgagaatttaacccgtaaagtgatttgtgatattggttatgaacattctgaaatgggttttgatggtcattcttgtgcggtgcttaatgcgattggtaaacaatctgcagatattaatcaaggcgttgatcgtgaaaatccattagatcaaggtgcaggcgaccaaggtattatgtttggttatgccaccaatgaaacggatgtattaatgcctgcagctattacttatgcacatcgtttaatggaaaaacaagctgaagtgcgtaaaagcggtaaattagcatggttacgcccagatgcgaaaagccaagtcacgttaaaatatgaagataataaaattgttggtgtggatgcggttgtactttctactcaacattctgaagaagttagccaaaaagatttacacgaaggtgtgatggaagaaattatcaaacctgtattaccaactgaatggctttctaaagaaacaaaattcttcatcaacccgactggtcgttttgttattggtggaccgatgggggattgtggtttaactggtcgtaaaattatcgtggatacttacggtggtgctgctcgtcacggtggtggcgcattctcaggaaaagatccatctaaagtagatcgttcagcggcttatgctgcacgttatgtcgcaaaaaatattgtggcagcaggtttagcagatcgttgtgaaatccaactttcttatgcgattggtgtggctgatccaacatctatcatggtcgaaaccttggaacggaannnnnttaat

SEQ ID NO: 1336 - protein, 322 aa, Haemophilus influenzae
  Xaa 319, 320, 321: Xaa is any amino acid
  Name: NTH0734
MSSYLFTSESVSEGHPDKIADQISDAVLDEILKQDPKARVACETYVKTGMALVGGEITTSAWVDIENLTRKVICDIGYEHSEMGFDGHSCAVLNAIGKQSADINQGVDRENPLDQGAGDQGIMFGYATNETDVLMPAAITYAHRLMEKQAEVRKSGKLAWLRPDAKSQVTLKYEDNKIVGVDAVVLSTQHSEEVSQKDLHEGVMEEIIKPVLPTEWLSKETKFFINPTGRFVIGGPMGDCGLTGRKIIVDTYGGAARHGGGAFSGKDPSKVDRSAAYAARYVAKNIVAAGLADRCEIQLSYAIGVADPTSIMVETLERXXXN

SEQ ID NO: 1337 - DNA, 579 bp, Haemophilus influenzae
  Name: NTH0735
atgaaattactcatcattaataatcacgattcttttacttttaacttggtggatttaattcgaaaattaaatgtgccttatgatgttttaaacgtggaagatttaaaggaaagtacagcggaaaaatatagtcatatattgatttcgccagggcctgatataccacgcgcttatccacaacttttttctatgttggaaaaatattatcagcaaaaatctattttaggtgtgtgtttagggcatcaaaccttatgtgaattttttggtggtacattgtataacttagagaatgttcgtcacgggcagaaacgaacattaaaagtgcggtcaaattctccattgttttttgatcttccaactgaatttaatatcgggctatatcattcttggggcgtacaggaagaagattttcctgattgcctagaagttaccgcactttgcgatgaaggcgtggtgatggcaatgcaacataaatctttgccaatttatagtgtccagtttcatccagaatcttatatgtcagactttggcgagaaaattttgcgtaattggttggcgattcctccctcaactaaccca

SEQ ID NO: 1338 - protein, 193 aa, Haemophilus influenzae
  Name: NTH0735
MKLLIINNHDSFTFNLVDLIRKLNVPYDVLNVEDLKESTAEKYSHILISPGPDIPRAYPQLFSMLEKYYQQKSILGVCLGHQTLCEFFGGTLYNLENVRHGQKRTLKVRSNSPLFFDLPTEFNIGLYHSWGVQEEDFPDCLEVTALCDEGVVMAMQHKSLPIYSVQFHPESYMSDFGEKILRNWLAIPPSTNP

SEQ ID NO: 1339 - DNA, 630 bp, Haemophilus influenzae
  n 563, 576, 577, 617, 618, 619, 620, 621: n is any nucleotide
  Name: NTH0736
atggcacaaagcacaatgcaacattttattgaacaggctaatcattatggcaaacaacgcacgccatttttctttcttattgattttgaaaaagaaaaacccttgatttgtcctctcgaaaattctgcacaacaaggcatttattttgatattttaggcaaaagaaattgcacgatttctccacaatctctccctcttaatttcaccaaacatccaatgcctttctcgcattatcaacaaggttttgaacttgttcaaagtgaattacaaaaaggtaattcttatttattaaatctcacctaccccactgaaatttcaggtaatctgtcacttgaacaaatttttcatcaaaccaatgcaccttataaattgtggttacaagatcaattcgtttgcttttcgcctgaatgttttgtcaatattcatgacaacaatatttttacctatcccatgaaagggacaattaatgccactctgcccgatgcagaaaatcagttactcacaaatgaaaaagaacaacgcgagcattacacgattgttgatttaatgcgtaatgatttatnccatggtggcagnnaacaccatgggtaccgaaggcccgatattcgtataccatnnnnnttaattaat

SEQ ID NO: 1340 - protein, 210 aa, Haemophilus influenzae
  Xaa 188, 192, 193, 206, 207: Xaa is any amino acid
  Name: NTH0736
MAQSTMQHFIEQANHYGKQRTPFFFLIDFEKEKPLICPLENSAQQGIYFDILGKRNCTISPQSLPLNFTKHPMPFSHYQQGFELVQSELQKGNSYLLNLTYPTEISGNLSLEQIFHQTNAPYKLWLQDQFVCFSPECFVNIHDNNIFTYPMKGTINATLPDAENQLLTNEKEQREHYTIVDLMRNDLXHGGXXHHGYRRPDIRIPXXLIN

SEQ ID NO: 1341 - DNA, 354 bp, Haemophilus influenzae
  Name: NTH0737
atgaataatatgcaacttaaagccacttcgccactcgctgagtggctttcttatttagaaaaaagccattttaaacctattgatctcggtttagatcgtattcaatccgtggcagaaaaattggatttacttcatcccgccccttatgtgataactgtgggggggacgaatggtaaaggcacgacttgtcgcttgttagaaacgattctgcttaatcacggattacgtgtaggcgtgtattcttcgccccatttattgcgttataacgagcgagtacgcattcaaaatcaagatttacccgatgaagcacataccgcctcttttgcttttattgatgaaaacaaacagaatcgc

SEQ ID NO: 1342 - protein, 118 aa, Haemophilus influenzae
  Name: NTH0737
MNNMQLKATSPLAEWLSYLEKSHFKPIDLGLDRIQSVAEKLDLLHPAPYVITVGGTNGKGTTCRLLETILLNHGLRVGVYSSPHLLRYNERVRIQNQDLPDEAHTASFAFIDENKQNR

SEQ ID NO: 1343 - DNA, 552 bp, Haemophilus influenzae
  Name: NTH0738
atgacaggtacactttataatatgccaatcgttgtggctgcatcgaactttgcttttatgggcggttcaatgggttctgtagttggtgcaaaatttgttaaagcggctgaaaaagcgatggaaatgaattgtccgtttgtatgtttctctgcgagtggtggtgctcgtatgcaggaagcattattctctttaatgcaaatggcaaaaaccagtgccgtacttgctcaaatgcgtgaaaagggtgtgccatttatttcagtattaacggatccgactttaggcggcgtatcagccagttttgcgatgttaggggatttaaatattgccgagccaaaagccttaattggttttgcagggccacgcgttattgaacaaactgtgcgtgaaaaattgccagaaggtttccaacgtagtgagtttctacttgagaaaggggcaattgatatgatcgtgaaacgttcagaaatgcgtcaaactttagcaagtgtactgagtaaattaacgaatcaaccttctccttttgtagaacctgaactcatttcagaagatgaa

SEQ ID NO: 1344 - protein, 184 aa, Haemophilus influenzae
  Name: NTH0738
MTGTLYNMPIVVAASNFAFMGGSMGSVVGAKFVKAAEKAMEMNCPFVCFSASGGARMQEALFSLMQMAKTSAVLAQMREKGVPFISVLTDPTLGGVSASFAMLGDLNIAEPKALIGFAGPRVIEQTVREKLPEGFQRSEFLLEKGAIDMIVKRSEMRQTLASVLSKLTNQPSPFVEPELISEDE

SEQ ID NO: 1345 - DNA, 279 bp, Haemophilus influenzae
  Name: NTH0739
atgagctggattaaccgaatttttagtaaaagtccttcttcttccactcgaaaagccaatgtgccagaaggcgtgtggacaaaatgtactgcttgtgaacaagtactttatagtgaagaactcaaacgtaatctgtatgtttgcccgaaatgtggtcatcatatgcgtattgatgctcgtgagcgtttattaaatttattggacgaagattcaagccaagaaattgcggcagatttagaaccagaaagatattttaaaattcaaagatttaaagaaata

SEQ ID NO: 1346 - protein, 93 aa, Haemophilus influenzae
  Name: NTH0739
MSWINRIFSKSPSSSTRKANVPEGVWTKCTACEQVLYSEELKRNLYVCPKCGHHMRIDARERLLNLLDEDSSQEIAADLEPERYFKIQRFKEI

SEQ ID NO: 1347 - DNA, 531 bp, Haemophilus influenzae
  Name: NTH0740
ttgctacttgtaagaccgtttttgtactgctccgatttccttttaaacaagataatttgctctcctcttattgaacattttttttatttttttgtcttacagaccacgttatctgaaatttattttggagtatttatgaaaaaaacacgttttgtattaaatagtattgcacttggattaagtgtattaagcacatcatttgttgctcaagccactttgccaagttttgtttcggaacaaaacagtcttgcaccgatgttagaaaaagtacaacctgccgttgtcactctttccgttgaaggaaaagctaaagtagattctcgttctcctttcctagacgatattcctgaagaatttaaattcttctttggcgatcgttttgccgaacaatttggtggacgtggagagtcaaagcgtaacttccgtggtttaggttctggtgtcattattaatgcaagcaaaggctatgttttaaccaataatcatgttattgatggagctgataaaattaccggcattacaagatgggcg

SEQ ID NO: 1348 - protein, 177 aa, Haemophilus influenzae
  Name: NTH0740
LLLVRPFLYCSDFLLNKIICSPLIEHFFYFFVLQTTLSEIYFGVFMKKTRFVLNSIALGLSVLSTSFVAQATLPSFVSEQNSLAPMLEKVQPAVVTLSVEGKAKVDSRSPFLDDIPEEFKFFFGDRFAEQFGGRGESKRNFRGLGSGVIINASKGYVLTNNHVIDGADKITGITRWA

SEQ ID NO: 1349 - DNA, 963 bp, Haemophilus influenzae
  Name: NTH0741
gtgggtaaagatgaacaatcagatattgcattagtacagcttgaaaaaccaagtaatttaacagaaatcaaatttgctgattccgacaaattacgcgtaggcgatttcactgttgcaatcggtaatccatttggtttaggtcaaactgtgacatcaggtattgtttctgcattgggtcgttcaacaggttctgacagtggcacttatgaaaactatattcaaaccgatgcagcagtaaaccgcggtaattcgggtggtgcattagtcaatctaaatggcgaacttattggaattaataccgcaattatttctccaagcggtggcaatgcaggaattgcctttgcgattccaagtaatcaagcaagcaatttagtgcaacaaattttagaatttggtcaagtgcgtcgcggattgcttggtattaaagggggcgaactcaatgctgatttagccaaagcctttaatgtaagcgcgcaacaaggcgcatttgtaagtgaagttttaccgaaatctgctgctgaaaaagcaggacttaaagcgggcgatattatcacggcgatgaacggtcaaaaaatctcaagtttcgctgaaattcgtgcaaaaatcgcaaccactggtgcaggcaaagagattagcttgacttacttacgtgatggcaaatcccacgacgttaaaatgaaattacaagcggatgatggtagccaactttcctcaaaaactgagttgcctgcattagatggtgcaacattgaaagactacgatgctaaaggcgttaaaggaattaaaatcacaaaaattcaacctaattcgctggctgcacaacgtggtttaaaatcgggcgatattattattggtattaatcgtcaaatgatcgaaaacattcgtgaattaaataaagtgcttgaaactgaaccgtcagcagttgcacttaatattttacgaggtgacagtaattctatttat

SEQ ID NO: 1350 - protein, 321 aa, Haemophilus influenzae
  Name: NTH0741
VGKDEQSDIALVQLEKPSNLTEIKFADSDKLRVGDFTVAIGNPFGLGQTVTSGIVSALGRSTGSDSGTYENYIQTDAAVNRGNSGGALVNLNGELIGINTAIISPSGGNAGIAFAIPSNQASNLVQQILEFGQVRRGLLGIKGGELNADLAKAFNVSAQQGAFVSEVLPKSAAEKAGLKAGDIITAMNGQKISSFAEIRAKIATTGAGKEISLTYLRDGKSHDVKMKLQADDGSQLSSKTELPALDGATLKDYDAKGVKGIKITKIQPNSLAAQRGLKSGDIIIGINRQMIENIRELNKVLETEPSAVALNILRGDSNSIY

SEQ ID NO: 1351 - DNA, 807 bp, Haemophilus influenzae
  Name: NTH0743
atgaaaattgcattaggcattgagtataacgggcaaaattattatggttggcagagacaagaaaaagtccgtagtgtacaagaagaattagaaaaggcactttctcacattgcaaatgaaaaaattgagatattttgtgcaggcagaacggattctggcgtaagtggaacgggtcaggttgttcattttgaaaccaatgcggttcgtccagagaaggcttgggcttttggtacgaatgctcatttacctgatgacattgcggtggcttgggcaaaacaagtcgatgatgaatttcacgccagattttccgcaacagcacgccgttaccgctatattctttattgtaataaattacgctctgcgattttagcgggaggaataacccattgccatttagatttagatgcggaaaaaatgcatcaggcagggcaatgtttacttggcgaacaggatttttcctctttccgtgcggcacaatgtcagtctcatacgccttggcgtaatgtgcatcatttgaatgtgtctcgtatcggaaaatatattattgttgatattcaggcgaacgcttttgtgcatcatatggtgcgcaatattgtgggaagtttgattgaggtcggtgctggaaatcagccgattgaatggatgcaatggctacttgagcagaaaaatcgtcagcttgctgcaccaacagcaaaaccagatggattgtatttggttgatgtgatttatccacaaaagtttgatattcctaaacgcccgattggtcctttatttttagaggatggtttattaaatcgtactttgaag

SEQ ID NO: 1352 - protein, 269 aa, Haemophilus influenzae
  Name: NTH0743
MKIALGIEYNGQNYYGWQRQEKVRSVQEELEKALSHIANEKIEIFCAGRTDSGVSGTGQVVHFETNAVRPEKAWAFGTNAHLPDDIAVAWAKQVDDEFHARFSATARRYRYILYCNKLRSAILAGGITHCHLDLDAEKMHQAGQCLLGEQDFSSFRAAQCQSHTPWRNVHHLNVSRIGKYIIVDIQANAFVHHMVRNIVGSLIEVGAGNQPIEWMQWLLEQKNRQLAAPTAKPDGLYLVDVIYPQKFDIPKRPIGPLFLEDGLLNRTLK

SEQ ID NO: 1353 - DNA, 1053 bp, Haemophilus influenzae
  Name: NTH0744
ttgggtaaaagacaaaaacactcactaaggaaaggaaaaatgaacactcgtcccttttatttcggacttatatttattgcgattatcgctatacttgctcactatttaggaaacactgatttttcccatcattatcatatcagtgctctaattattgccatcttgctgggaatggcaatcggcaataccatttatccgcaattttcaacacaagtggaaaaaggcgtgttatttgcgaaaggcacgcttcttcgcactggcattgtgctgtatggttttcgccttacttttggcgatattgccgatgttggcttaaatgctgttgtcactgatgcgattatgctaatttcaaccttttttcttaccgcacttttgggcattcgttatctaaaaatggataaacaattggtttatctcactggggctggatgtagtatttgtggtgcggcagcggttatggcggcagagcctgttaccaaagcagaatctcataaagtttcagtagcgattgccgtagtggtcattttcgggacgcttgctatttttacttaccccttgttctacacgtggtcacaagatttaattaacgcccatcaattcggtatttatgttggttctagtgtacacgaagtggctcaagtgtatgcgattggggaaaatattgatcctatcgtggcgaatactgccgtcatttccaaaatgatccgagtgatgatgctcgcaccatttttattaatgctttcttggttattaacacgtagtaatggagtatcagaaaatacatcacacaaaattacaattccttggtttgctgtactttttattggcgttgcgatttttaattcttttgatttattaccaaaagaactcgtgaaattattagttgaaatcgattctttcttattaatttcagcgatggctgcccttggcttaacgacacaagcaagcgcaatcaaaaaggcaggattaaaaccacttgttttaggaacactaatttatttatggctaatggttggtggatttttagtgaattatggaatatcaaaattaata

SEQ ID NO: 1354 - protein, 351 aa, Haemophilus influenzae
  Name: NTH0744
LGKRQKHSLRKGKMNTRPFYFGLIFIAIIAILAHYLGNTDFSHHYHISALIIAILLGMAIGNTIYPQFSTQVEKGVLFAKGTLLRTGIVLYGFRLTFGDIADVGLNAVVTDAIMLISTFFLTALLGIRYLKMDKQLVYLTGAGCSICGAAAVMAAEPVTKAESHKVSVAIAVVVIFGTLAIFTYPLFYTWSQDLINAHQFGIYVGSSVHEVAQVYAIGENIDPIVANTAVISKMIRVMMLAPFLLMLSWLLTRSNGVSENTSHKITIPWFAVLFIGVAIFNSFDLLPKELVKLLVEIDSFLLISAMAALGLTTQASAIKKAGLKPLVLGTLIYLWLMVGGFLVNYGISKLI

SEQ ID NO: 1355 - DNA, 705 bp, Haemophilus influenzae
  n 65, 141: n is any nucleotide
  Name: NTH0745
ttgaacagtaaacaaacacttgcaatcattggcaataatggctctggtaaatcacctctagtganaatgatagcgggcattattccgccaactctgggtcgaattttatttaatgatcgagaattacaatatcaggatgcncaatctagagctaaacatattcgtatggttttccaagatgccaactctgcatttaatccacgtttaaatattggacaaatattagacgaaccattaagcctagcgacagattggacagaaacacaacgtaatgaaaaaatctttgagaccctctctcttgttggactttatcctgattacacaaatctcaatattaagcatctctctatcagccaaaagcagcgggttgccctagcacgcgcattaattttagcaccagaaattattataatagatgatgcaattggcaatttagatgcttctgtacgtattcaattgcttaatttaacccttgatttacaacaacgtttaggtatatcttatatttatgtgggacaggatctcggtgtaattaaacatattgcagatacgattatcgtaatggatgacggaaaaatgattgaatatggcagccctcaaaatctttttactgatccacaaactgatgttactcgtcgcttagtcgaaagctattttggcaaaattttagatgaaaccgcttgggtaaaagacaaaaacactcac

SEQ ID NO: 1356 - protein, 235 aa, Haemophilus influenzae
  Xaa 22: Xaa is any amino acid
  Name: NTH0745
LNSKQTLAIIGNNGSGKSPLVXMIAGIIPPTLGRILFNDRELQYQDAQSRAKHIRMVFQDANSAFNPRLNIGQILDEPLSLATDWTETQRNEKIFETLSLVGLYPDYTNLNIKHLSISQKQRVALARALILAPEIIIIDDAIGNLDASVRIQLLNLTLDLQQRLGISYIYVGQDLGVIKHIADTIIVMDDGKMIEYGSPQNLFTDPQTDVTRRLVESYFGKILDETAWVKDKNTH

SEQ ID NO: 1357 - DNA, 111 bp, Haemophilus influenzae
  Name: NTH0747
atgcccttattacaagtggaagatttaactaaaacttttaaaggtcacgccagtttatttggtcgaaatcaattcaatgcagtggataaagtgagttttacccttgaacag

SEQ ID NO: 1358 - protein, 37 aa, Haemophilus influenzae
  Name: NTH0747
MPLLQVEDLTKTFKGHASLFGRNQFNAVDKVSFTLEQ

SEQ ID NO: 1359 - DNA, 132 bp, Haemophilus influenzae
  Name: NTH0748
atggaaaaaccaagacgattgaaaataaaacaacacgaattttcttgtcattatcctattaatctccgagaaaaaaatttcaaagaaaaaacaaccgccaccccttttatacttaattgcaaaggaaatgaa

SEQ ID NO: 1360 - protein, 44 aa, Haemophilus influenzae
  Name: NTH0748
MEKPRRLKIKQHEFSCHYPINLREKNFKEKTTATPFILNCKGNE

SEQ ID NO: 1361 - DNA, 435 bp, Haemophilus influenzae
  n 430, 431, 432, 433, 434: n is any nucleotide
  Name: NTH0749
atgcccggcttgtattttcatttgccccttatcccggtcttttctgcctgttttttccttctgttttttcttccccctcttttctcccctctctccggcctcctcgttcttttcgcttttttcccttgcccatcttttttttcttatctttccacatccctttgtatattgttatcttctctctattctttcccccgttattctcccgttttctttcctcccctccctccctttcttattgttttttttcttttttgtcattttcttttatttctctcttttcactccgttatctttttattttttatatttctcttttttttttttgatttcttcttcttttttgtgtctattcttatttttctttttattctttcttctatccttggagtgtttcttattgttacattttttgtttcttcctcttttnnnnnt

SEQ ID NO: 1362 - protein, 145 aa, Haemophilus influenzae
  Xaa 144, 145: Xaa is any amino acid
  Name: NTH0749
MPGLYFHLPLIPVFSACFFLLFFLPPLFSPLSGLLVLFAFFPCPSFFSYLSTSLCILLSSLYSFPRYSPVFFPPLPPFLIVFFLFCHFLLFLSFHSVIFLFFIFLFFFFDFFFFFVSILIFLFILSSILGVFLIVTFFVSSSFXX

SEQ ID NO: 1363 - DNA, 741 bp, Haemophilus influenzae
  n 736, 737, 738, 739, 740: n is any nucleotide
  Name: NTH0750
atgcaagcaattaacccaaattggaatgttccaaagaatattcatgcctttaccactactcgtgaagggggcgtgagcttagcgccttatttgagtttcaacttaggcgatcatgtcggtgatgataaaagtgcggtaaaaactaaccgcactttattagtcgaaaaatttggcttgccacaaaaacctatatttttaacgcaaacacacagcactcgagtacttcaattaccttattcaggacaaaatcttgaagcggatgcagtttatacaaatgttcccaatcaagtttgcgttgttatgactgcagactgtttgccagttctattcactacaacatctggcaatgaagtggctgcaacacatgctggctggcgtggtttatgcgatggcgtactagaagaaacagtgaaatattttcaagctaaacctgaagatattattgcgtggtttggccctgcaataggtccaaaggcctttcaagttgggattgatgttgtagaaaagtttgttgcagtagatgaaaaagccaaactcgcctttcaacctgatgcaatcgaagaaggtaaatacttgagtaatctttatcaaattgcaactcagcgattaaacaatctaggtattacgcaaatttatggtggaaatcactgtacattcaacgaaaaagaaaagttcttttcttatcgcagggggattcctctaaaagtcgaacctgcaggcatgcaaagtcagggcnnnnnt

SEQ ID NO: 1364 - protein, 247 aa, Haemophilus influenzae
  Xaa 246, 247: Xaa is any amino acid
  Name: NTH0750
MQAINPNWNVPKNIHAFTTTREGGVSLAPYLSFNLGDHVGDDKSAVKTNRTLLVEKFGLPQKPIFLTQTHSTRVLQLPYSGQNLEADAVYTNVPNQVCVVMTADCLPVLFTTTSGNEVAATHAGWRGLCDGVLEETVKYFQAKPEDIIAWFGPAIGPKAFQVGIDVVEKFVAVDEKAKLAFQPDAIEEGKYLSNLYQIATQRLNNLGITQIYGGNHCTFNEKEKFFSYRRGIPLKVEPAGMQSQGXX

SEQ ID NO: 1365 - DNA, 258 bp, Haemophilus influenzae
  Name: NTH0751
atggcacatattgcccatccattgctaggcgatcaaacctatggcggacgccctcgtccacccaaaaatgcgagtgaagactttatggaagtattgcgtaatttcaaacgccaagctttacatgcggtcatgttacgcttagctcatccaatcacaggggaaattatggaatggtatgcaccattaccagatgactttgttgaattgcttaatgcactcaaagccgactatctcaaacatcaagatgagttagattat

SEQ ID NO: 1366 - protein, 86 aa, Haemophilus influenzae
  Name: NTH0751
MAHIAHPLLGDQTYGGRPRPPKNASEDFMEVLRNFKRQALHAVMLRLAHPITGEIMEWYAPLPDDFVELLNALKADYLKHQDELDY

SEQ ID NO: 1367 - DNA, 108 bp, Haemophilus influenzae
  n 95, 96, 97, 98, 99: n is any nucleotide
  Name: NTH0752
atgggcaatatgtgccatatgaacgcggatttgatgcgtgcgccccgttctaaacgtaaacgtaaacggggtaccgagtccgaatcgtataccannnnnttaattaat

SEQ ID NO: 1368 - protein, 36 aa, Haemophilus influenzae
  Xaa 32, 33: Xaa is any amino acid
  Name: NTH0752
MGNMCHMNADLMRAPRSKRKRKRGTESESYTXXLIN

SEQ ID NO: 1369 - DNA, 594 bp, Haemophilus influenzae
  Name: NTH0753
gtggacgatcgcccttatggtggtggcccaggaatgctgatgatggtgcaacctttacgggatgcgattcatactgcaaaagcagcggcaggagaaggcgcaaaggtgatttacctttcgccacaaggacgtaaacttgatcaagacggcgtaaccgagcttgctcaaaatcagaaattgattttagtatgtggacgttacgaagggattgatgaacggttgattcaaactgaaattgatgaagaatggtcaatcggcgattacgttctaactggtggggaattgccggcaatgacattaattgatgctgttgcacgttttattcctggtgtattaggcaaacaagcctccgcagaagaagattcttttgcagatggtttattagattgcccgcattacaccagaccggaagtgttagaaggattaactgtaccacccgtgctgatgtcgggacatcacgaagaaattcggaaatggcgattaaaacaatcgctacagagaacgtggttccgacgccctgagctcttagaaggcctagctctgactgacgaacaacgtaagctgttaaaagaggcgcaagccgagcataacagt

SEQ ID NO: 1370 - protein, 198 aa, Haemophilus influenzae
  Name: NTH0753
VDDRPYGGGPGMLMMVQPLRDAIHTAKAAAGEGAKVIYLSPQGRKLDQDGVTELAQNQKLILVCGRYEGIDERLIQTEIDEEWSIGDYVLTGGELPAMTLIDAVARFIPGVLGKQASAEEDSFADGLLDCPHYTRPEVLEGLTVPPVLMSGHHEEIRKWRLKQSLQRTWFRRPELLEGLALTDEQRKLLKEAQAEHNS

SEQ ID NO: 1371 - DNA, 348 bp, Haemophilus influenzae
  Name: NTH0754
atgtctaacattatcaaacaacttgaacaagaacaattaaaacaaaacgtacctagcttccgcccaggtgatactttagaagttaaagtatgggtagttgaaggtagcaaacgtcgtttgcaagcattcgaaggcgtggttattgcaattcgtaaccgtggcttgcactcagcatttactttgcgtaaagtatctaacggcgtaggcgttgagcgtgtattccaaactcactctccagctgtagattctatcgcagttaaacgtaaaggtgcggtacgtaaagctaaactttactacttacgtgaacgttcaggtaaatcagctcgtattaaagagcgtttaggcgca

SEQ ID NO: 1372 - protein, 116 aa, Haemophilus influenzae
  Name: NTH0754
MSNIIKQLEQEQLKQNVPSFRPGDTLEVKVWVVEGSKRRLQAFEGVVIAIRNRGLHSAFTLRKVSNGVGVERVFQTHSPAVDSIAVKRKGAVRKAKLYYLRERSGKSARIKERLGA

SEQ ID NO: 1373 - DNA, 969 bp, Haemophilus influenzae
  Name: NTH0755
gtgttagggacaattttacattcagaactggaaaaattttatgatccaaatttgctcgttggcaatgaaactgcagacgatgcggcggtgtatgatcttggtaatggaactgcaattatcagtaccacagacttttttatgccgattgtagatgatccttttgattttggacgaattgccgcgaccaatgccattagtgacatttttgctatgggcggtaagccgattatgggaatcgctattttaggttttccaaccaatgtattacctgcagaagttgcacagaaaattgttgatggtggtcgttttgcttgccatcaagcgggtattgctttggcgggtggacattccattgattcgcctgaacctatttttggtttagccgtgacaggtgtgattgacactgaaaaagtaaaacgtaatgcttctgcaaaatcaggttgtaagctttatatgacaaaaccgcttggtattggtattttgacgacggcggagaaaaaaggaaaacttaagccagaacatcaaggtttagccactgccgctatgtgccaaatgaattctattggcagtcaattttcccaagtggatggcgtcacagcaatgacggatgtcactggatttggtttacttggccatttaattgaaatctgtgaaggttcaaatctaagtgcggtagttttttcggacaaaattaaaaccttggacggagtaaaagattatattgctcaaggttgcgtacccggtggaacagggcgtaattttgaaagttatggacataaagttggcgcattaacggaagaacaaaaagcgattttgtgcgatcctcaaacatcaggtggtttattagtggctgttgagcctaatagcgttcaaactataattgaaatagccaaagatactggcattgatttatatgaagtgggtaaattgaaacctaaatcagaatccgatatcgttgttgaagtaaaa

SEQ ID NO: 1374 - protein, 323 aa, Haemophilus influenzae
  Name: NTH0755
VLGTILHSELEKFYDPNLLVGNETADDAAVYDLGNGTAIISTTDFFMPIVDDPFDFGRIAATNAISDIFAMGGKPIMGIAILGFPTNVLPAEVAQKIVDGGRFACHQAGIALAGGHSIDSPEPIFGLAVTGVIDTEKVKRNASAKSGCKLYMTKPLGIGILTTAEKKGKLKPEHQGLATAAMCQMNSIGSQFSQVDGVTAMTDVTGFGLLGHLIEICEGSNLSAVVFSDKIKTLDGVKDYIAQGCVPGGTGRNFESYGHKVGALTEEQKAILCDPQTSGGLLVAVEPNSVQTIIEIAKDTGIDLYEVGKLKPKSESDIVVEVK

SEQ ID NO: 1375 - DNA, 150 bp, Haemophilus influenzae
  n 108, 122, 145, 146, 147, 148, 149: n is any nucleotide
  Name: NTH0756
atggctgtattgcgtcagcccgaatttttcttccatttcttatttaccttattgaatatcccgtttcgagaaatgactttcaaccctattttttatcgtaagaagctnaacatctttcctgnacggcatatttgcaaatccaaannnnnt

SEQ ID NO: 1376 - protein, 50 aa, Haemophilus influenzae
  Xaa 41, 49, 50: Xaa is any amino acid
  Name: NTH0756
MAVLRQPEFFFHFLFTLLNIPFREMTFNPIFYRKKLNIFPXRHICKSKXX

SEQ ID NO: 1377 - DNA, 705 bp, Haemophilus influenzae
  Name: NTH0758
atgggtcaaaaagtacatccacatggtattcgcctaggtattgttaaaccttggagctctacttggttcgcgaatacacaagacttcgctgacaatcttgaaggcgatttcaaagtacgcaaattcttaaataaagaattagcaaatgcttcagtttcacgtattactattgagcgtccagctaaaagtattcgtgtaactattcacacagctcgtcctggtatcgtaatcggtaaaaaaggcgaagatgttgaaaaattacgtaacgcagtgtctaaaatcgctggcgttcctgctcaaattaacattgctgaagtgaaaaaacctgaattagatgcgaaattagttgcagatagcatcgcttctcaattagaacgtcgtgtaatgttccgtcgtgcaatgaaacgtgcggtacaaagtgctatgcgtttaggtgctaaaggtatcaaagttgaggttagcggtcgtttaggtggtgcagaaatcgcacgttcagaatggtatcgtgaaggtcgcgtacctctacatactcttcgtgcggacatcgattataacactgcagaagctcatacaacttacggcgtaatcggcgttaaagtgtggatcttcaaaggtgaaattcttggtggaatggctgccgttgcgcaatcagaacaacaacctgccgacaagcctaaaaaggctcctcgcggtaaaggtcgtaag

SEQ ID NO: 1378 - protein, 235 aa, Haemophilus influenzae
  Name: NTH0758
MGQKVHPHGIRLGIVKPWSSTWFANTQDFADNLEGDFKVRKFLNKELANASVSRITIERPAKSIRVTIHTARPGIVIGKKGEDVEKLRNAVSKIAGVPAQINIAEVKKPELDAKLVADSIASQLERRVMFRRAMKRAVQSAMRLGAKGIKVEVSGRLGGAEIARSEWYREGRVPLHTLRADIDYNTAEAHTTYGVIGVKVWIFKGEILGGMAAVAQSEQQPADKPKKAPRGKGRK

SEQ ID NO: 1379 - DNA, 330 bp, Haemophilus influenzae
  Name: NTH0759
atggaaactatcgcaaaacatcgttacgctcgcacttctgcccaaaaagctcgcttagttgccgatttaattcgtggtaaaaaagttgcgcaagcattagaaattttaactttcactaacaaaaaagcagcagctttagtgaagaaagttttagaatcagctattgcaaatgcagagcacaatgacggtgcagatattgatgatcttaaagttgctaaaatcttcgttgatgaaggtcctagcatgaaacgtgttatgccacgtgctaaaggtcgtgcagatcgtattttaaaacgtactagccacattactgtggttgtgtcagatcgt

SEQ ID NO: 1380 - protein, 110 aa, Haemophilus influenzae
  Name: NTH0759
METIAKHRYARTSAQKARLVADLIRGKKVAQALEILTFTNKKAAALVKKVLESAIANAEHNDGADIDDLKVAKIFVDEGPSMKRVMPRAKGRADRILKRTSHITVVVSDR

SEQ ID NO: 1381 - DNA, 273 bp, Haemophilus influenzae
  Name: NTH0760
atgccacgttctctcaagaagggtcctttccttgacctacacttgttgaagaaggtagagaaggcggtggaaagcggggataaaaaaccaattaaaacttggtcccgtcgttcaatgatcattccatcaatgatcggattgaccatcgcagtccataatggtcgtcagcacgttcctgtttatgtatctgatgaaatgatcggtcataagcttggtgaatttgcaccgactcgtacataccgcggtcacgcggcagataagaaagctaagaaa

SEQ ID NO: 1382 - protein, 91 aa, Haemophilus influenzae
  Name: NTH0760
MPRSLKKGPFLDLHLLKKVEKAVESGDKKPIKTWSRRSMIIPSMIGLTIAVHNGRQHVPVYVSDEMIGHKLGEFAPTRTYRGHAADKKAKK

SEQ ID NO: 1383 - DNA, 540 bp, Haemophilus influenzae
  Name: NTH0761
gtgctttataaagatggtgaacgccgttatattttagcacctaaaggtttgtcagtaggcgatcaaatccaagctggcataaactcaccaattaaagtgggtaactcattaccaatgcgtaatatcccagttggttcaacagtacataacgttgaattaaaaccaggtaaaggcggtcaaatcgctcgttctgctggtgcttatgtacaaatcatcgcacgtgaaggcaactatgtaactttacgtttacgttctggcgaaatgcgtaaagtattagctgaatgtgttgctacaatcggtgaagttggtaactcagaacatatgcttcgcgtattgggtaaagctggtgctaaccgctggagaggcattcgccctacagttcgtggtactgcaatgaacccagtagatcacccacacggtggtggtgaaggtcgtaactttggtaaacacccagtaactccttggggcgttcaaactaaaggtaagaaaactcgtcacaacaaacgtactgataaatatatcgtacgtcgtcgtggcaaa

SEQ ID NO: 1384 - protein, 180 aa, Haemophilus influenzae
  Name: NTH0761
VLYKDGERRYILAPKGLSVGDQIQAGINSPIKVGNSLPMRNIPVGSTVHNVELKPGKGGQIARSAGAYVQIIAREGNYVTLRLRSGEMRKVLAECVATIGEVGNSEHMLRVLGKAGANRWRGIRPTVRGTAMNPVDHPHGGGEGRNFGKHPVTPWGVQTKGKKTRHNKRTDKYIVRRRGK

SEQ ID NO: 1385 - DNA, 663 bp, Haemophilus influenzae
  n 650, 651, 652, 653, 654: n is any nucleotide
  Name: NTH0762
atgttgcacaattcaggtcgttttggttctaatttccaaattactggtgttgatagtattgccgaagcacataatctttctaccttgttgaaatctggcgcattaattgcaccaattcaaattgttgaagaacgcacaattggcccatcattaggtgcacaaaacgtagagcaagggattaatgcgagtctttggggattagttgctgttattgcctttatgttgttttactacaaaatgtttggtgtgattgcaagttttgcacttgttattaatatcgtattacttgtgggattaatgtctattttacccggtgcgacactttcaatgccgggtattgcgggtatcgttttaactttaggtatgtcagtagatgcgaatgtattgatttttgaacgtattaaagaagaaattcgtaatggtcgttcaattcagcaagccattaatgaaggttataacggtgcatttacttctatttttgatgctaacttaaccacaatcttaaccgcaattattctatacgcggtaggaacaggcccaattcaaggttttgcgattacgctttcacttggtgttgcgatttctatgtttaccgcgattactggaactcgcgcattagttaatgccctttacggcggcaaacaacttannnnnttaattaat

SEQ ID NO: 1386 - protein, 221 aa, Haemophilus influenzae
  Xaa 217, 218: Xaa is any amino acid
  Name: NTH0762
MLHNSGRFGSNFQITGVDSIAEAHNLSTLLKSGALIAPIQIVEERTIGPSLGAQNVEQGINASLWGLVAVIAFMLFYYKMFGVIASFALVINIVLLVGLMSILPGATLSMPGIAGIVLTLGMSVDANVLIFERIKEEIRNGRSIQQAINEGYNGAFTSIFDANLTTILTAIILYAVGTGPIQGFAITLSLGVAISMFTAITGTRALVNALYGGKQLXXLIN

SEQ ID NO: 1387 - DNA, 1218 bp, Haemophilus influenzae
  n 1169, 1207: n is any nucleotide
  Name: NTH0764
ttgtggctctgtgcgttagaaaagaaaaggaaaactatgttaaaccgttatccattatggaagaatttgatggttatttttattgtggccatcgggattttatattctcttccaaatatttatggtgaagatcctgcggtgcaaatttccggtacgcgcggtcaagaagcaaatactagcgtgcttggacaagttcaagatgtgcttaaaaccaataatcttccaaccaaatctatcgtgcttgagaatggctcaattctagctcgttttactaataccgatgatcaacttcttgctaaagataaaattgctgaacgtcttggcaataattacaccaccgcattaaatcttgctccagccactccagcttggttaagtatgtttggtgcgaatcctatgaaatggggattagacttacgcggtggggttcgttttttgatggaagtcgatatgaatgccgcacttgtaaaacgccaagagcaattacaagacagtttgcgtggcgaacttcgcaaagaaaaaattcaatatactgccattaaaaatacagagcattttggtacgttgataaccttagctaatgtgagccagcgtgctaaagctgagcgaattattcgccaattacatccaacattagacattactgagcctgatgctgatagtattaatttagggctatctactgcagcattaaatgaagcacgcgacttagccattgagcaaaacttaacgattttacgtaaacgtgttgctgaattaggtgttgcagaagcggtaattcaacgtcaaggtgctgaacgtattgtgattgaattaccaggtgttcaagacactgcacgcgcaaaagaaattttaggggcaacggcaacacttgagtttcgtatcgtaaatcaaaatgttacagctgatgctatttctcgtaatatgttaccagctgattcggaagttaaatatgatcgccaagggcatcctgttgcattatttaaacgtgccgtattaggtggggagcatatcattaattcaagctctggtttagatcagcattcaagcacgccgcaagtgagtgtaaccttggatagcgaaggtggcgagattatgtctcagaccactaaaaaatattacaaaaaaccaatggcaacgctttatgttgaatataaagataatggcanaaaagatgaaaatggcaaaaccattttagaaaagcagnaaagaagttat

SEQ ID NO: 1388 - protein, 406 aa, Haemophilus influenzae
  Xaa 390, 403: Xaa is any amino acid
  Name: NTH0764
LWLCALEKKRKTMLNRYPLWKNLMVIFIVAIGILYSLPNIYGEDPAVQISGTRGQEANTSVLGQVQDVLKTNNLPTKSIVLENGSILARFTNTDDQLLAKDKIAERLGNNYTTALNLAPATPAWLSMFGANPMKWGLDLRGGVRFLMEVDMNAALVKRQEQLQDSLRGELRKEKIQYTAIKNTEHFGTLITLANVSQRAKAERIIRQLHPTLDITEPDADSINLGLSTAALNEARDLAIEQNLTILRKRVAELGVAEAVIQRQGAERIVIELPGVQDTARAKEILGATATLEFRIVNQNVTADAISRNMLPADSEVKYDRQGHPVALFKRAVLGGEHIINSSSGLDQHSSTPQVSVTLDSEGGEIMSQTTKKYYKKPMATLYVEYKDNGXKDENGKTILEKQXRSY

SEQ ID NO: 1389 - DNA, 291 bp, Haemophilus influenzae
  Name: NTH0765
atggaagcacaaagtccaatgtccacgctatttattttcgtgatctttggtttaattttctactttatgatttatcgcccgcaagctaaacgcaataaagaacacaaaaaattgatgtctgagcttgcaaaaggtactgaagttttaactgctggtggtttaataggcaaaattactaaagtaaccgaaggtagtgatagcatcgtgattgcgttaaacgacacgacagaaattacgattaatcgtaactacattgtgagcgttcttcctaaaggttcattaaaatcactt

SEQ ID NO: 1390 - protein, 97 aa, Haemophilus influenzae
  Name: NTH0765
MEAQSPMSTLFIFVIFGLIFYFMIYRPQAKRNKEHKKLMSELAKGTEVLTAGGLIGKITKVTEGSDSIVIALNDTTEITINRNYIVSVLPKGSLKSL

SEQ ID NO: 1391 - DNA, 219 bp, Haemophilus influenzae
  Name: NTH0766
atgaaatatcagctcaatttaaccgcacttcgatgccccattcctcttttaagtgccaaaaaagccttaaaaaatttgaataaaaatgatgagctaatgttgatcttaaaccttgaaagtgcggtggaaaatttttctatttttgccgaagaaaattctgttgctttagtcgagcaatattacgcttcggaaaaagaatttatcgttatcttgaaaaaa

SEQ ID NO: 1392 - protein, 73 aa, Haemophilus influenzae
  Name: NTH0766
MKYQLNLTALRCPIPLLSAKKALKNLNKNDELMLILNLESAVENFSIFAEENSVALVEQYYASEKEFIVILKK

SEQ ID NO: 1393 - DNA, 546 bp, Haemophilus influenzae
  Name: NTH0767
ttgaccgcactttttaacaaaggaaaccttatgcaaattcttgaacctcaacaattcgccacatggaatgaacctattgaaatgctttatgcttgtcatagtaaagtaaaacgtttttgtcgtcagttaagcattttgcctgattatctagaaaaacacggctatactcaggctgtgttaaatgatgttgagcaaattttaacttatttcaatcgtgccgcaccgttacatcacgatgatgaagaatcagattttttccctcaattagtcaaagtggctccgcaagcacaaacttccattgatgaattagaaaaacagcacgaatatttgcatgaaaattggaatgcattatctgtgcagttagaagagcttatttctgaacaacgtcaaaatattgatgaatatttaattgaacgctttattcaaggttatgatcgtcatattgcgttagaagagccgttatttgaaatggggcgtgaatgcttaagtgcggatattttgactgaaatgggcaagcgcatgagtgctcgtcgtcaagttaaagaa

SEQ ID NO: 1394 - protein, 182 aa, Haemophilus influenzae
  Name: NTH0767
LTALFNKGNLMQILEPQQFATWNEPIEMLYACHSKVKRFCRQLSILPDYLEKHGYTQAVLNDVEQILTYFNRAAPLHHDDEESDFFPQLVKVAPQAQTSIDELEKQHEYLHENWNALSVQLEELISEQRQNIDEYLIERFIQGYDRHIALEEPLFEMGRECLSADILTEMGKRMSARRQVKE

SEQ ID NO: 1395 - DNA, 375 bp, Haemophilus influenzae
  Name: NTH0768
ttgcataaggtttcctttgttaaaaagtgcggtcaaaaaacgcttcatttttctaccgcactttcatcaattatgagttatccgctaattgtaatggtggaacaggtttgcccatgcgagcatagaattccaccacaaaatcatcaaaacgatcatcttcaatcgcttgacgaatttccgccattaaacgttgataatagcgtaaattgtgaatggtatttaagcgtgcacctaaaatttcaccgcatttatctaaatgatataaatacgctttggtgtagtttttacaggtgtagcaatcacattcaggatctaacgggctggtatcatcacgatattttgcatacggattttgacaatgccgtctgtcacaaa

SEQ ID NO: 1396 - protein, 125 aa, Haemophilus influenzae
  Name: NTH0768
LHKVSFVKKCGQKTLHFSTALSSIMSYPLIVMVEQVCPCEHRIPPQNHQNDHLQSLDEFPPLNVDNSVNCEWYLSVHLKFHRIYLNDINTLWCSFYRCSNHIQDLTGWYHHDILHTDFDNAVCHK

SEQ ID NO: 1397 - DNA, 111 bp, Haemophilus influenzae
  Name: NTH0769
atggcggaaattcgtcaagcgattgaagatgatcgttttgatgattttgtggtggaattctatgctcgcatgggcaaacctgttccaccattacaattagcggataactca

SEQ ID NO: 1398 - protein, 37 aa, Haemophilus influenzae
  Name: NTH0769
MAEIRQAIEDDRFDDFVVEFYARMGKPVPPLQLADNS

SEQ ID NO: 1399 - DNA, 1113 bp, Haemophilus influenzae
  n 1108, 1109, 1110, 1111, 1112: n is any nucleotide
  Name: NTH0770
gtgcaaaataaaattaacggcaaaattattttgccgttttctaattcaatgaccaatgtgcttcgccttaaccgaagttacgggagaactatgttaatttcaaatacttataatcaacactttcctcaactgacgcaagaacagcttgcgagaaatgcgacaaaaaaagtgatttgtggtatgtctggtggcgtggattcttctgtgtcagcttttattcttcaacagcaaggctatcaagtggaaggcctgtttatgaaaaactgggaagaagatgacgactctgattattgtactgccgcagctgatcttgcagatgctcaagcagtatgcgataaattagggatcaaactacataaaattaattttgcggcagaatattgggataatgtctttgagcattttttaactgaatataaagcaggacgcacgccgaacccagatattctatgtaataaagaaattaaatttaaagcatttttagaatatgcagctgaagatctcggtgcagattatattgcaacagggcattatgtacgtagagcgggagataatgaaaatgcaaaactattacgtggtttagatgccaataaagatcaaagttattttctttatactttaagccataaacaagtggggcaaagtttattccccgttggtgaaatcgagaagcccattgttcgcgctattgctgaagatcttggcttaattacggcgaagaaaaaagattctaccggtatttgttttattggtgagcgtaaatttaaggatttcttagcacgctatttaccagctcaaccaggtaatattcgcactgtagatgatgaaattattggtcgtcatgatggattaatgtatcacacattgggacaacgcaaaggattgggcattggtggtctaaaaaatgcgggagatgaagcttggtatgtagtagataaagatgtagaaaataatgaacttattgtcgcgcaaggtcacgatcatcctcgtttattttcaaaaggattgattgctagccaattacattgggttgatcgcgaaccaattcgagagtcattacgttgcacggtgaaaacacgtagggtaccgagccgatatcgtatacagnnnnnt

SEQ ID NO: 1400 - protein, 371 aa, Haemophilus influenzae
  Xaa 370, 371: Xaa is any amino acid
  Name: NTH0770
VQNKINGKIILPFSNSMTNVLRLNRSYGRTMLISNTYNQHFPQLTQEQLARNATKKVICGMSGGVDSSVSAFILQQQGYQVEGLFMKNWEEDDDSDYCTAAADLADAQAVCDKLGIKLHKINFAAEYWDNVFEHFLTEYKAGRTPNPDILCNKEIKFKAFLEYAAEDLGADYIATGHYVRRAGDNENAKLLRGLDANKDQSYFLYTLSHKQVGQSLFPVGEIEKPIVRAIAEDLGLITAKKKDSTGICFIGERKFKDFLARYLPAQPGNIRTVDDEIIGRHDGLMYHTLGQRKGLGIGGLKNAGDEAWYVVDKDVENNELIVAQGHDHPRLFSKGLIASQLHWVDREPIRESLRCTVKTRRVPSRYRIQXX

SEQ ID NO: 1401 - DNA, 258 bp, Haemophilus influenzae
  Name: NTH0771
atgcaaactttattttttactttaatcgctttcgtcgcaattatattgttgatgtctatcggctttattatcaaaaaacaaagtttaaaaggcagctgcggtggtttatctagccttggtattgacaaagcttgtgattgtgataaaccttgcgacacgcttcaatcaaaattagatgcaggcgatgaacaagcaaaagctgaatatgagcaaaaatttgcgaaaaaagatgataactcgcaattttatgaagtgaaa

SEQ ID NO: 1402 - protein, 86 aa, Haemophilus influenzae
  Name: NTH0771
MQTLFFTLIAFVAIILLMSIGFIIKKQSLKGSCGGLSSLGIDKACDCDKPCDTLQSKLDAGDEQAKAEYEQKFAKKDDNSQFYEVK

SEQ ID NO: 1403 - DNA, 165 bp, Haemophilus influenzae
  Name: NTH0772
atgactgcagatggcttatctacagggttatttgtgctgggggaagacaaggcgttagaagtggctgagaaaaataatcttgccgtttatttaatcattagaacagataatggttttgttaccaaatcatcctctgctttcaaaaaattaacagaaacaaaagaa

SEQ ID NO: 1404 - protein, 55 aa, Haemophilus influenzae
  Name: NTH0772
MTADGLSTGLFVLGEDKALEVAEKNNLAVYLIIRTDNGFVTKSSSAFKKLTETKE

SEQ ID NO: 1405 - DNA, 105 bp, Haemophilus influenzae
  Name: NTH0773
atgggaatggcaagttctggcgattaccgtatttactttgaagaaaatggcaaacgctttgctcatgaaattgatccgaaacagggtatcccattcagcatcatt

SEQ ID NO: 1406 - protein, 35 aa, Haemophilus influenzae
  Name: NTH0773
MGMASSGDYRIYFEENGKRFAHEIDPKQGIPFSII

SEQ ID NO: 1407 - DNA, 897 bp, Haemophilus influenzae
  Name: NTH0774
atggcattaagtcttgctgcttgtcaaaagaacaaagttatctctttaagcggtaaaacaatggggacaacttatcatgttaaataccttgatgatggttcaataaaagcaacatctgaaaagacgcatgaagaaattgaagcaatcttaaaagatgtgaatgcgaaaatgtccacttacaaaaaagattcggaattgagccgcttcaatcaaaatacccaagtgaacacaccgattgagatttcagcagattttgccaaagtattagctgaagcgattcgtttaaataaagtgaccgaaggcgcgttggatgtaactgttggtccagttgtaaatttatggggatttggtcctgaaaaacgccccgaaaaacaacctacaccagaacaattagctgaacgccaagcctgggttggcattgataaaattgcccttgatatgagtggtgcaaaaccgacattaagcaaagcacttcctcaagtttacgtagatttatcgtcaattgctaaaggttttggcgttgatcaggtggctgaaaagttagaacaactaaatgctcagaattacatggttgaaatcggcggtgaaattcgtgcgaaaggaaaaaatattgaaggtaaaccttggcagattgccattgaaaaaccaactacaacaggcgaaagagcggctgaagctgtcattggattaacaatatgggaatggcaagttctggcgattaccgtatttactttgaagaaaatggcaaacgctttgctcatgaaattgatccgaaacagggtatcccattcagcatcatttagcctcaattacgggacttgcaccaacctcaatgactgcagatggcttatctacagggttatttgtgctgggggaagacaaggcgttagaagtggc

SEQ ID NO: 1408 - protein, 299 aa, Haemophilus influenzae
  Name: NTH0774
MALSLAACQKNKVISLSGKTMGTTYHVKYLDDGSIKATSEKTHEEIEAILKDVNAKMSTYKKDSELSRFNQNTQVNTPIEISADFAKVLAEAIRLNKVTEGALDVTVGPVVNLWGFGPEKRPEKQPTPEQLAERQAWVGIDKIALDMSGAKPTLSKALPQVYVDLSSIAKGFGVDQVAEKLEQLNAQNYMVEIGGEIRAKGKNIEGKPWQIAIEKPTTTGERAAEAVIGLTIWEWQVLAITVFTLKKMANALLMKLIRNRVSHSASFSLNYGTCTNLNDCRWLIYRVICAGGRQGVRSG

SEQ ID NO: 1409 - DNA, 297 bp, Haemophilus influenzae
  Name: NTH0775
ttgggacatagattaattaatttcatcaacggcgttgatacccgtaaagaaacgtcaaaattagcagaggataaattcccagaagaacttatcaatgatacagatactactgggaatatttctaatgaagattgggattggtggtgtcatttatctgatacaatgaagtatatattaatacatgatcttccttatcaagaagaggagattggcatcacagagttttatgatgaaaatgatttggatacagaagcagatatatatgatcgagagacttttagaatcttattaggagaa

SEQ ID NO: 1410 - protein, 99 aa, Haemophilus influenzae
  Name: NTH0775
LGHRLINFINGVDTRKETSKLAEDKFPEELINDTDTTGNISNEDWDWWCHLSDTMKYILIHDLPYQEEEIGITEFYDENDLDTEADIYDRETFRILLGE

SEQ ID NO: 1411 - DNA, 90 bp, Haemophilus influenzae
  n 76: n is any nucleotide
  Name: NTH0776
ttgaattttaaccgcactttaaaaacaaaaaagccaatagatttacactattggcttttattttattactctttgntattaattaagcaa

SEQ ID NO: 1412 - protein, 30 aa, Haemophilus influenzae
  Xaa 26: Xaa is any amino acid
  Name: NTH0776
LNFNRTLKTKKPIDLHYWLLFYYSLXLIKQ

SEQ ID NO: 1413 - DNA, 189 bp, Haemophilus influenzae
  Name: NTH0777
atgaaagctcaagaattacgtacaaaaagtgttgaagagctgaatgctgaattagtaaaccttttaggtgaacaattcaagttgcgtatgcagacagccaccggtcagcttcaacaaacccatcaggctaagcaagtgcgtcgtgatattgcacgtgtaaaaactgtattaaccgaaaaggcgggtgag

SEQ ID NO: 1414 - protein, 63 aa, Haemophilus influenzae
  Name: NTH0777
MKAQELRTKSVEELNAELVNLLGEQFKLRMQTATGQLQQTHQAKQVRRDIARVKTVLTEKAGE

SEQ ID NO: 1415 - DNA, 222 bp, Haemophilus influenzae
  Name: NTH0778
atgtggattagtgtattcccaaataaaccaattactgaagaaccattagaagtccgtatgggtaaaggtaaaggtaacgttgagtactgggtagcattaatccaaccgggtaaagtgctttatgaaatggatggtgtgtctgaagaagtagcaagaaacgcatttgcattagcagctgataaattgccagttaagaccactttcgtaactaagacggtgatg

SEQ ID NO: 1416 - protein, 74 aa, Haemophilus influenzae
  Name: NTH0778
MWISVFPNKPITEEPLEVRMGKGKGNVEYWVALIQPGKVLYEMDGVSEEVARNAFALAADKLPVKTTFVTKTVM

SEQ ID NO: 1417 - DNA, 1005 bp, Haemophilus influenzae
  Name: NTH0779
ttgatcaatctatcatttaacgttgaaggcgataaagcttcaatggaagtgcctgcaccagaagcgggtgttgtaaaagaaattttagtgaaagtgggcgataaagtttcaactggtactccaatgcttgtattagaagcggcaggtgctgctccagcagctgatgagcctactgctccagtagctgatgcgcctactgcaccagtggttgctaccgcaccaacggcttcagctattgtagaagtaaatgtgccagatattggtggcgatgaagtcaatgtaaccgaaattatggttgcagttggcgatacaatcactgaagaacaatctttaattagcgttgaaggcgataaagcctcaatggaagttcctgcaccattcggcggtgtggtaaaagaaattttagtgaaatcaggcgataaagtttcaactggttcattaattatgcgttttgaagtactaggtgcagctccagcagcatcagcatcagcttcaacatcagcaccacagacagcagctcctgctactactgcacaagcaccacaggcagcagctcctgctactactgcacaagcaccacaggcagcagctcctgatactactgcacaagcagctcaatcaaataacaacgtatctggattaagccaagaacaagtagaagcaagtacaggatatgcacacgcaacaccagttattcgtcgtttagctcgtgaatttggtgtaaatctagataaagtaaaaggtactggtcgtaaaggtcgtatcgttaaagaagatattgaagcttatgtgaagaccgcagttaaagcttatgaaagcggtgcaacagcacaagctactggcaatggtgtagcaaatggtgctggattaggcttattgccatggccaaaagttgatttcagtaaatttggcgaaattgaagaagttgaattaagtcgtatcaacaaaatttcaggtgctaacttacatcgaaactgggtaataattcacacgttactcacttcg

SEQ ID NO: 1418 - protein, 335 aa, Haemophilus influenzae
  Name: NTH0779
LINLSFNVEGDKASMEVPAPEAGVVKEILVKVGDKVSTGTPMLVLEAAGAAPAADEPTAPVADAPTAPVVATAPTASAIVEVNVPDIGGDEVNVTEIMVAVGDTITEEQSLISVEGDKASMEVPAPFGGVVKEILVKSGDKVSTGSLIMRFEVLGAAPAASASASTSAPQTAAPATTAQAPQAAAPATTAQAPQAAAPDTTAQAAQSNNNVSGLSQEQVEASTGYAHATPVIRRLAREFGVNLDKVKGTGRKGRIVKEDIEAYVKTAVKAYESGATAQATGNGVANGAGLGLLPWPKVDFSKFGEIEEVELSRINKISGANLHRNWVIIHTLLTS

SEQ ID NO: 1419 - DNA, 105 bp, Haemophilus influenzae
  Name: NTH0781
atgtcaaaacaaattcaaattcctgatattggtagtgatgaagttaccgtaacagaagtgatggtaaacgtaggcgataccatttctgttgatcaatctatcatt

SEQ ID NO: 1420 - protein, 35 aa, Haemophilus influenzae
  Name: NTH0781
MSKQIQIPDIGSDEVTVTEVMVNVGDTISVDQSII

SEQ ID NO: 1421 - DNA, 1647 bp, Haemophilus influenzae
  n 131: n is any nucleotide
  Name: NTH0782
ttgggtcgtatccaagaacttgcgccattagttgctgatatgcccgatgagaaatctgggcattacgccgtggtgcacatgatagcgaaaaattatatgcagcctatgcaaaagcacaaaatgcaccgaancccagttgtgattttagcgcatcaagttaaaggttataaaattcctgaagcggaaagtaaaaataccgctcaccaatctaaaaaaatgtcttacgaaagccttaaaggtttccgtgacttctttgaattaccattaaccgatgaacaagtagaaaaattagaatacattaaatttgctgaaggcacacctgagtatgaatacttacatggtcaccgtaaagcattaaacggttatgttcccgctcgtcgtactaaatttgatgttgaatataaagttcctgcattagaagagtttaaagcattattagaagaacaacctcgtggtatttcaaccactatggcgtttactcgtgcattaaacatcttattaaaagataaaaacatcggtaaaactatcgttccaatgattgcggatgaagcacgtactttcggtatggaaggtttattccgtcaagttggtatttataacccacatggtcaaaactatgtaccttcagaccgtgatttagtggcttactatcgtgaagcaaaagatggtcaagtattacaagaaggtatcaatgaattaggtgcaaccgcatcttggttagcagcagcgaactcgtactctgtcaataaccaaccgatgattccattctttatctattactcaatgttcggtttccaacgtgtgggcgatatgatgtgggctgcaggcgaccaattagctcgtggctttatggtagggggtacttctggtcgtacaaccttaaatggcgaaggtttacaacacgaagacggtcacagccatattcaagcgggcgttattcctaattgcgttacttacgatccatcatttgcatttgaagttgctgttattatgcaagacggtatcaaccgtatgtacggcgaaaaacaagaagatgtattctattatatgactacattaaatgaagtgatggatcaacctgcaatgcctgctggtgcggaagaaggtatccgtaaaggtttatataaatttgaaacagtggaaggtaaaaaaggcaaaggtcacgttcaattattaggttctggtgcgattatgcgtcacgttcgtgaagcggcacaaattcttgcaaatgactacggtgtgacttcagatgtattttctgcgccttcattcaatgaattagcacgcgaaggtcatgatgcagcacgttggaacttattacacccaacagagacacaacgcgtaccatacgttgctcaagtattagctgatttaccaaccgttgcttcaactgactatgtgaaaggttatgctgatcaaatccgtgcatttgtaccaagtaagcactatcatgtattaggtacagacggtttcggtcgttcagatagccgtgcaaacttacgtgaacacttcgaagttgatgcacgttatgttgtggttgctgcactttctcaattagcgaaagaaggtacagtatctaaccaagtggttgcagatgcgattgcgaaattcggtttgaatgtagatcgtatcaatccgctttatgcg

SEQ ID NO: 1422 - protein, 549 aa, Haemophilus influenzae
  Xaa 44: Xaa is any amino acid
  Name: NTH0782
LGRIQELAPLVADMPDEKSGHYAVVHMIAKNYMQPMQKHKMHRXPVVILAHQVKGYKIPEAESKNTAHQSKKMSYESLKGFRDFFELPLTDEQVEKLEYIKFAEGTPEYEYLHGHRKALNGYVPARRTKFDVEYKVPALEEFKALLEEQPRGISTTMAFTRALNILLKDKNIGKTIVPMIADEARTFGMEGLFRQVGIYNPHGQNYVPSDRDLVAYYREAKDGQVLQEGINELGATASWLAAANSYSVNNQPMIPFFIYYSMFGFQRVGDMMWAAGDQLARGFMVGGTSGRTTLNGEGLQHEDGHSHIQAGVIPNCVTYDPSFAFEVAVIMQDGINRMYGEKQEDVFYYMTTLNEVMDQPAMPAGAEEGIRKGLYKFETVEGKKGKGHVQLLGSGAIMRHVREAAQILANDYGVTSDVFSAPSFNELAREGHDAARWNLLHPTETQRVPYVAQVLADLPTVASTDYVKGYADQIRAFVPSKHYHVLGTDGFGRSDSRANLREHFEVDARYVVVAALSQLAKEGTVSNQVVADAIAKFGLNVDRINPLYA

SEQ ID NO: 1423 - DNA, 126 bp, Haemophilus influenzae
  Name: NTH0783
ttggtggaccaacccaaccctatttcggtattgattggcaaatggttgttgaatggtcggttccgagaaaccattcttcatttaaaattacccatgaaaaacggttatcagaatggatcttatgtt

SEQ ID NO: 1424 - protein, 42 aa, Haemophilus influenzae
  Name: NTH0783
LVDQPNPISVLIGKWLLNGRFRETILHLKLPMKNGYQNGSYV

SEQ ID NO: 1425 - DNA, 564 bp, Haemophilus influenzae
  Name: NTH0784
ttgaagaaattatcacaacaagttaattttgctcaatctagcgagctttttgtagaaactgcagacacaaatgaagcaaaggagctttccactttttgtcgtaagtttaccgtgcctttacgtcaggcattgaaaaaacaaggttggctttcggcaaaggcgagtcaaaagtgcggtcaatttttacattgtttttttgtaaaaccgaattgctgctatgtgggatattcttatgtggataatcattcctcccattttatgggaatccctcgtttaaaatttcctgcagatgcgccgagtcgatctacgttaaaactagaagaagctattttgacttttattccgcgtaaagaagagaataaacgtttaaatgaaaatatgattggcgttgatttaggggcttgccctggcggttggacgtatcaattagtcaaacgaggtttatttgtttatgcagttgatcacggaaaaatggcggcgagtttgcatgatacggggtgcattgaacattgcgcggaagacggttttaaatttcagcccccaaaaggaaaaaaggggattggt

SEQ ID NO: 1426 - protein, 188 aa, Haemophilus influenzae
  Name: NTH0784
LKKLSQQVNFAQSSELFVETADTNEAKELSTFCRKFTVPLRQALKKQGWLSAKASQKCGQFLHCFFVKPNCCYVGYSYVDNHSSHFMGIPRLKFPADAPSRSTLKLEEAILTFIPRKEENKRLNENMIGVDLGACPGGWTYQLVKRGLFVYAVDHGKMAASLHDTGCIEHCAEDGFKFQPPKGKKGIG

SEQ ID NO: 1427 - DNA, 168 bp, Haemophilus influenzae
  Name: NTH0785
gtgtatttgggttttgctcgagtgcaagataattcgggctacgtgatttttgaatgttatcaacctgatgaggcagatcgccttgcccgatacattccttttaatcgtttgatttttgctcgtcagatgaatggttatttccgatttcttggaagatttagatcccgc

SEQ ID NO: 1428 - protein, 56 aa, Haemophilus influenzae
  Name: NTH0785
VYLGFARVQDNSGYVIFECYQPDEADRLARYIPFNRLIFARQMNGYFRFLGRFRSR

SEQ ID NO: 1429 - DNA, 111 bp, Haemophilus influenzae
  Name: NTH0786
atgaataaactcgcattatattgtcgcccaggttttgagaaagaagtcgccgcagagattaccgatcaagcaagtcatttaggtgtatttgggttttgctcgagtgcaaga

SEQ ID NO: 1430 - protein, 37 aa, Haemophilus influenzae
  Name: NTH0786
MNKLALYCRPGFEKEVAAEITDQASHLGVFGFCSSAR

SEQ ID NO: 1431 - DNA, 891 bp, Haemophilus influenzae
  Name: NTH0787
atgtataaacgtttgccaccattgaattcactaaaatcttttgagtcggctgctcgttatttaagttttactaaagcagcagatgagctttgtgttacacaggcggcggttagtcatcaaattaaattattagaagaatttttagggattgaattatttaagcgaaagaatcgttctttagaattaacggagcttggtaaagcttattttgttgatattaataaaattctgcgtcgcttaaatgaagcaacagagcgattattaacgttaaaaacggatccgcatttaaatattagcgtgccacaaacttttggtatccaatggttagtgccacatttaagtgaatttaatcagctttatccgcaaattgaggttcgtttaacaggcgtggatcaagatgaaggtttgttaaataaagaaattgatcttgctatttattatggtttgggaaattggcagaatcttcaagtagatcgtctttgcgaagaaaatttattgattttagcctcacctgaattgctagcagaaaatccaattattcagcctgaagatttaaaaaaacacacattaattcacattcatacctgtgataattggcaagcgatggcaaatcatttacagttagatgatttaaatattcagcaagggccgttatttagccatacatttatggcgttacaggcggctattcacgggcaaggtattgtattagctaatcgcttattagccttgcaagaaattgaaaatggctcattgcaagcagtgttgccgactaatttgcctgatccaaaatcattttatgtggtcaatcatcttgatcgccttgatgaccaaaaaattcaagcattccgtcagtggattattaactcaattaaacaagaagaaaatgaa

SEQ ID NO: 1432 - protein, 297 aa, Haemophilus influenzae
  Name: NTH0787
MYKRLPPLNSLKSFESAARYLSFTKAADELCVTQAAVSHQIKLLEEFLGIELFKRKNRSLELTELGKAYFVDINKILRRLNEATERLLTLKTDPHLNISVPQTFGIQWLVPHLSEFNQLYPQIEVRLTGVDQDEGLLNKEIDLAIYYGLGNWQNLQVDRLCEENLLILASPELLAENPIIQPEDLKKHTLIHIHTCDNWQAMANHLQLDDLNIQQGPLFSHTFMALQAAIHGQGIVLANRLLALQEIENGSLQAVLPTNLPDPKSFYVVNHLDRLDDQKIQAFRQWIINSIKQEENE

SEQ ID NO: 1433 - DNA, 477 bp, Haemophilus influenzae
  Name: NTH0788
atgcggatcgcaaaattaatattaaacaccctattaactttatgtattttaggtttagtggctggcggaatgttgtatttccacctaaaatcggaattgccctcagtagaaacattaagaaccgttgaattacaacaaccaatgcagatttatacggctgacggtaaattaattggcgaagtgggcgagcaacgccgtattccagtgaaattagccgatgtgccacaacgcttaattgacgcatttttagcaacggaagacaatcgtttttacgatcatcacggattagaccctatcggcattgctcgtgcattgtttgtcgcagtgagtaatggcggtgcatcacaaggtgcaagtacgattactcaacaattagcgcgtaactttttcttaaccccagaaaaaaccattattcgtaaagcccgtgaagcggtgcttgcggcagaaattgaaaataccctcacccacaagaaatct

SEQ ID NO: 1434 - protein, 159 aa, Haemophilus influenzae
  Name: NTH0788
MRIAKLILNTLLTLCILGLVAGGMLYFHLKSELPSVETLRTVELQQPMQIYTADGKLIGEVGEQRRIPVKLADVPQRLIDAFLATEDNRFYDHHGLDPIGIARALFVAVSNGGASQGASTITQQLARNFFLTPEKTIIRKAREAVLAAEIENTLTHKKS

SEQ ID NO: 1435 - DNA, 492 bp, Haemophilus influenzae
  Name: NTH0790
atgcaattctccctgaaaaattaccgcactttacaaatcggcattcatcgtaagcagggttattttgattttgtgtggtttgatgatcttgaacagccacaaagttatcaaatttttgttaatgatcgtgattttaaaaatcgttttttacaacagctaaaaacacaatatcaagggaaaacctttcctttacagtttgtggcaagcattcccgctcacttaacttggtcgaaagtattaatgttgccacaagtgttaaatgcgcaagaatgtcatcaacaatgtaaatttgtgattgaaaaagagctgcctatttctttaaatgaattatggtttgattatcgttctacctcgttaaagcaaggttttcgattagacgtttctgcaattcgtaaaagtactgctcaaacttatttgcaagattttcagccatttaaaattaatgtattggatgttgcgtcaaatgctatttgggtgcatttcagtattttg

SEQ ID NO: 1436 - protein, 164 aa, Haemophilus influenzae
  Name: NTH0790
MQFSLKNYRTLQIGIHRKQGYFDFVWFDDLEQPQSYQIFVNDRDFKNRFLQQLKTQYQGKTFPLQFVASIPAHLTWSKVLMLPQVLNAQECHQQCKFVIEKELPISLNELWFDYRSTSLKQGFRLDVSAIRKSTAQTYLQDFQPFKINVLDVASNAIWVHFSIL

SEQ ID NO: 1437 - DNA, 132 bp, Haemophilus influenzae
  n 101: n is any nucleotide
  Name: NTH0792
gtgcggtcaaattttcgtgagattgtaaaatttgcgattgctgcgatctttcacagatcgccaaacaatagtcatcttcttgaaataaaaataaggtattntctgaccgcacttgttcatttcacaaaatac

SEQ ID NO: 1438 - protein, 44 aa, Haemophilus influenzae
  Xaa 34: Xaa is any amino acid
  Name: NTH0792
VRSNFREIVKFAIAAIFHRSPNNSHLLEIKIRYXLTALVHFTKY

SEQ ID NO: 1439 - DNA, 504 bp, Haemophilus influenzae
  Name: NTH0794
atgtcgatgaatttattgccttggcgtacttatcaacatcaaaagcgtttacgtcgtttagctttttatatcgctttatttatcttgcttgctattaatttaatgttggcttttagcaatttgattgaacaacagaaacaaaatttgcaagcgcagcaaacatcttttgaacaacttaatcagcaacttcacaaaactaccatgcaaattgatcagttacgcagtgcggtgaaagttggtgaagttttgacatctattcccaacgagcaagtaaaaaagagtttacaacagctaagtgaattaccttttcaacaaggagaactgaataaatttaaacaagatgccaataacttaagtttggaaggtaacgcgcaagatcaaacagaatttgaactgattcatcaatttttaaagaaacattttcccaatgtgaaattaagtcaggttcaacctgaacaagatacattgttttttcactttgatgtggaacaaggggcggaaaaa

SEQ ID NO: 1440 - protein, 168 aa, Haemophilus influenzae
  Name: NTH0794
MSMNLLPWRTYQHQKRLRRLAFYIALFILLAINLMLAFSNLIEQQKQNLQAQQTSFEQLNQQLHKTTMQIDQLRSAVKVGEVLTSIPNEQVKKSLQQLSELPFQQGELNKFKQDANNLSLEGNAQDQTEFELIHQFLKKHFPNVKLSQVQPEQDTLFFHFDVEQGAEK

SEQ ID NO: 1441 - DNA, 402 bp, Haemophilus influenzae
  Name: NTH0795
atgaaagctttttttaacgatccttttactccttttggaaaatggctaagtcagcctttttatgtgcacggtttaacctttttattgctattaagtgcggtgatttttcgccccgttttagattatatcgaggggagttcacgtttccatgaaattgaaaatgagttagcggtgaaacgttcagaattgttgcatcaacagaaaattttaacttctttacagcagcagtcggaaagtcgaaaactttctccagaactggctgcacaaattattcctttgaataaacaaattcaacgtttagctgcgcgtaacggtttatctcacatttacgttgggaaatggggcaaaagcctattttgcatttacagcttacaggtcattttgagaaaacgaagacatttt

SEQ ID NO: 1442 - protein, 134 aa, Haemophilus influenzae
  Name: NTH0795
MKAFFNDPFTPFGKWLSQPFYVHGLTFLLLLSAVIFRPVLDYIEGSSRFHEIENELAVKRSELLHQQKILTSLQQQSESRKLSPELAAQIIPLNKQIQRLAARNGLSHIYVGKWGKSLFCIYSLQVILRKRRHF

SEQ ID NO: 1443 - DNA, 516 bp, Haemophilus influenzae
  Name: NTH0796
ttggctaattcgtcacagctttcagtgagtcgcttgcagtttatcaaacccgaagacaacccattgcaaaccgagatcatttttcagctagataaggaaacaaaatgttacatttggtttttcctgattatattattttttatgaattgcagttggggacaagatcctttcgataaaacacagcgtaaccgttctcagtttgataacgcacaaacagtaatggagcagacagaaataatttcctcagatgtacctaataatctatgcggagcggatgaaaatcgccaagcggctgaaattcctttgaacgctttaaaattggtgggcgtagtgatttctaaagataaagcctttgccttgttgcaagatcaaggtttgcaaatttacagcgttttagagggcgttgatgtggctcaagagggctatattgtagaaaaaatcaaccaaaacaatgttcaatttatgcgtaagctcggagagcaatgtgatagtagtgaatggaaaaaattaagtttt

SEQ ID NO: 1444 - protein, 172 aa, Haemophilus influenzae
  Name: NTH0796
LANSSQLSVSRLQFIKPEDNPLQTEIIFQLDKETKCYIWFFLIILFFMNCSWGQDPFDKTQRNRSQFDNAQTVMEQTEIISSDVPNNLCGADENRQAAEIPLNALKLVGVVISKDKAFALLQDQGLQIYSVLEGVDVAQEGYIVEKINQNNVQFMRKLGEQCDSSEWKKLSF

SEQ ID NO: 1445 - DNA, 99 bp, Haemophilus influenzae
  Name: NTH0797
atggaaaaaattaagtttttaaaggaagattatgaagaaatattttttaaagtgcggttattttttagtgtgtttttgtttgccattaatcgtttttgc

SEQ ID NO: 1446 - protein, 33 aa, Haemophilus influenzae
  Name: NTH0797
MEKIKFLKEDYEEIFFKVRLFFSVFLFAINRFC

SEQ ID NO: 1447 - DNA, 498 bp, Haemophilus influenzae
  n 457, 460, 489, 490, 491, 492, 493: n is any nucleotide
  Name: NTH0798
ttgccattaatcgtttttgctaatcctaaaacagataacgaatgtttttttattcgtttatcgcaagcacctttagctcaaacactggagcaattagcttttcaacaagatgtgaatttagtgatgggtgagaggttagaaggcaatatttctttgaaattaaacaatattgatatgccacgtttgctaaaaataatcgcaaaaagtaagcatcttactttgaataaagatgatggggtttattatttaaacggcagtcaatctggcaaaggtcaagttgcaggaaatcttacgacaaatgaaccgcacttagtcagccacacggtaaaacttcattttgctaaagcctctgaattaatgaaatccttaacaacaggaagtggatctttgctttcttctgcggggagcattactttgatgatcgcagtaattgctggttatcaggagaaccggggtnctntaagtaaaccgcaggcagcaagaaaggcnnnnnttaat

SEQ ID NO: 1448 - protein, 166 aa, Haemophilus influenzae
  Xaa 153, 154, 164, 165: Xaa is any amino acid
  Name: NTH0798
LPLIVFANPKTDNECFFIRLSQAPLAQTLEQLAFQQDVNLVMGERLEGNISLKLNNIDMPRLLKIIAKSKHLTLNKDDGVYYLNGSQSGKGQVAGNLTTNEPHLVSHTVKLHFAKASELMKSLTTGSGSLLSSAGSITLMIAVIAGYQENRGXXSKPQAARKAXXN

SEQ ID NO: 1449 - DNA, 198 bp, Haemophilus influenzae
  Name: NTH0799
ttgtatatttctcaaagggacaaaatgacaaatttacaggaaaatttgaccgcactttcagcagatttagcaacatttgaaagaaaaattcagcatttagccaaagaaatgacaatagatctgtctcactatgaaatcgatcatcttgcattacgggtaaatagtgagcaaactgctaaaaattggctgatactttct

SEQ ID NO: 1450 - protein, 66 aa, Haemophilus influenzae
  Name: NTH0799
LYISQRDKMTNLQENLTALSADLATFERKIQHLAKEMTIDLSHYEIDHLALRVNSEQTAKNWLILS

SEQ ID NO: 1451 - DNA, 1749 bp, Haemophilus influenzae
  Name: NTH0801
ttgaacataggaaaaaacgtgaatattcaatctattctatccgataaaattaaacaagcaatggttattgcaggtgctgatcaatcttgtgatgcgcttgttcgtcaatcaggcaaaccacaatttggcgattatcaagccaacggtattatggctgcagcaaaaaaattaggtttaaatccacgagaatttgctcaaaaagttttagataatcttcaactatctgatattgcagaaaaattagaaatcgcaggtccaggttttatcaatattttcttaaatccaacttggctaacaactgaaatttcagctgcactttcccacaaaaatttaggtattcaagctaccaataaacaaacagttgtgattgattattcctctccaaacgtagcaaaagaaatgcacgtaggtcatttacgctctacgataatcggcgatgctgtagctagaacccttgagtttttaggtcacaatgtcatccgcgctaaccacgtaggcgactggggaacgcaattcggaatgcttattgcttatcttgaaaaaatgcaaaacgaacacgccagtgaaatggaattacaagatcttgaagccttttatcgcgaagccaaaaaacactacgatgaagatgaaatattcgctgaaaaagcacgtaattacgtcgtaaaattacaaagtggagatgaatattgtcgaacgatgtggaaacgtttagtcgatatcactatgcaacaaaatcagcacaactataatcgcttaaacgtgactttaaccgaaaaagatgtaatgggcgaaagtctttataatcctatgttaccaagcatcgtagaagatcttaaaaaacaaggtttggctgtggaaaatgatggtgcattggttgtttatttagatgaatttaaaaataaagatggcgacccaatgggtgtaatcgttcaaaaaaaagacggcggtttcctttatactacaactgatattgctgcagcaaaatatcgttatgaaacattaaaagctaatcgcgcacttgttttttcagatactcgccaaagccaacatatgcaacaagcttggttaattactcgtaaagcaggttatgtaccagacagtttctcgttagagcataaaaactttgggatgatgcttggtaaagatggcaagccatttaaaactcgtactggtggcacggtaaaattagccgatctattaaatgaagccatcgaacgcgccactgtattaattaatgaaaaaaataccaatttatctaatgatgaaaaacaagctgtgattgaggctattggtattggatcggtaaaatatgcagatctatccaaaaaccgcaccacggattacgtttttgattgggataatatgttaagtttcgaaggtaacactgcaccttatatgcaatatgcctacactcgaattcgttcgatctttaataaaacagatataaattcaaccgcacttttggctgcacctttaactattaaagatgataaagaaagaacgcttgcaatcaagcttctacaatttgaagaagccgtgcaaactgtcggaaaagaaggcacaccacacgtgctttgtgcttatttatatgaacttgctggcatcttctcgtcattctatgaacattgcccaattttaaatgctgaaaatgaatctataaaattaagtcgtttgaaattggcattattaacagaaaaaaccttaaaacagggtttaacgttactcggtattaaaaccgtagaaaaaatg

SEQ ID NO: 1452 - protein, 583 aa, Haemophilus influenzae
  Name: NTH0801
LNIGKNVNIQSILSDKIKQAMVIAGADQSCDALVRQSGKPQFGDYQANGIMAAAKKLGLNPREFAQKVLDNLQLSDIAEKLEIAGPGFINIFLNPTWLTTEISAALSHKNLGIQATNKQTVVIDYSSPNVAKEMHVGHLRSTIIGDAVARTLEFLGHNVIRANHVGDWGTQFGMLIAYLEKMQNEHASEMELQDLEAFYREAKKHYDEDEIFAEKARNYVVKLQSGDEYCRTMWKRLVDITMQQNQHNYNRLNVTLTEKDVMGESLYNPMLPSIVEDLKKQGLAVENDGALVVYLDEFKNKDGDPMGVIVQKKDGGFLYTTTDIAAAKYRYETLKANRALVFSDTRQSQHMQQAWLITRKAGYVPDSFSLEHKNFGMMLGKDGKPFKTRTGGTVKLADLLNEAIERATVLINEKNTNLSNDEKQAVIEAIGIGSVKYADLSKNRTTDYVFDWDNMLSFEGNTAPYMQYAYTRIRSIFNKTDINSTALLAAPLTIKDDKERTLAIKLLQFEEAVQTVGKEGTPHVLCAYLYELAGIFSSFYEHCPILNAENESIKLSRLKLALLTEKTLKQGLTLLGIKTVEKM

SEQ ID NO: 1453 - DNA, 300 bp, Haemophilus influenzae
  n 187: n is any nucleotide
  Name: NTH0802
ttgcctagaatgtttaactcaaaaaaaggaaatcttatgttcgttgttatttttgggtcgtcctggctgccctttactgtgtgcgtgcaaaaaacccttgctgaaaaattaaaaggcgaagttgctgattttgactatcgttatgtggatattcatgcagaaggcattactaaagaagatttatcanaatcagttggtaagccagtagaaaccgtaccacaaatctttattgatgaaaaaccaattggtggttgcactgactttgaagcattaatgaaagaacaatttggtatcgttgct

SEQ ID NO: 1454 - protein, 100 aa, Haemophilus influenzae
  Xaa 63: Xaa is any amino acid
  Name: NTH0802
LPRMFNSKKGNLMFVVIFGSSWLPFTVCVQKTLAEKLKGEVADFDYRYVDIHAEGITKEDLSXSVGKPVETVPQIFIDEKPIGGCTDFEALMKEQFGIVA

SEQ ID NO: 1455 - DNA, 1218 bp, Haemophilus influenzae
  Name: NTH0803
atgagaagagctgtaattacaggctttgggattatttcaagtatcggtaacaacaaagaagaagtattggcttcattaaaagaagggaaatcaggtattgaagttgtgcctgagtttgtagaaatgaatatgcgtagccatgttgccggaacaatcaaattaaacccaagcgagcacattgatcgtaaagtgttccgttttatgggtgatgcagcggcttatgcttatctttctatgcgtgaagcgattgaagatgcaggcttaacagaagatcaagtttctaatgatcgtactggtttagtgattggtgcaggtacgggctctgcacataatcaattagtggcttgtgatgcggttcgtggccctcgcggtgtaaaagcgattggtccttacgctgtaacgaaaaccatggcatcaagtgtttcagcttgtttagcaacaccttataaaattcgtggtgtgaattattctatgagttctgcttgtgcaacctctgcacattgtattggtcatgcggttgaattaattcaattaggcaaacaagatatcgtttttgctggtggtgcagaagaattatcttgggaatgtgctactgagtttgatgcaatgggtgcagtttcaactaaatacaatgaaacgccagaaaaagcatctcgtgcttatgacgcaaatcgtgacggtttcgttattgcaggtggtggtgctgttgtggttgtggaagaattagaacacgcacttgctcgtggtgcaaaaatctacgcggaaattgtcggctatggcgcaacttctgacggttacgatatggttgcaccaagtggcgaaggtgcagagcgttgtatgaaacaggcaatggcaactgtagataccccaattgattacatcaacgtacacggtacatctacaccagttggtgacgtgaaagaattaggtgcaatcaaaaatgtatttggcgataaaatcccagcgatttcttcaactaaatcaatgacaggtcactctttaggggcggcgggtgcacacgaagcaatttacacgttgttaatgctggataatgattttattgcgccaagtattaatatcgaaaccttagatgaagccgctgaaggttgcaacatcgttactgagacgaaagaaaatgcaggattacaaactgtcatgtcaaatagctttggttttggtggtacaaatgcgacattaatttttaaacgttataacggt

SEQ ID NO: 1456 - protein, 406 aa, Haemophilus influenzae
  Name: NTH0803
MRRAVITGFGIISSIGNNKEEVLASLKEGKSGIEVVPEFVEMNMRSHVAGTIKLNPSEHIDRKVFRFMGDAAAYAYLSMREAIEDAGLTEDQVSNDRTGLVIGAGTGSAHNQLVACDAVRGPRGVKAIGPYAVTKTMASSVSACLATPYKIRGVNYSMSSACATSAHCIGHAVELIQLGKQDIVFAGGAEELSWECATEFDAMGAVSTKYNETPEKASRAYDANRDGFVIAGGGAVVVVEELEHALARGAKIYAEIVGYGATSDGYDMVAPSGEGAERCMKQAMATVDTPIDYINVHGTSTPVGDVKELGAIKNVFGDKIPAISSTKSMTGHSLGAAGAHEAIYTLLMLDNDFIAPSINIETLDEAAEGCNIVTETKENAGLQTVMSNSFGFGGTNATLIFKRYNG

SEQ ID NO: 1457 - DNA, 411 bp, Haemophilus influenzae
  Name: NTH0804
ttgatctcattgaaaaaaactaagcgaatttttaccgcactttctcacttatttagtcctaaatggtggaaaaaaaactggcagcgagttgtcttttgtttttttttcgccgtttttgctttgttgctgatttttcgctttgtacctattccattttccgcttatatggtacaacaaaaaatcgctaatcttttacaaggcgattttcgatatcaaatccaatataactgggtcagcctagaaaatatctctccaaacattcaattagctgtgatttcatcagaagatcagcgtttttttgaacatttaggctttgattttgaggctatccaacgagcaattcggtataacgaaaaatctaacaaaggaatccgaggggcatcaactatttcccacaaactgctaaaaact

SEQ ID NO: 1458 - protein, 137 aa, Haemophilus influenzae
  Name: NTH0804
LISLKKTKRIFTALSHLFSPKWWKKNWQRVVFCFFFAVFALLLIFRFVPIPFSAYMVQQKIANLLQGDFRYQIQYNWVSLENISPNIQLAVISSEDQRFFEHLGFDFEAIQRAIRYNEKSNKGIRGASTISHKLLKT

SEQ ID NO: 1459 - DNA, 303 bp, Haemophilus influenzae
  Name: NTH0805
atgtatatcagccgtaatttagagcaatggaatgcatttcttcaaatgctaaaaatcgcctttgaagaaaacaaagcacaggaatttctaaccttattattaactgcagacgaacgagatgctgtaggattacgcttgcagattgtctctcagctgattgataaaaatatgcctcagcgtgaaattcaacaaaatctgaatacaagtgccgccacaatcactcgaggttccaatatgattaaaacgatggatcctgattttatgcaatggatgaaacaacatcttgatctcattgaaaaaaac

SEQ ID NO: 1460 - protein, 101 aa, Haemophilus influenzae
  Name: NTH0805
MYISRNLEQWNAFLQMLKIAFEENKAQEFLTLLLTADERDAVGLRLQIVSQLIDKNMPQREIQQNLNTSAATITRGSNMIKTMDPDFMQWMKQHLDLIEKN

SEQ ID NO: 1461 - DNA, 915 bp, Haemophilus influenzae
  n 79: n is any nucleotide
  Name: NTH0806
ttgctatctgccgaatcaaaaagtaagcaagaatggcgttattgggaagctaaacaagatatattaaaaaataccaaanaactgaccgcactttcaaaagagcgtggcttttatccaatgttagcggctacacaattaaaacaagcatatcaactgaatgtccctattgcgtcaagttttactcaagctgaacaacttccttttaagcaagtttttgcaatgattacagaattaagagaacttggacgaaatggtttagcaaaacaacgctggcgaattttacttgataatgttgatttcacaactcagctaaaactttctgaatatgccaaaaatcagcaatggtttgaattagctgttgatgcttctattgtagcaaaagcgtggggttacctgtctcttcgtctgccaaatgcttattctgaatacttcaatgctgcattacagaatttgaatatcagcaaaacttttgctatggcaatcgctcgtcaagaaagtgcttggaatccaatggcacaatcttcagcaaatgcgaggggcttaatgcaacttttgccaagtacggcaaaattgacagcagagaataatcaactaccttatcaaggcgaacaagatttattcaaaccattgaataatattttgctaggtaccgcacatctgaatgaactcaatggaaaatatcctaataatcgaatattgattgcagccgcttataatgcaggagcaaatcgagtagaaaaatggttaagtcgcgcgagtggaaaattagcattagatgaatttgttgcatctattcctttttatgaaactcgtggttatgtgcaaaatgtagtcgcttatgatttttactatcaaattttgcaaaataaagaaaacccacaaatctttagccaagaagaattgaatcggctatac

SEQ ID NO: 1462 - protein, 305 aa, Haemophilus influenzae
  Xaa 27: Xaa is any amino acid
  Name: NTH0806
LLSAESKSKQEWRYWEAKQDILKNTKXLTALSKERGFYPMLAATQLKQAYQLNVPIASSFTQAEQLPFKQVFAMITELRELGRNGLAKQRWRILLDNVDFTTQLKLSEYAKNQQWFELAVDASIVAKAWGYLSLRLPNAYSEYFNAALQNLNISKTFAMAIARQESAWNPMAQSSANARGLMQLLPSTAKLTAENNQLPYQGEQDLFKPLNNILLGTAHLNELNGKYPNNRILIAAAYNAGANRVEKWLSRASGKLALDEFVASIPFYETRGYVQNVVAYDFYYQILQNKENPQIFSQEELNRLY

SEQ ID NO: 1463 - DNA, 801 bp, Haemophilus influenzae
  Name: NTH0807
ttgtatataaaaaaggagcaattaatgaaaatcgtatttttagatagcacggctattcctaaacatatttcaattcctcgcccaagttttgaacatacttggactgaatatgatcatacgtcttctgccgaaaccattgagcgagcgaaggatgcggacattgttattaccagcaaagtgatttttgatcgtgaaactttgcaacaactgccaaaattaaagctgattgcgattactgcgacaggtacaaataatgttgatcttgtggctgcagaagaaatgggcatcgccgtgcgtaatgtgacaggttattccagtacaaccgtgccagaacacgtaatcggtctgattttttctttaaaacacagtttggcaggttggttacgcgatcaaacggaagcaaaatgggcggaaagcaaacaattttgttattttgattatccaattacagatgtgcgcggttcaacgttgggcgtatttggtaaaggttgcctaggaacagaagtggggcgtttggctaatgccgtgggaatgaaagtgctttatgcagaacataaagatgctactgtttgccgtgaaggttatacgccttttgatgaagtattaaaacaagcggatattgtgacgttgcattgcccattaacggaaacaacaaaggatttaattaatacagaaaccttatccaaaatgaaaaaaggtgcatttttgattaatacagggcgtgggcctttgattgatgaacttgccttagttgatgcgttaaaaacggggcatttaggcggagcggctttggatgtaagg

SEQ ID NO: 1464 - protein, 267 aa, Haemophilus influenzae
  Name: NTH0807
LYIKKEQLMKIVFLDSTAIPKHISIPRPSFEHTWTEYDHTSSAETIERAKDADIVITSKVIFDRETLQQLPKLKLIAITATGTNNVDLVAAEEMGIAVRNVTGYSSTTVPEHVIGLIFSLKHSLAGWLRDQTEAKWAESKQFCYFDYPITDVRGSTLGVFGKGCLGTEVGRLANAVGMKVLYAEHKDATVCREGYTPFDEVLKQADIVTLHCPLTETTKDLINTETLSKMKKGAFLINTGRGPLIDELALVDALKTGHLGGAALDVR

SEQ ID NO: 1465 - DNA, 90 bp, Haemophilus influenzae
  Name: NTH0808
ttgccactttctgcgcttgaaggctttgtttcccaaatgaaagccatcgatgatttagtaaaatcttttccagaattggatacctcaatt

SEQ ID NO: 1466 - protein, 30 aa, Haemophilus influenzae
  Name: NTH0808
LPLSALEGFVSQMKAIDDLVKSFPELDTSI

SEQ ID NO: 1467 - DNA, 747 bp, Haemophilus influenzae
  n 615: n is any nucleotide
  Name: NTH0810
atgcaaaataaaattgtaaaaattggcaatattgatgttgcaaacgacaaaccttttgtgctttttggcggaatgaacgtgctggaaagccgtgatatggcaatgcaagtgtgcgaagcttatgtgaaagtgacagagaaacttggcgtgccttatgtatttaaagcgtcttttgacaaagcgaatcgttcatctattcattcttaccgtggacctggcatggaagaaggattaaaaattttccaagaattaaaagatacattcggggtaaaaattattaccgatgtacacgaaatctatcaatgtcagcccgttgctgatgttgtcgatattattcaacttcccgcctttttggcgcgtcaaacagatctcgttgaagcgatggcaaaaacaggcgcagtgattaatgtgaaaaaaccacaatttttaagcccaggtcaaatgggcaatatcgtggaaaaaatcgaagaatgtggtaatgataaaatcattctttgtgatcgtggaacaaattttggttacgataatttaattgtggatatgcttggctttagtgtaatgaaaaaagcctctaagggtagccctgttatttttgatgtaacccattcacttcanatccgtgatccatttggggcagcatcgagtggtcgtcgtgcgcaagtaaccgaattagcgcgttcaggtttagcagtaggcattgcaggtttattcttagaagcacatcccaaatccaaatcaagcaaaatg

SEQ ID NO: 1468 - protein, 249 aa, Haemophilus influenzae
  Xaa 205: Xaa is any amino acid
  Name: NTH0810
MQNKIVKIGNIDVANDKPFVLFGGMNVLESRDMAMQVCEAYVKVTEKLGVPYVFKASFDKANRSSIHSYRGPGMEEGLKIFQELKDTFGVKIITDVHEIYQCQPVADVVDIIQLPAFLARQTDLVEAMAKTGAVINVKKPQFLSPGQMGNIVEKIEECGNDKIILCDRGTNFGYDNLIVDMLGFSVMKKASKGSPVIFDVTHSLXIRDPFGAASSGRRAQVTELARSGLAVGIAGLFLEAHPKSKSSKM

SEQ ID NO: 1469 - DNA, 765 bp, Haemophilus influenzae
  Name: NTH0811
gtgcatttttatcttgttatctctgatgatggcagctcagaagcacaacttcggggaaaaatgggtgggcttgtgcgtaaagcgcgtaaaaaaatttcgccagattggccgaaagaagagcagattcatcagttactacagctattttatggtgattggggctttcattgcgatccagaagattatttttatgctcgcaatttatatttgccttatgtgtttgaacatcgtcaaggaatgccagtgactcttggggcaatggtgttttatttagctgaggcattggatttgccaatttacccagtaaatttcccaacacagttaattttacgtgctgaagtcagagatgaagtggcttttattgatccttgggatggcacttatatttcacaagaaaaattgcagcaactttatgaaggtgcatttgggtttggggcgaaaattcaacccgaagaacttgatagagccgatctttctttactttattctcgctttgagcaactggcgaaaaatgcgcttattcgtgaagagcataacgatatggcatatcactatattaagaatttaatgattactgatgctgaaaatccttatcatatccgtgaccgtggcttagttttagctcaaatgggggcttatccttcagcattgaaagatttagaattttttgtggaacattgtccaaaagatccaacggcggcgtttatccgcacgcaacttttagaacttaaaggcgagattaataaagatacttttcccctccat

SEQ ID NO: 1470 - protein, 255 aa, Haemophilus influenzae
  Name: NTH0811
VHFYLVISDDGSSEAQLRGKMGGLVRKARKKISPDWPKEEQIHQLLQLFYGDWGFHCDPEDYFYARNLYLPYVFEHRQGMPVTLGAMVFYLAEALDLPIYPVNFPTQLILRAEVRDEVAFIDPWDGTYISQEKLQQLYEGAFGFGAKIQPEELDRADLSLLYSRFEQLAKNALIREEHNDMAYHYIKNLMITDAENPYHIRDRGLVLAQMGAYPSALKDLEFFVEHCPKDPTAAFIRTQLLELKGEINKDTFPLH

SEQ ID NO: 1471 - DNA, 252 bp, Haemophilus influenzae
  Name: NTH0812
ttgcatcaaggcgatgtacgttttgaacccctttctgcattagttgccaatgatgcagggtatgctgatttacgtcatattattgaattagcatcgagttatttgaattctaatggcgtattattgcttgaacacggatggcaacaaggagaaaaagtgcggtcaattttccaagaaaatcattgggaaatggttgaaactgtgcgtgattatagcgacaatgagcgtgtcactttaggtttttggaagaag

SEQ ID NO: 1472 - protein, 84 aa, Haemophilus influenzae
  Name: NTH0812
LHQGDVRFEPLSALVANDAGYADLRHIIELASSYLNSNGVLLLEHGWQQGEKVRSIFQENHWEMVETVRDYSDNERVTLGFWKK

SEQ ID NO: 1473 - DNA, 606 bp, Haemophilus influenzae
  Name: NTH0813
atgaattataaagaatggctggcacaagcgattgtagatttagcacaaaaaaatcccactgaaaatagtaaaattgatgcacttgtgcttcttcaacacgctactggcaaatcgcgtacgcaaatccttgcttttgatgatactgagattgatgaaaaagtgcggttaaaattgaccgcacttttagatcgtcgtctaaaaggcgaacctatcgcttatattcttggtgaaaaagaattttggtcgttaccattaaatgtttcaaaaagcacattgattccaagaccagacacggaaagtttagtggaaaaagcattacaaattgcgttagaaaaactggaagaaaatccaccgcactttcgtattcttgatctcggcactggcacaggcgcaatcgccctcgctttggcttccgagcttgagcccatttgccaaaagcggcatattccgctggaaataattggtgttgatcttatgcccgatgttgtggcattagctcaatctaatgcagaaagaaatcagctaaatgtagaatttttgcagagccgttggtttgataatataacagggaagtttgatcttatcgtcagcaatccgcccttatat

SEQ ID NO: 1474 - protein, 202 aa, Haemophilus influenzae
  Name: NTH0813
MNYKEWLAQAIVDLAQKNPTENSKIDALVLLQHATGKSRTQILAFDDTEIDEKVRLKLTALLDRRLKGEPIAYILGEKEFWSLPLNVSKSTLIPRPDTESLVEKALQIALEKLEENPPHFRILDLGTGTGAIALALASELEPICQKRHIPLEIIGVDLMPDVVALAQSNAERNQLNVEFLQSRWFDNITGKFDLIVSNPPLY

SEQ ID NO: 1475 - DNA, 429 bp, Haemophilus influenzae
  Name: NTH0814
ttgaaaataaaaagagctgaattttcttctgctttcaaatcttctcaacctgctcaagcaagccgttttaaacgttggcttgcgagtatgattaatgggcttgtgctttgggtgatggctggtctcggttttgcattgggggattttgccggtgtagtggggatgattgtatatgctggttttcagttatatttcatgaaaacttatggtcaaacaatggcaaaacgctggttaggcttgcgcgtatttaattatcataccaatcatcctgttgaatttggtaaatacatcggtcgtgagattattgatattttattggcatggacaagtttcttattgattattagcggtattgttgcacttgtgcgtgatgatcgccgttctttaacggatttagtggctggcacgatggtgttaaaagacgaaaaa

SEQ ID NO: 1476 - protein, 143 aa, Haemophilus influenzae
  Name: NTH0814
LKIKRAEFSSAFKSSQPAQASRFKRWLASMINGLVLWVMAGLGFALGDFAGVVGMIVYAGFQLYFMKTYGQTMAKRWLGLRVFNYHTNHPVEFGKYIGREIIDILLAWTSFLLIISGIVALVRDDRRSLTDLVAGTMVLKDEK

SEQ ID NO: 1477 - DNA, 567 bp, Haemophilus influenzae
  Name: NTH0815
gtgattggtggaacatcattacaacaagtaccgggtcttgaatggactaaaatgggcgttcctcaagcgatgctaattggtgcaatttacggcattatcgtcactcgtatttccccagtaaaaatcactgaagaatttttcaatggtatgggaaattcttatgcaaacgtacttggtattatcattgcagccagtgtatttgtggcaggattaaaatctacgggcgcagtggatgctgcaatttctttcttaaaagaatccaacgaatttgtacgttggggtgcaacaattggaccattcttaatgggcttaattacaggctctggcgatgcagcagcgattgcctttaacactgccgtcacgccacatgctgtagaactcggctacacccatataaatcttggtatggcagcagccattgctggtgcaattggtcgtacagcttcaccaattgcaggcgtaactattgtttgtgcaggccttgcgatggtaagcccagtagaaatggtaaaacgtaccgcaccaggcatgatacttgctgttttattcttagcattatttatgttg

SEQ ID NO: 1478 - protein, 189 aa, Haemophilus influenzae
  Name: NTH0815
VIGGTSLQQVPGLEWTKMGVPQAMLIGAIYGIIVTRISPVKITEEFFNGMGNSYANVLGIIIAASVFVAGLKSTGAVDAAISFLKESNEFVRWGATIGPFLMGLITGSGDAAAIAFNTAVTPHAVELGYTHINLGMAAAIAGAIGRTASPIAGVTIVCAGLAMVSPVEMVKRTAPGMILAVLFLALFML

SEQ ID NO: 1479 - DNA, 1233 bp, Haemophilus influenzae
  Name: NTH0817
atgaacttagatttaaatcaacttgttaaatggcgtcgtgaatttcatcgttttccagaaattggctggagtgaattttggacaacttctcgcattgcggattacttggaagacttagattgttttgaaatttttcttggcaaacaaattataaatccagactttgttcgtggacgaaaacaagccgtagtagataaaggcttagctaatgcaaaagcctatggagccaatgaaaaatggctcgaaaaaatggaagggtacactggttgtgtggcattatttgattcaggtaaaccagggaaaactattgcattacgttttgacatagactgtgtgaatgtaacggaaactcgctcaccagagcatattccaaataaagaaggttttgcctcaattaacgatggttttatgcatgcttgtggacatgattcacacattacaataggtttaggtgttgcattatggatcgctcagaacaaagataaactcactggaaaagtaaaaattgtatttcaaccagcagaagaaggtgttcgtggtgcagctgccattgcacaaagtggcataattgatgatgcagattattttgcttcttcacacattagtttttgcgcaaatacaggcactgttattgctaatccaagaaattttctttccactacaaaaattgatattcgctataaaggtaaacctgcgcacgcaggtgctgcgccccatttaggtcgtaatgctttattagctgcagcgcatacagtcactcaacttcatggtattgcacgccatggtgaaggcatgacaagaattaatgtgggtgtgctaaaagcgggtgaaggacgaaatgtcattccatcctctgctgaattacaattagaagtgcggggagaaaataaagcaattaatgaatacatgactgaacaagtcatgcaaatagccaaaggtatctccataagttttgatgtcgcatatgaaactgaaattggaggtgaagcagtggatatgaataacgatggtgaacttataaaactcatcgaagaaatatctcttaaacaaccacaaataaataacggaaattcagattatgctttcaatgcgggggaagatgcgactattttaggtagacgtggacaagaacatgggggcaaagctatttactttattcttgggggcgatcggacaggagggcatcccgaggctgaattcgcacgtggggggaatcaattacttactgggggg

SEQ ID NO: 1480 - protein, 411 aa, Haemophilus influenzae
  Name: NTH0817
MNLDLNQLVKWRREFHRFPEIGWSEFWTTSRIADYLEDLDCFEIFLGKQIINPDFVRGRKQAVVDKGLANAKAYGANEKWLEKMEGYTGCVALFDSGKPGKTIALRFDIDCVNVTETRSPEHIPNKEGFASINDGFMHACGHDSHITIGLGVALWIAQNKDKLTGKVKIVFQPAEEGVRGAAAIAQSGIIDDADYFASSHISFCANTGTVIANPRNFLSTTKIDIRYKGKPAHAGAAPHLGRNALLAAAHTVTQLHGIARHGEGMTRINVGVLKAGEGRNVIPSSAELQLEVRGENKAINEYMTEQVMQIAKGISISFDVAYETEIGGEAVDMNNDGELIKLIEEISLKQPQINNGNSDYAFNAGEDATILGRRGQEHGGKAIYFILGGDRTGGHPEAEFARGGNQLLTGG

SEQ ID NO: 1481 - DNA, 99 bp, Haemophilus influenzae
  Name: NTH0818
atgatgattgctttatctgatttctggttgttgcatggttttaaaaataaatcggatattatagaagcttgcaaaaaaattgcaggaacaagatttacc

SEQ ID NO: 1482 - protein, 33 aa, Haemophilus influenzae
  Name: NTH0818
MMIALSDFWLLHGFKNKSDIIEACKKIAGTRFT

SEQ ID NO: 1483 - DNA, 627 bp, Haemophilus influenzae
  Name: NTH0819
ttgtaccaatggttttccccgattctgttagagaatcaagcagcttatgaggctaacaatcttgatttaattaatccagattattgggtgctttacactattgatgcgatgaatatttctttagataaattagatgcaggtttaatttgtttctatttgtttaatattgtacatctcaaaaaaggcgagggaatttcccaagatgctggcattccacacgcttatttgcgtgggcaaaatattgaactgatggcttgttcagataatgtaattcgaggtggtttaacgcctaaatatgtcgatattccagaattgcttaaaattgtcgattgccgtgaagtggagcctaaaattattccaacagcccctcaagacgcacgcatatttacttacgccacgccagcaaaagatttcgatttgcaaaatattcaatatgaatgtggcgaaacacatcatttaaaagcacaaagtgcgagtattttattagtaatgaaagggcagttaaatttacgctcagaaacgaccgcactttctttgaaacaaggtgaggttgcttttattactgcaaatgcttcttatgaagtggacggcttaattgaaggctatgcagtggtcgcaaaattgcct

SEQ ID NO: 1484 - protein, 209 aa, Haemophilus influenzae
  Name: NTH0819
LYQWFSPILLENQAAYEANNLDLINPDYWVLYTIDAMNISLDKLDAGLICFYLFNIVHLKKGEGISQDAGIPHAYLRGQNIELMACSDNVIRGGLTPKYVDIPELLKIVDCREVEPKIIPTAPQDARIFTYATPAKDFDLQNIQYECGETHHLKAQSASILLVMKGQLNLRSETTALSLKQGEVAFITANASYEVDGLIEGYAVVAKLP

SEQ ID NO: 1485 - DNA, 363 bp, Haemophilus influenzae
  Name: NTH0820
atgaaaaaatttgcattagcaacaatcttcgcattagcaaccacttcagcatttgctggttttaatggcaataatagtcaaggtggttttcggcaaacagcgcctgctgcaattagcgtaaagcaagctttatatgcggctgataattcaatgattactttggtgggtaatattacacagcaaattgatgacgatgaattttggtttactgatgggacagggcaaatcaagattgaaatcaaaaaacgcgtttggaatggtttaaacgtagattcaaaggataaagtgaaaatttatggaaaattggataacgaagcctttgagaaagcagaacttgatgtattgcgcgttgaaaaagcagaa

SEQ ID NO: 1486 - protein, 121 aa, Haemophilus influenzae
  Name: NTH0820
MKKFALATIFALATTSAFAGFNGNNSQGGFRQTAPAAISVKQALYAADNSMITLVGNITQQIDDDEFWFTDGTGQIKIEIKKRVWNGLNVDSKDKVKIYGKLDNEAFEKAELDVLRVEKAE

SEQ ID NO: 1487 - DNA, 720 bp, Haemophilus influenzae
  Name: NTH0821
ttgaagatagcgggcgttagctcgctatttttgtctataaagtgcggtcaattttttatgagaattttattgatagaagacgataatctaatcggcaatgggttgcagattggtttaactaaacttggttttgcggtggattggtttaccgatggaaaaacaggaatggctgctttaacctctgcatcttatgatgcggtggtattggatttaaccttgcctaaacttgatggattagatgtattgcaacaatggcgatctaatcatcaagatgttcccgtattaattttgactgctcgtgatactttagatgaacgagttaaaggtttacaaagtggtgcagatgattatctttgcaagccttttgctttggctgaagtcgccgcacgtttacaagcccttattcgtcgtcgttatggatatcatcattctgtgatagaacaggctggtgttaagctagatcagaatcaacgttctgtttggctgaataatcaacccatttctttaacaagccgtgaatataaattgcttgaattatttatgctgaataaagattgcgtattgtctcgctcatccattgaagaaaaattatccagttgggatgaggaaattagcagtggcgcattggatgtgcatatttataatttacgccaaaaattggggaaacaatttattcgcacggtacacggtgttggatatgctttgggacaagttgaaaaa

SEQ ID NO: 1488 - protein, 240 aa, Haemophilus influenzae
  Name: NTH0821
LKIAGVSSLFLSIKCGQFFMRILLIEDDNLIGNGLQIGLTKLGFAVDWFTDGKTGMAALTSASYDAVVLDLTLPKLDGLDVLQQWRSNHQDVPVLILTARDTLDERVKGLQSGADDYLCKPFALAEVAARLQALIRRRYGYHHSVIEQAGVKLDQNQRSVWLNNQPISLTSREYKLLELFMLNKDCVLSRSSIEEKLSSWDEEISSGALDVHIYNLRQKLGKQFIRTVHGVGYALGQVEK

SEQ ID NO: 1489 - DNA, 462 bp, Haemophilus influenzae
  Name: NTH0822
atgaaaaatagaagccttacgttgcgtcttatttctgtgctttgtttaaccgcactttttgtttggctgggttctacgcttgtggcttggtggcaagttcgccacgatgtgaataaagtttttgatgcacaacaagttctctttgctgaacggctcgcaaattcagatttaagtactattttgttggaatctagcacaacgctaaataaaaattcacagtcggtattaaaaaaaagttatgacgatgatgccttagcctttgctattttttctaaaactgggaaacttttattcagtgatggacgaaatggaaaagattttatttttaattataaaacggggttttataatgcgaatatttatgatgatgacgataaatggcgaattttttggcgtatggcagctaatggagaattagttatcgcagtagggcaagaattagattaccgtggaagatttaat

SEQ ID NO: 1490 - protein, 154 aa, Haemophilus influenzae
  Name: NTH0822
MKNRSLTLRLISVLCLTALFVWLGSTLVAWWQVRHDVNKVFDAQQVLFAERLANSDLSTILLESSTTLNKNSQSVLKKSYDDDALAFAIFSKTGKLLFSDGRNGKDFIFNYKTGFYNANIYDDDDKWRIFWRMAANGELVIAVGQELDYRGRFN

SEQ ID NO: 1491 - DNA, 198 bp, Haemophilus influenzae
  Name: NTH0823
gtggaagatttaattgaagaaatgattttggggcaaatgtggatttgggtttggccagttgcctatttggacattggtttaagaagggggattcataaagacttcgacccgattaacggtttaagcccagaacaccatcgaaaaatctgccggatgggctttgccgaacccgaggggtaccccgttcacatttccctt

SEQ ID NO: 1492 - protein, 66 aa, Haemophilus influenzae
  Name: NTH0823
VEDLIEEMILGQMWIWVWPVAYLDIGLRRGIHKDFDPINGLSPEHHRKICRMGFAEPEGYPVHISL

SEQ ID NO: 1493 - DNA, 948 bp, Haemophilus influenzae
  n 884: n is any nucleotide
  Name: NTH0824
atgaaactagatgctccttttaatttagatccaaatgtaaaagtgcgtactcgttttgctcctagccctacaggttatttacatgtaggtggcgcacgtaccgcactttattcttggttatacgcaaaacataataacggcgaatttgtattacgaattgaagacactgatttagagcgttcaacaccagaagcaacggctgccattattgaaggcatggaatggttaaatcttccgtgggagcatggcccttattaccaaactaaacgctttgatcgttataaccaagtgatcgatgaaatgattgaacaaggcttatcatatcgttgttattgtactaaagaacacttagaagaacttcgtcatactcaagaacaaaataaagaaaaaccacgttatgaccgtcactgcttacacgatcacaaccattcacctgatgaaccccatgttgtacgttttaaaaatccaactgaaggctcggtagtatttgatgatgccgtacgtggccgtattgaaatcagcaacagtgagcttgatgatcttattattcgccgcacagacggttctccaacttataacttctgtgtagttgtagatgactgggacatgggtatcacacatgttgtacgtggcgaagatcatatcaacaacacgcctcgtcaaattaacattttaaaagcgattggtgccccgattccaacctatgcacacgtttctatgattaatggcgatgatggtcaaaaactctctaaacgacatggcgcagtgagcgtaatgcaatatcgtgatgatggttacttacccgaagctttaattaactatctgtttcgtttaggctggggacatggcgaccaagaaatttttagtcgcgaagaaatgatcanctatttcgaattagatcacgttagcaaatcagctagcgcatttataccgaaaatttacaatggt

SEQ ID NO: 1494 - protein, 316 aa, Haemophilus influenzae
  Xaa 295: Xaa is any amino acid
  Name: NTH0824
MKLDAPFNLDPNVKVRTRFAPSPTGYLHVGGARTALYSWLYAKHNNGEFVLRIEDTDLERSTPEATAAIIEGMEWLNLPWEHGPYYQTKRFDRYNQVIDEMIEQGLSYRCYCTKEHLEELRHTQEQNKEKPRYDRHCLHDHNHSPDEPHVVRFKNPTEGSVVFDDAVRGRIEISNSELDDLIIRRTDGSPTYNFCVVVDDWDMGITHVVRGEDHINNTPRQINILKAIGAPIPTYAHVSMINGDDGQKLSKRHGAVSVMQYRDDGYLPEALINYLFRLGWGHGDQEIFSREEMIXYFELDHVSKSASAFIPKIYNG

SEQ ID NO: 1495 - DNA, 240 bp, Haemophilus influenzae
  Name: NTH0825
ttgaatcaacattatatccgcgaattaccgccagaatatgtggctaaacatcttgaatggcattacaaagatcaaagcattgatacaagcaatggtcctgcattaactgatattgtctccatgcttgcggaacgttgcaaaaccttaaaagaaatggcaagttcaagccgctacttctttgaagagtttgaaacctttgatgaagccgcagcgaaaaaaacatttcaaaggcaatgctgc

SEQ ID NO: 1496 - protein, 80 aa, Haemophilus influenzae
  Name: NTH0825
LNQHYIRELPPEYVAKHLEWHYKDQSIDTSNGPALTDIVSMLAERCKTLKEMASSSRYFFEEFETFDEAAAKKTFQRQCC

SEQ ID NO: 1497 - DNA, 237 bp, Haemophilus influenzae
  Name: NTH0826
gtgaaagaaaaattaaccgcactttctagctggaatttacattctattcacgaagccattgagcaaacagctgctgaactagaagtgggcatgggtaaagttggcatgccattacgtgtcgctgtgacaggttctggtcaatcgccatcaatggatgttaccctagtcggtatcggcagagatcgcgtacttgtgcgtattcagcgcgctattgattttattcatgcacaaaacgct

SEQ ID NO: 1498 - protein, 79 aa, Haemophilus influenzae
  Name: NTH0826
VKEKLTALSSWNLHSIHEAIEQTAAELEVGMGKVGMPLRVAVTGSGQSPSMDVTLVGIGRDRVLVRIQRAIDFIHAQNA

SEQ ID NO: 1499 - DNA, 126 bp, Haemophilus influenzae
  Name: NTH0827
ttgggagagcgcttgaatggcattcaagaggtcgtcggttcgatcccgattatctccaccaaattaataaagcaaggttatttaccttgcttttttattatcaataatcaatatcttagcgaattt

SEQ ID NO: 1500 - protein, 42 aa, Haemophilus influenzae
  Name: NTH0827
LGERLNGIQEVVGSIPIISTKLIKQGYLPCFFIINNQYLSEF

SEQ ID NO: 1501 - DNA, 135 bp, Haemophilus influenzae
  Name: NTH0828
gtgcgctttttattacatcgttcgaaatcatatcaaggaataattttgcgtccaaataatcgagaaaataatcaaccccgccaaattaaaattacccgtaactacccaagcatgctgaaggggtctgtgccttgg

SEQ ID NO: 1502 - protein, 45 aa, Haemophilus influenzae
  Name: NTH0828
VRFLLHRSKSYQGIILRPNNRENNQPRQIKITRNYPSMLKGSVPW

SEQ ID NO: 1503 - DNA, 834 bp, Haemophilus influenzae
  n 829, 830, 831, 832, 833: n is any nucleotide
  Name: NTH0829
ttggtgcataccggcaatttaaccaactcagtggagttaaaagaaaaagtctttaaaactgcccgccgtcacgtaaacactaattcagattctgaacttcttcttaatattctcgctaatcatcttgatcacattcctcaaaaccatcttgatccacaagatattttctatgctgttcgtaaaactcacaatgatattcgtggtgcttatgcctgcgtagcgatgattattggacacggaatggttgcatttagagatccttttggtattcgtcctttggtgttgggtaaacgtgaagaaaatggcaaaactgattatatgttcgcctctgaaacagtagctttagatattgtgggtttcgagtttgtgcgtgatattgctgcgggcgaagccgtttatgtgacatttgatggcgagctttattcacaacaatgtaccgaaagtgcggtgttaaatccttgtatttttgagtatgtttattttgcacgcccagattcaacgattgatggtgtctctgtttatgcggcacgtgttcatatgggggaaaaactcgggaaaaaaattgcaaaagaatgggcggatgaaattgataatattgatgtggtcattcctattcctgaaacctccacagatattgcgttacaaatagctcgtgttctagggaagccttatcgacaaggatttgtgaaaaatcgctatgttggtcgtacctttattatgccaggtcaagcacagcgtattagttctgttcgtcgcaaattgaataccattaaagctgaatttaaagataaaaatgtgttatggtggggtaccagccgaatcgatccannnnnt

SEQ ID NO: 1504 - protein, 278 aa, Haemophilus influenzae
  Xaa 277, 278: Xaa is any amino acid
  Name: NTH0829
LVHTGNLTNSVELKEKVFKTARRHVNTNSDSELLLNILANHLDHIPQNHLDPQDIFYAVRKTHNDIRGAYACVAMIIGHGMVAFRDPFGIRPLVLGKREENGKTDYMFASETVALDIVGFEFVRDIAAGEAVYVTFDGELYSQQCTESAVLNPCIFEYVYFARPDSTIDGVSVYAARVHMGEKLGKKIAKEWADEIDNIDVVIPIPETSTDIALQIARVLGKPYRQGFVKNRYVGRTFIMPGQAQRISSVRRKLNTIKAEFKDKNVLWWGTSRIDPXX

SEQ ID NO: 1505 - DNA, 1452 bp, Haemophilus influenzae
  n 28: n is any nucleotide
  Name: NTH0830
gtgtctgaattgccatcccaagtaatanagcaaattagtcgagaaatttgccgaattattcgcgagaaaaaattcgaaggcatcagcaatattactgacctttcaaacaaagaagggatccgtattgaaattgatattaaacgtgatgcagtgggggaagtggtattaaaccatctttactcactcactcaaatgcaagtgacctttggtatcaatatggtggcattggatcacggtcagccacgtttatttaatcttaaagaaatcattgaatccttcgttttacaccgccgtgaagtggtgacacgtcgttctatctttgagcttcgcaaagcacgtgaacgtacgcacattttggaaggtttagcggttgctcgttctaatatcgatgaaatgattgcaattattcgcaactctaaaaaccgtgaagaggccgcaacagcaatcagttcacgttcttggacattacatagcgatattattaatcttcttgatgtttccgctcgtcctgatgagttagaagaaaatcttggtattcaaggtgaacagtattacttatcgccagcgcaagtaaacgcaattctagaacttcgcttacaccgtttaacgggcattgcgtttgaagaagttataaaagaatatgaagaattattagttaaaattgcggatcttcttcatattttaagtagcgcagaacgtttaatggaagtgattcgtgaagaattagaagaagtgaaagcacaatttggcgatgatcgtttaactgaaattaccgctgcttctggcgatattgatttagaagatttaatcgcacaagaagacgtggttgtgacgctttctcacgaaggttatgtgaaataccaaccactgactgactatgaagcacaacgccgtggcggtaaaggcaaatctgcaacgaagatgaaagaagaagatttcatcgaaaaattactggtggcaaatactcacgataccatcctctgcttctctagccgtggtcgtttatattggttgaaagtatatcaacttccacaagcaagccgtggtgcacgcggtcgtccaattgtgaatattcttccgttacaagaaaacgaacgtattactgcaatcttgccagtttctgcttacgaagaagataaattcgtagtcatggcaactgctggcggtattgtgaagaaaatcgccttaaccgaatttagccgtccacgttcaaacggtatcatcgcattgaatttacgtgacgaagatgaattaatcggcgtggatattactgatggcagcaacgaaattatgttgttctcatcgcaaggtcgcgtggtgcgttttgctgaaaatgccgtgcgtgcaatggggcgtttagcaacaggtgttcgcggtatcaaactggctttaacaaacgatatttctgacgatgaaagtgcggtagaaattgaagatattctgatgacaacg

SEQ ID NO: 1506 - protein, 484 aa, Haemophilus influenzae
  Xaa 10: Xaa is any amino acid
  Name: NTH0830
VSELPSQVIXQISREICRIIREKKFEGISNITDLSNKEGIRIEIDIKRDAVGEVVLNHLYSLTQMQVTFGINMVALDHGQPRLFNLKEIIESFVLHRREVVTRRSIFELRKARERTHILEGLAVARSNIDEMIAIIRNSKNREEAATAISSRSWTLHSDIINLLDVSARPDELEENLGIQGEQYYLSPAQVNAILELRLHRLTGIAFEEVIKEYEELLVKIADLLHILSSAERLMEVIREELEEVKAQFGDDRLTEITAASGDIDLEDLIAQEDVVVTLSHEGYVKYQPLTDYEAQRRGGKGKSATKMKEEDFIEKLLVANTHDTILCFSSRGRLYWLKVYQLPQASRGARGRPIVNILPLQENERITAILPVSAYEEDKFVVMATAGGIVKKIALTEFSRPRSNGIIALNLRDEDELIGVDITDGSNEIMLFSSQGRVVRFAENAVRAMGRLATGVRGIKLALTNDISDDESAVEIEDILMTT

SEQ ID NO: 1507 - DNA, 162 bp, Haemophilus influenzae
  n 37, 38, 42, 132: n is any nucleotide
  Name: NTH0831
atgcaacatattccggggcccagacttttccacccgnntggnataattaatggtcgtaaagggattgaagaagcctatcgcactggtcgtggtaaagtatatgttcgtgctcgtgcacccgtagaacccaancgaaaaaggacgcgagcaaattatcgtgtc

SEQ ID NO: 1508 - protein, 54 aa, Haemophilus influenzae
  Xaa 13, 44: Xaa is any amino acid
  Name: NTH0831
MQHIPGPRLFHPXGIINGRKGIEEAYRTGRGKVYVRARAPVEPXRKRTRANYRV

SEQ ID NO: 1509 - DNA, 111 bp, Haemophilus influenzae
  n 20, 22: n is any nucleotide
  Name: NTH0832
gtgggaggggggaagagttnantggcccttcccccccgcatacccgaagaacatttggttaaagtgctggataccgagttgcaatacatctggggatcattaatcgcctta

SEQ ID NO: 1510 - protein, 37 aa, Haemophilus influenzae
  Xaa 7, 8: Xaa is any amino acid
  Name: NTH0832
VGGGKSXXALPPRIPEEHLVKVLDTELQYIWGSLIAL

SEQ ID NO: 1511 - DNA, 1749 bp, Haemophilus influenzae
  Name: NTH0833
ttgcaagaaaaccagaaaataggtggttttttaaagtatggaaataatagcaataataaccaaaaaacttatagtactgcactagttttacaaaatgaacaaaaaaatattgatttattattatttggttctgtaagaaatgctggcgattataaaagacccgataatagcaaaattcttttttcaaaaaataatcaaaaaaccggattaataaaagtaaattggcaaatttcacccgagcatttactcacattatcgagtgtttatggtattcataaaggctgggagcctttcgcagcaaaaagagatatcctacctaaaccaagttcgggtgatataatgcgttatggtgctgatattgcttggaaacgtaaactggtttatcgagatcaaaaagataaaaattacacattaaaatacaactatctacctgaaaataacccatggattaacttatctactcagttcagctacagtaaaaccacacaaaatgatactcgccccgaaaaagcccctcctgtatttctgggtacactcggtaatcaaagctggataacttattcagatcttacttttgatataaataacacaagtacttttaatatcaaaagtactcggcatgaactactatttggtttgcaatggttaaaaaacacaagaaatactttaatgtacgataaaagtaaagtgaaaaaagaggactataattatggctattttcaaccttattatatgccttctggacgtcaatatacacaggcactttatttacaagatcaaataacatggaagaatataatttttagcacaggagtgcgttatgaccatatcaataatatagggcagaaaaattttgcaccacaatataatgatatatctgtggggcagaattatagtcagaaaaattataatggctggtcttattatttaggtcttaagtatgatgtaaaccattatttaagtttatttacaaattttagtagaacttggcgtgcacctgttattgatgaacaatatgagacgcaatataagcaatcttctgggcctgtaacagcaacctctttaaatttagaaaaagaaatgattaatcaaacgagagtgggtggaattattactctcaatcatctatttcaggaaaatgatgtttttcaatttagaactacttatttttacaatcgcggcaagaatgaaatatttaaaaccagaggagttaattgtgtaggcaatgctgcagataccaatcatgtttgtcctaaaatcattggaaattatcgtaatttgccaggttatgttattcaaggtgcagagttagaagcttattaccaatctacttatttatttggtgagataacatattcttatgtaaaaggaaaacgtgacacctcaccaagaaacccatggggtaaaacctcaacatggattgcagaaataccccctagaaaagcaactactgctttaggttttaatattcccaaatataattttacagctggctggcgtgctgagtttgtaagaagacaagatcgatcaccattatctggtgaccctgaagcaaaatattggtcattgccagcttcaagaggatatagcctacataacctattcctttcttggagccctgcaaaaattaaaggtatgaatattaagattacagtggataatttattcaatcgagcatacaacccttatctaggcgaattggcttctggaacaggtagaaatatcaaatttagcctatctcagaaattt

SEQ ID NO: 1512 - protein, 583 aa, Haemophilus influenzae
  Name: NTH0833
LQENQKIGGFLKYGNNSNNNQKTYSTALVLQNEQKNIDLLLFGSVRNAGDYKRPDNSKILFSKNNQKTGLIKVNWQISPEHLLTLSSVYGIHKGWEPFAAKRDILPKPSSGDIMRYGADIAWKRKLVYRDQKDKNYTLKYNYLPENNPWINLSTQFSYSKTTQNDTRPEKAPPVFLGTLGNQSWITYSDLTFDINNTSTFNIKSTRHELLFGLQWLKNTRNTLMYDKSKVKKEDYNYGYFQPYYMPSGRQYTQALYLQDQITWKNIIFSTGVRYDHINNIGQKNFAPQYNDISVGQNYSQKNYNGWSYYLGLKYDVNHYLSLFTNFSRTWRAPVIDEQYETQYKQSSGPVTATSLNLEKEMINQTRVGGIITLNHLFQENDVFQFRTTYFYNRGKNEIFKTRGVNCVGNAADTNHVCPKIIGNYRNLPGYVIQGAELEAYYQSTYLFGEITYSYVKGKRDTSPRNPWGKTSTWIAEIPPRKATTALGFNIPKYNFTAGWRAEFVRRQDRSPLSGDPEAKYWSLPASRGYSLHNLFLSWSPAKIKGMNIKITVDNLFNRAYNPYLGELASGTGRNIKFSLSQKF

SEQ ID NO: 1513 - DNA, 429 bp, Haemophilus influenzae
  Name: NTH0834
gtgggatttaaagaattttcacgtttaaaacaagtaaatccagacgcacctgaagcgattattaaaggcacaatgcgtgcgatgaatcttgcgatgaaccgtgagattgaaagtttggaaaaccgagttccatttttagccacagtggcatctgttagcccttatattggtttattcggcactgtttggggaattatgcacgcttttatggcattaagtggtgcaaaacaagcaacgttacagatggtagcaccaggtatcgccgaagcgttgattgccactgcgattggtttatttgccgcaattcctgcagtaatggcttataaccgtttaagcttacgagtgaatgccattgaacaagattacggtaattttattgatgaatttacgacgattttacaccgtcaagcctttggtaaagcccctcac

SEQ ID NO: 1514 - protein, 143 aa, Haemophilus influenzae
  Name: NTH0834
VGFKEFSRLKQVNPDAPEAIIKGTMRAMNLAMNREIESLENRVPFLATVASVSPYIGLFGTVWGIMHAFMALSGAKQATLQMVAPGIAEALIATAIGLFAAIPAVMAYNRLSLRVNAIEQDYGNFIDEFTTILHRQAFGKAPH

SEQ ID NO: 1515 - DNA, 417 bp, Haemophilus influenzae
  Name: NTH0835
atggctcgtcgtcagcgtaaagcaattaaatctgaaattaatattgtgccttttttagatgtgcttttagttttagtgttaatttttatggcaaccgcccctattattagtcaaagcgttcaagttgaattgcctgattctgtgcaaagccaagaggtttctaatgaagataaagtgcccgtcattcttgaagtggcaggcattggaaaatatgcgatttctattggcggagaacgtcaagaaggtttaacagaagaaatggttactcaattatctagacaggaatttgataaggataataatacactatttttagtaggcggagctaaagaagtgccttatgaagaagtgattaaggcattgaatttacttcatcttgcaggcattaaatctgtaggtttaatgacaaatcccatt

SEQ ID NO: 1516 - protein, 139 aa, Haemophilus influenzae
  Name: NTH0835
MARRQRKAIKSEINIVPFLDVLLVLVLIFMATAPIISQSVQVELPDSVQSQEVSNEDKVPVILEVAGIGKYAISIGGERQEGLTEEMVTQLSRQEFDKDNNTLFLVGGAKEVPYEEVIKALNLLHLAGIKSVGLMTNPI

SEQ ID NO: 1517 - DNA, 1011 bp, Haemophilus influenzae
  Name: NTH0836
gtgcaaaataatcgacaaaagaaaggaatcaatgcttttgctatttctatccttttgcactttatcttgtttggcttattgattttaagttcgctttatcacaccgttgaaattatgggtggtggagaaggtgaaggagatgtaataggggcagtgattgttgatactggtacggctgctcaggaatgggggcgtattcaacaacaaaaaaaagggcaagcggataaacaaaaacgcccagaacctgttgtggaagaaaaaccacctgagcctaatcaagaagagattaagcatcaacaagaagttcaacgacaagaagagattaagcatcaacaagaagttcaacgacaagaagagttaaaacgtcagcaagaacagcaacgtcagcaagaaataaaaaaacaacaagagcaagctcgtcaagaagcgttggaaaaacagaagcaagctgaagaggctagggctaaacaagcggctgaagctgcaaaattaaaagcagatgcagaggctaaacgtttagctgctgcggcaaaacaagctgaagaagaggctaaagcgaaagcagcagaaattgctgctcaaaaagcaaaacaagaggcagaaactaaggcgaaactagaagcggaagctaaggcaaaagccgctgctgaagctaaagcaaaggctgaagcggaggcaaaagcgaaagcagcagctgaggcaaaagcaaaggctgaagcggaggcaaaagcgaaagcagcagctgaggcaaaagcaaaagctgatgcagaagctaaagcgaaagccgctgctgaggcaaaagctgctgcggaagcaaaacgtaaagcagatcaagcaagcctagatgatttctttaacggcggagatgttggtggcggtagtgcatctaaagggggaaacacaaataaaggtggaactcaaggtagcggtgctgcacttggctctggcgatggtggtaaggttgtggatcaatacgcaggtgtaattaagaaagagatcaacgtcgtttct

SEQ ID NO: 1518 - protein, 337 aa, Haemophilus influenzae
  Name: NTH0836
VQNNRQKKGINAFAISILLHFILFGLLILSSLYHTVEIMGGGEGEGDVIGAVIVDTGTAAQEWGRIQQQKKGQADKQKRPEPVVEEKPPEPNQEEIKHQQEVQRQEEIKHQQEVQRQEELKRQQEQQRQQEIKKQQEQARQEALEKQKQAEEARAKQAAEAAKLKADAEAKRLAAAAKQAEEEAKAKAAEIAAQKAKQEAETKAKLEAEAKAKAAAEAKAKAEAEAKAKAAAEAKAKAEAEAKAKAAAEAKAKADAEAKAKAAAEAKAAAEAKRKADQASLDDFFNGGDVGGGSASKGGNTNKGGTQGSGAALGSGDGGKVVDQYAGVIKKEINVVS

SEQ ID NO: 1519 - DNA, 882 bp, Haemophilus influenzae
  Name: NTH0837
atggtgttaaatcactcacatattgtgaggttatatctaattaaaattatgtgtcaattactcggaatgaattgtaatacgccgacggatattgttttttcttttgaaggtttccgtcgtcgcgcaggtttaacagattgccattcagatggctttggggtcgctttttttgaaggacgaggtgtacgtatttttcgtgataatcaaacagccagtctttcccccatcgcagattgtgtaaaacaatataatattaaatctcttaatgtcattgcgcatattcgtaaagcaacacaaggcgaagtcaatattgaaaacacccatccgttcattcgtgaaatttggggacaaaactgggtttttgcacataatggtaatttaaaaaacttaccagatatgacagatcattttttacagccaataggttctacagattctgaagctgctttctgttatatggctgagtatcttaaaaatactttccgcaaaaaaccaagtgaaatggaaatttttgaagcaattcaaaaagtaacacaagaacttgctcaacacggtacgtttaatttcattctttctaatggcgagtggatgattgcacattgctcaacaaacttacattatgttatgcgaaaagcaccttttggcaaagctcaccgtattgatgatgatggagtaattgattttagcaattatgcaaaagcaggagataaggtcaatatcatcacaacatttcctttaaccaaagatgaatcttggacaaaaatggaaaatggtggatttgtgttttttaaaaatggagagaaaatcgccgaagttattgggacgccaaaagaagcgattgatgatggtactttaggtaataggacaataaattctgctatt

SEQ ID NO: 1520 - protein, 294 aa, Haemophilus influenzae
  Name: NTH0837
MVLNHSHIVRLYLIKIMCQLLGMNCNTPTDIVFSFEGFRRRAGLTDCHSDGFGVAFFEGRGVRIFRDNQTASLSPIADCVKQYNIKSLNVIAHIRKATQGEVNIENTHPFIREIWGQNWVFAHNGNLKNLPDMTDHFLQPIGSTDSEAAFCYMAEYLKNTFRKKPSEMEIFEAIQKVTQELAQHGTFNFILSNGEWMIAHCSTNLHYVMRKAPFGKAHRIDDDGVIDFSNYAKAGDKVNIITTFPLTKDESWTKMENGGFVFFKNGEKIAEVIGTPKEAIDDGTLGNRTINSAI

SEQ ID NO: 1521 - DNA, 450 bp, Haemophilus influenzae
  Name: NTH0838
atggcattgtttgttggggctcttgtgagtttatttgcttgtaccacaatacatcagccgaagaaaacggttaaatctcgatttttaaagaataatattagccaaactgagttaaataattctgttaattacaagccatatcattatcgttgtaataataaagaaactgggggaatttctcatttgacgacttatttccctctgtcgcgtgaaagccgtatgaaagaaaattttagtttttattttcagttagataatggcaaagcgataccttttgatcatttatatacgctaacactcaatacccgtggtacaaaatttgaagcgatttatcgttcgtatgatccaattcaaggaagttatgtagatttaatcgtgcgatctcaaagttcaatttactacaagaatcaacaaggcaagcaagtaacttggttaaattgcaaaggaggt

SEQ ID NO: 1522 - protein, 150 aa, Haemophilus influenzae
  Name: NTH0838
MALFVGALVSLFACTTIHQPKKTVKSRFLKNNISQTELNNSVNYKPYHYRCNNKETGGISHLTTYFPLSRESRMKENFSFYFQLDNGKAIPFDHLYTLTLNTRGTKFEAIYRSYDPIQGSYVDLIVRSQSSIYYKNQQGKQVTWLNCKGG

SEQ ID NO: 1523 - DNA, 195 bp, Haemophilus influenzae
  Name: NTH0839
ttggaagttaatttcatatttgtaaaaagtgtacaaggtttggaagttaatttccatattttatttttttgtatgtatttggaattacatttccagtttttattgcattttttagtctcattccaatcccttgcacagtccccaatttccgctatcatacgcgcctcttatttctccgaattttgtatttatgaa

SEQ ID NO: 1524 - protein, 65 aa, Haemophilus influenzae
  Name: NTH0839
LEVNFIFVKSVQGLEVNFHILFFCMYLELHFQFLLHFLVSFQSLAQSPISAIIRASYFSEFCIYE

SEQ ID NO: 1525 - DNA, 228 bp, Haemophilus influenzae
  n 215, 216, 217, 218, 219: n is any nucleotide
  Name: NTH0840
ttgaccgtgagaagcataactaccacattcgtttctaatttctgcaatataatgcaaaatcgaaccacaaaattatccgcactttcgggcggttggttacgcaaagcggcactagcacgtgcattggtatgcgatcctgatgtgttattacttgatgaaccaaccacttggatgtggaagttattgaatggctggaaaatttcttactggatttnnnnnttaattaat

SEQ ID NO: 1526 - protein, 76 aa, Haemophilus influenzae
  Xaa 72, 73: Xaa is any amino acid
  Name: NTH0840
LTVRSITTTFVSNFCNIMQNRTTKLSALSGGWLRKAALARALVCDPDVLLLDEPTTWMWKLLNGWKISYWIXXLIN

SEQ ID NO: 1527 - DNA, 120 bp, Haemophilus influenzae
  Name: NTH0841
atggaaacaatatataaaatttcatattcacaagcattatttgctcaagatcctgatacctatagagaaatggtattggagtttgagcaaatagaatatgaacggttgatggacacgctc

SEQ ID NO: 1528 - protein, 40 aa, Haemophilus influenzae
  Name: NTH0841
METIYKISYSQALFAQDPDTYREMVLEFEQIEYERLMDTL

SEQ ID NO: 1529 - DNA, 93 bp, Haemophilus influenzae
  Name: NTH0842
atgctcaacgaaaacgatatcgaacaactcactcttcaacgcctgcaatccctcggttgggaatatcgctacggtaaagatttgcctgttcat

SEQ ID NO: 1530 - protein, 31 aa, Haemophilus influenzae
  Name: NTH0842
MLNENDIEQLTLQRLQSLGWEYRYGKDLPVH

SEQ ID NO: 1531 - DNA, 90 bp, Haemophilus influenzae
  Name: NTH0843
ttgcaacaggatctaactcagttatctaatgaacaggcaaatctttaccgtagcgatattcccaaccgagggattgcaggcgttgaagag

SEQ ID NO: 1532 - protein, 30 aa, Haemophilus influenzae
  Name: NTH0843
LQQDLTQLSNEQANLYRSDIPNRGIAGVEE

SEQ ID NO: 1533 - DNA, 159 bp, Haemophilus influenzae
  Name: NTH0844
atgtcattaacttatctcgatttattttctggtgctggcggtctttctctaggatttgattatgctggatttcgccagttactttccattgagttagagccagtatattgtgaaacctaccgcgttaattttccgcatcatcgatcttgcaacaggatc

SEQ ID NO: 1534 - protein, 53 aa, Haemophilus influenzae
  Name: NTH0844
MSLTYLDLFSGAGGLSLGFDYAGFRQLLSIELEPVYCETYRVNFPHHRSCNRI

SEQ ID NO: 1535 - DNA, 552 bp, Haemophilus influenzae
  Name: NTH0845
atgtggtgggtaaattggggacttcaaaccgtttcgcccgtggaacttgaaaatgcgattcatgctcgtcctgaaactggatttggcattatgagtgaagcagaattaaaagatgctgtcgcacaagctaaagcgcgcggtgaaaaaattgtgatgactaatggctgttttgatattttgcatccagggcatatttcttatttagaaaatgcacgcaaattgggcgatcgtctaattgttgcggtaaacagcgacgattctgttaaacgcttaaaaggcgaaagtcgtccaattaataatcttgaaaaccgtatggcggtattggctggtttggcatccgtggactggttggtgcctttcactgaagatacaccacaacgtttaatcggcgaaattctaccagatcttttagtcaaaggtggcgattacaaacccgaagagattgcaggcagtaaagaagtttgggcaaacggtggcgatgttaaagtgctaaactttgaaaatggttgttcaacaacaaatgtgattgaaaaaattaaattattgaaagat

SEQ ID NO: 1536 - protein, 184 aa, Haemophilus influenzae
  Name: NTH0845
MWWVNWGLQTVSPVELENAIHARPETGFGIMSEAELKDAVAQAKARGEKIVMTNGCFDILHPGHISYLENARKLGDRLIVAVNSDDSVKRLKGESRPINNLENRMAVLAGLASVDWLVPFTEDTPQRLIGEILPDLLVKGGDYKPEEIAGSKEVWANGGDVKVLNFENGCSTTNVIEKIKLLKD

SEQ ID NO: 1537 - DNA, 105 bp, Haemophilus influenzae
  Name: NTH0846
atgaccaatcaacaagactatactcaagacaatgacaaactttaccgttatcttttccaacatcgtgcagttcgtggagaatgggttcgcttaaataaaacttta

SEQ ID NO: 1538 - protein, 35 aa, Haemophilus influenzae
  Name: NTH0846
MTNQQDYTQDNDKLYRYLFQHRAVRGEWVRLNKTL

SEQ ID NO: 1539 - DNA, 1167 bp, Haemophilus influenzae
  Name: NTH0847
gtgcggtcaattccgcaagcaattgttcaagatgatgctgaagatattcatagatgggttgagagtaagctaattgataaagtaggcaaccttggtaaaaaattacatactggtcgtagccgcaccgatcaagtggcagtagatataaaactgtggtgcaaacagcgtgtggttgaattacaagaatccgtgcgtaatttgcaccgccacttagttcaaaccgcagaaaacacacagcaagcagtaatgcctggctacacccatttacaacgagctcaaccaatcacttttgcccattggtgtatggcatatgtggaaatgttcgaccgcgactattcacgtttaacagatgcgtataatcgtatgaatacttgtccacttggtagtggtgcgctggctggtacggcttatgctgtagatcgtgattcacttgcgcacgatcttagttttgctttcgcaactagaaatagcttagatagcgtctctgatcgcgatcatatcgtagaattactttctatcgcctctcttagtatggcacatctttcccgctttgctgaagatatgattatctttaacagcggagaagcaaatttcgtggaactatccgatcgtgtgacttctggttcatcattaatgccacaaaagaaaaatcctgatgcttgtgagttaattcggggcaaaacggggagagtaattggttcattaacatctatgttaatcaccttaaaaggcttgccacttgcgtataataaagatatgcaagaagacaaagagggcatttttgatgccttagatacttggcaaaactgtgtagatatggcaacgttcgtcttagatgaattgaaagtaaatgttgaacgtactcgtgaagctgcgttaaaaggatattcaaacgcaactgaattagcggattatttagtctctaaaggcgtacctttccgagattcccatcatatcgtgggcgaaacagtggtttatgcaatcgagaaaggcaaaggattagaagatctgactatccctgaattccgccaatttagtgaagtagtgggagatgacgtttacgagattctttctctccaatcttgcttagacaaacgttgtgcaaaaggtggcgtatcgccattgcgtgttgccgaagctattgcagaagccaaaacaagatttgct

SEQ ID NO: 1540 - protein, 389 aa, Haemophilus influenzae
  Name: NTH0847
VRSIPQAIVQDDAEDIHRWVESKLIDKVGNLGKKLHTGRSRTDQVAVDIKLWCKQRVVELQESVRNLHRHLVQTAENTQQAVMPGYTHLQRAQPITFAHWCMAYVEMFDRDYSRLTDAYNRMNTCPLGSGALAGTAYAVDRDSLAHDLSFAFATRNSLDSVSDRDHIVELLSIASLSMAHLSRFAEDMIIFNSGEANFVELSDRVTSGSSLMPQKKNPDACELIRGKTGRVIGSLTSMLITLKGLPLAYNKDMQEDKEGIFDALDTWQNCVDMATFVLDELKVNVERTREAALKGYSNATELADYLVSKGVPFRDSHHIVGETVVYAIEKGKGLEDLTIPEFRQFSEVVGDDVYEILSLQSCLDKRCAKGGVSPLRVAEAIAEAKTRFA

SEQ ID NO: 1541 - DNA, 885 bp, Haemophilus influenzae
  Name: NTH0848
atgaaagcaattattcctgtcgccggtcttggcacacgtatgttgcccgccacgaaggcgattccgaaggaaatgctcactttggtggataaaccgttaattcaatacgtggtaaatgaatgtgtagctgctggcataaaagaaattgtgctggtaacacattcatcaaaaaatgctatcgaaaaccattttgatacatcttttgaattagaaacaatgctggaaaaacgtgtgaagcgtcagcttctagaagaagttcgttctatctgtccaaaaaatgtaaccattatgcacgttcgtcaaggtaatgcgaaaggtttaggtcacgccgtgttatgcggtcgtcctttagtaggaaatgaatcttttgccgttatgttaccagatgtattattagctgaatttagtgcagatcagaaaaaagaaaatcttgctgcaatgattcaacgctttaatgaaactggcgcaagccaaattatggtaaccccagttccgcaagaaaatgtgagtagctatggtgttgcagattgtggtggcattgagcttaatggcggcgaaagtgcaaaaattaatagtattgttgaaaaaccttctattgaagacgcaccatcaaatcttgctgtggttgggcgttatgttttttcagcagcaatttgggatttgttagaaaaaacaccaattggtgttggcgatgaaatccaattaaccgatgctattgatatgctcattgaaaaagaaaccgttgaagcatttcatatgacaggggaaacttttgattgtggcgataaaattggttatatggaagctttcgtagaatatggtattcgtcacgaaaaattaggtaaagaatttaaatcctttatcaaaaatttggcaaaaacgcta

SEQ ID NO: 1542 - protein, 295 aa, Haemophilus influenzae
  Name: NTH0848
MKAIIPVAGLGTRMLPATKAIPKEMLTLVDKPLIQYVVNECVAAGIKEIVLVTHSSKNAIENHFDTSFELETMLEKRVKRQLLEEVRSICPKNVTIMHVRQGNAKGLGHAVLCGRPLVGNESFAVMLPDVLLAEFSADQKKENLAAMIQRFNETGASQIMVTPVPQENVSSYGVADCGGIELNGGESAKINSIVEKPSIEDAPSNLAVVGRYVFSAAIWDLLEKTPIGVGDEIQLTDAIDMLIEKETVEAFHMTGETFDCGDKIGYMEAFVEYGIRHEKLGKEFKSFIKNLAKTL

SEQ ID NO: 1543 - DNA, 189 bp, Haemophilus influenzae
  n 28, 31, 46, 68: n is any nucleotide
  Name: NTH0849
ttggcatggcctgcaggtcgactcttanggnatcccctcatggggnagatatttctatcacggttttngagtgtacgtggaaaccaagtcaaactcggtgttgaagcacctaaagaagtatccgttcaccgagaagaaatttaccaacgaattaaacaaacgaaagatgaaccctatttaggttcctct

SEQ ID NO: 1544 - protein, 63 aa, Haemophilus influenzae
  Xaa 10, 11, 16, 23: Xaa is any amino acid
  Name: NTH0849
LAWPAGRLLXXPLMGXIFLSRFXSVRGNQVKLGVEAPKEVSVHREEIYQRIKQTKDEPYLGSS

SEQ ID NO: 1545 - DNA, 1383 bp, Haemophilus influenzae
  Name: NTH0850
atgttggaacaagttgaaaacttacataatttctatgcccgttttctgcctcaacaaagtctttcagccattgttccagtggttattttcattgctgtatttcccttgaactgggctgcaggcttaatcttaatgattaccgcaccgcttgttcctctgtttatgatcattgtcggtattgctgcggctgacaacagccaaaaaaatatggataccctttctcgcctcagtgcccaatttttagatcgcttacgcggtttggaaaccttgcgtctttttaaccgcacttctgaacaaactgagcatattgaaaatgccactgaagatttccgtgaaaccacaatggatgtgctaaaactcgcttttctctcttctgcagtattggaattttttacctctatttccattgcactgatggcggtctattttggttttagctacttaggtcaaattgaatttggtacctataatgcaccgcttacacttttcacaggtttcttttgtttaattcttgcacctgaattttatcaacccttacgcgatctaggcacctattaccacgaccgtgcagcaggtattggtgcagcggatgccattgttgattttttagaatctgattatttaactgtacatcaaaatgaaaaaacaatttctttagaaagtgcggttgaaatttctgccgaaaatttagtggtgctttcgacacagggttcagcattaaccaagccgttaaacttccaaattccagcaaatcataatgttgcgcttgtaggacaaagtggcgcgggaaaaacttcattaataaatgcgattctgggctttttaccttatgagggctcgctcaaaattaatgggcaagaacttcgcgaaagtaatctagctgactggcgcaaacatattgcgtgggtaggacaaaatccattgttattacaaggcacaattaaagaaaacttactacttggcaatattcaagccaacgatgaagaaattaatcaagctttaatgcgttctcaagcgaaagaatttaccgataaacttggacttcatcacgaaataaaagatggtggattaggcatttctgtgggacaagcgcaacgccttgccattgctcgggcattgttacgcaaaggcgatttacttctgctcgatgagccaaccgcaagcctagatgcgcaatcagaaaatcttgttttacaagcattgaatgaagcaagtcagcatcaaactacactgatgattacacaccgaattgaagatttgaaacaatgtgatcaaatttttgtgatgcaacgaggagaaatagtacagcaaggtaaatttaccgaattacaacatcaaggtttctttgctgaactactcgctcaacgacaacaggatatccaa

SEQ ID NO: 1546 - protein, 461 aa, Haemophilus influenzae
  Name: NTH0850
MLEQVENLHNFYARFLPQQSLSAIVPVVIFIAVFPLNWAAGLILMITAPLVPLFMIIVGIAAADNSQKNMDTLSRLSAQFLDRLRGLETLRLFNRTSEQTEHIENATEDFRETTMDVLKLAFLSSAVLEFFTSISIALMAVYFGFSYLGQIEFGTYNAPLTLFTGFFCLILAPEFYQPLRDLGTYYHDRAAGIGAADAIVDFLESDYLTVHQNEKTISLESAVEISAENLVVLSTQGSALTKPLNFQIPANHNVALVGQSGAGKTSLINAILGFLPYEGSLKINGQELRESNLADWRKHIAWVGQNPLLLQGTIKENLLLGNIQANDEEINQALMRSQAKEFTDKLGLHHEIKDGGLGISVGQAQRLAIARALLRKGDLLLLDEPTASLDAQSENLVLQALNEASQHQTTLMITHRIEDLKQCDQIFVMQRGEIVQQGKFTELQHQGFFAELLAQRQQDIQ

SEQ ID NO: 1547 - DNA, 282 bp, Haemophilus influenzae
  Name: NTH0851
atgggcttcgcgcacaacaaagaacctatcaaaaaattaatgcgtgcaaacattgtcttagctacgctttcttcattcattttagtcgcacaaacttattttcttgcgacgttgctcgataaactgattatgcaaaatgtgcctcgtgatgaacttattccttattttctcgggctaattatcggcttcgggatgcgtgctattattttatgggcacgcgaaaaaaataggtttccaaagcggacaattattacgcaaccatattcgtcaaaaaattctgga

SEQ ID NO: 1548 - protein, 94 aa, Haemophilus influenzae
  Name: NTH0851
MGFAHNKEPIKKLMRANIVLATLSSFILVAQTYFLATLLDKLIMQNVPRDELIPYFLGLIIGFGMRAIILWAREKNRFPKRTIITQPYSSKNSG

SEQ ID NO: 1549 - DNA, 480 bp, Haemophilus influenzae
  Name: NTH0852
atgaatttcaatccaattttatctcatgaagaattgcagaatgctaacaaaggtattattccagaagatattcagcaagagcatgattttattcttcaagcagatttaattacgttggtttatcccctttggtggatggggttcccagcaattttgaaaggatatttagatcgcgtattaagtcacggttttgcctataaaacggaaaacggcgaatcagtggggttgctaaaaaataagcaaatgcagcaatttattacgattggcagtaatgttgatcaatataaagaatttggtgtggataaatcgcttaatcattgtttgattaatggattattcaattattgtggaattgaaaatgtcgagtttgaattatttggagatattcatttaattgatgatgaggctcgtaaggcgatgattgaacttgctgctcaaaaaactcaagcaaaattgaccgcacttttaaaggaaaaagag

SEQ ID NO: 1550 - protein, 160 aa, Haemophilus influenzae
  Name: NTH0852
MNFNPILSHEELQNANKGIIPEDIQQEHDFILQADLITLVYPLWWMGFPAILKGYLDRVLSHGFAYKTENGESVGLLKNKQMQQFITIGSNVDQYKEFGVDKSLNHCLINGLFNYCGIENVEFELFGDIHLIDDEARKAMIELAAQKTQAKLTALLKEKE

SEQ ID NO: 1551 - DNA, 552 bp, Haemophilus influenzae
  Name: NTH0853
atgtctgaaaaacaaattaataatttttcattaattagtcgattattcggtaatcttttttatcgttctccaacagataaagtactcgctgacgcatttgtttggttacaacaaaaaggtttgagtcaagtttgggcgttagatactgataaagaaagtgaattagcactgaatagcttgcaagttaaaatcgatctcaatttattgaacgaagagtatcaaaaattatttggtgcgaatgggaaagtgatgacggctatttcagcttatggcattgatgttgaagaatttgtgaattttcgccttgtacgcaatatgccagaggtggaaagtgcggatcattttgctttattattgctcactgcttcttggcttgaagataattcggattctttagtggctcaacaagaattctttgaaacttttttactgccttgtgcagcgaagtttttaactcaagttgaaacgcaagcaactttgcctttttatcgtgcattggcccttcttacacgagaaatattggcagcgatggcggatgaattggaagaagag

SEQ ID NO: 1552 - protein, 184 aa, Haemophilus influenzae
  Name: NTH0853
MSEKQINNFSLISRLFGNLFYRSPTDKVLADAFVWLQQKGLSQVWALDTDKESELALNSLQVKIDLNLLNEEYQKLFGANGKVMTAISAYGIDVEEFVNFRLVRNMPEVESADHFALLLLTASWLEDNSDSLVAQQEFFETFLLPCAAKFLTQVETQATLPFYRALALLTREILAAMADELEEE

SEQ ID NO: 1553 - DNA, 552 bp, Haemophilus influenzae
  Name: NTH0854
atggatgcacttacacttttaaccacaagaaaatcaaacaaaaaattgaccgtacctgcacctaatgcagaacagcttgagcgtattttcgaagcagcaatgcgtgtgccagatcacggaaaattacatccttatcattttattgtaatggaaaatgagagcttaaataaattagaaacgctacttaaagctgccgttgtagaatttgatcttggggaagaaaaattgatgaaagccgaaaacctagcacatcgcgcacctatggttattggcgtggtagcaaaaatcgatccaactatcgctaaagtgccagattgggaacaaatgttgagtgcaggttgtgcaacttatggattacaactggctgcacaagcacaaggatttgataatgtgtggatttcagggaaatgggttaatggcactgcattacgagaagcgttcggatgtcgtgaacaagatcgtgtgattgcgttagtcatgattggcacaagtatggagaaagccgaacgtgaatgccgtattattgatacaaaagattttgtaacctatcta

SEQ ID NO: 1554 - protein, 184 aa, Haemophilus influenzae
  Name: NTH0854
MDALTLLTTRKSNKKLTVPAPNAEQLERIFEAAMRVPDHGKLHPYHFIVMENESLNKLETLLKAAVVEFDLGEEKLMKAENLAHRAPMVIGVVAKIDPTIAKVPDWEQMLSAGCATYGLQLAAQAQGFDNVWISGKWVNGTALREAFGCREQDRVIALVMIGTSMEKAERECRIIDTKDFVTYL

SEQ ID NO: 1555 - DNA, 399 bp, Haemophilus influenzae
  n 394, 395, 396, 397, 398: n is any nucleotide
  Name: NTH0856
atgtttcgagtattaaaattttgttggaaagtgctgtgtttcattcgtgatcttgtgatgaatgttgtgtttttaggctttgtactattgctagtggcgattattagcttttcaagtggcgggaaaaaatctactgcattaacgagcgaaggcgcattattgctcaatttagatggttatttagcggacaaccgagatgaaacacttcgttggcaagatgcgttaagcgaattgaatggcgagcatgtccctagaaaaatttcgacgtttgatgtggtatttgccattcaacaagcggaagatgatcctaaaattaaaggattagtgctagatcttaattatttgaaggggcagatttacccgctgggtaccgagtccgatattcgtataccannnnnt

SEQ ID NO: 1556 - protein, 133 aa, Haemophilus influenzae
  Xaa 132, 133: Xaa is any amino acid
  Name: NTH0856
MFRVLKFCWKVLCFIRDLVMNVVFLGFVLLLVAIISFSSGGKKSTALTSEGALLLNLDGYLADNRDETLRWQDALSELNGEHVPRKISTFDVVFAIQQAEDDPKIKGLVLDLNYLKGQIYPLGTESDIRIPXX

SEQ ID NO: 1557 - DNA, 456 bp, Haemophilus influenzae
  Name: NTH0857
gtgggcaatgatttagtcttaatcgcaccagcaaaaagtgcggtaaattctgtggatattgcaaaaggtgaatggatcaatgcattaaaagatagctatttatctgttggcgatcctgcacacgtacctgctggtcaatacgcagcagaagcattaaccaaattaaatttatgggataaagtgcaagatcgtttagcgcgtgctaaagatgtgcgtggcgcattagctttagttgaacgtgcagaagcaccttacggtattgtgtacagcactgatgcaaaagttagccaacaagttaaaacggttgcagtgttccctgcagatagccataaaccagttgtttatcccgtttctattgtaaaaggtcatgataatgcggattctcgcgatttcttgaaatatttagaatcagatgctgcgaagaaagtgcttgtagggtatggtttctctgcaaaa

SEQ ID NO: 1558 - protein, 152 aa, Haemophilus influenzae
  Name: NTH0857
VGNDLVLIAPAKSAVNSVDIAKGEWINALKDSYLSVGDPAHVPAGQYAAEALTKLNLWDKVQDRLARAKDVRGALALVERAEAPYGIVYSTDAKVSQQVKTVAVFPADSHKPVVYPVSIVKGHDNADSRDFLKYLESDAAKKVLVGYGFSAK

SEQ ID NO: 1559 - DNA, 726 bp, Haemophilus influenzae
  Name: NTH0858
ttgcttacccaatttttttcatttttcaatctgacgccaatggaaatctcagcaattaatttaagcctgagtgttgcagtcagttctatgctttggagtttgccgttagccatttttgtggcgtggctcttagcgcgcaaaaacttctatggcaaatctctgattactggcgtaattcatttgcctttagtgttgccaccagtggttatcggttatctattacttgtagcaatggggcgcaatggtttcattggcaagtatttatatcagtggtttggcttatcttttggttttagttggaaaggtgcggtgctttcctctgccgtggtggcctttccattggttgttcgcgcgattcgactttctttagaaaatattgatattaaattggagcaagcggcgcaaacactcggtgcttccgcttggcgtgtattttttacaataaccttgccgctttctttacctggggttttagctggactcgtgcttggttttgcacgatcattaggggaatttggcgcgaccattacctttgtatcgaacattgcaggcgaaactcaaacgattccccttgcgatgtattcttttattcaaacacccgcagcagaagaacaaactgctcgcttatgtttatttgctatcattctttcattgatttctttgttactgtctgaatggttgagcaagcgaatgcagaaaaaattaggacaaggaaatgttgcaaat

SEQ ID NO: 1560 - protein, 242 aa, Haemophilus influenzae
  Name: NTH0858
LLTQFFSFFNLTPMEISAINLSLSVAVSSMLWSLPLAIFVAWLLARKNFYGKSLITGVIHLPLVLPPVVIGYLLLVAMGRNGFIGKYLYQWFGLSFGFSWKGAVLSSAVVAFPLVVRAIRLSLENIDIKLEQAAQTLGASAWRVFFTITLPLSLPGVLAGLVLGFARSLGEFGATITFVSNIAGETQTIPLAMYSFIQTPAAEEQTARLCLFAIILSLISLLLSEWLSKRMQKKLGQGNVAN

SEQ ID NO: 1561 - DNA, 120 bp, Haemophilus influenzae
  n 120: n is any nucleotide
  Name: NTH0859
atgttgcaaattaatgtgaaaaaacagctcgggaaacttgccttgcaagcgaatatacaagtgccagatcaaggcgtaaccgccattttcggtttgtctggctcagggcaaaccatcggn

SEQ ID NO: 1562 - protein, 40 aa, Haemophilus influenzae
  Name: NTH0859
MLQINVKKQLGKLALQANIQVPDQGVTAIFGLSGSGQTIG

SEQ ID NO: 1563 - DNA, 735 bp, Haemophilus influenzae
  n 67, 722, 723, 724, 725, 726: n is any nucleotide
  Name: NTH0860
ttgcgtaaaattggctatgtattccaagatgcgcgtttatttcctcactacactgtgaaaggtaatntgcgctatggcatgaaacatgtctcgcaagatgattttaactatattgtcgatcttctcggtattactcatttattaaagcgttatccgcttacgctttctggcggagagaaacaacgtgtggcaatagggcgtgcgctgctgactgatcctgatattttactgatggacgaaccactttctgcccttgatgttccccgcaaacgcgagctaatgcaatatttggaacgtctttctaaagaaattaatatcccgattttatatgttacacatagcttggacgaactgttgcgtttagctgatcgggtcgtattgatggaaaacggcattgtgcaagcctatgacagcgtagaaaaaatttggaatagccctatttttgccccttggaaaggggaaaacgaacagagcagtgtacttgccttgcctgttcatttgcataatccaccttataaaatgaccgcactttcgctaggcgaacaagcactttggattcatcaagtacccgcgaatgtaggcgagcgagtgctagtttgtatttatagttcagatgtttctatcatactgcaaaagccagaacaaacaagcattcgtaatattttacgtggcaagattacacaaattgagatacaagattctcgagtggatcttgccgtatnnnnnttaattaat

SEQ ID NO: 1564 - protein, 245 aa, Haemophilus influenzae
  Xaa 23, 241, 242: Xaa is any amino acid
  Name: NTH0860
LRKIGYVFQDARLFPHYTVKGNXRYGMKHVSQDDFNYIVDLLGITHLLKRYPLTLSGGEKQRVAIGRALLTDPDILLMDEPLSALDVPRKRELMQYLERLSKEINIPILYVTHSLDELLRLADRVVLMENGIVQAYDSVEKIWNSPIFAPWKGENEQSSVLALPVHLHNPPYKMTALSLGEQALWIHQVPANVGERVLVCIYSSDVSIILQKPEQTSIRNILRGKITQIEIQDSRVDLAVXXLIN

SEQ ID NO: 1565 - DNA, 429 bp, Haemophilus influenzae
  Name: NTH0861
atgaaactcacaaaaacacttcttaccaccgcacttttaggtgcttctgtattatcttttcaatccaccgcttgggcggatacgctggaacagcaattccaacaaggtttaaccgcttatgagcaaagcaactatcaaaccgcctttaaactttggttacctctggcggagcagggagatgcaaatgttcaatttaatttgggcgtgatgtatgctgaggggcaaggcgtcaaacaagatgattttgaagcggtgaaatggtatcgcaaagcggcggagcagggagatgcaaatgctcaggcttatttaggtttggcttatactgaagggcgtggtgtaagacaagattataccgaagcggtgaagtggtttcgcaaagcggcggagcagggacatgcaaatgctcaagctatatgggatctctttctt

SEQ ID NO: 1566 - protein, 143 aa, Haemophilus influenzae
  Name: NTH0861
MKLTKTLLTTALLGASVLSFQSTAWADTLEQQFQQGLTAYEQSNYQTAFKLWLPLAEQGDANVQFNLGVMYAEGQGVKQDDFEAVKWYRKAAEQGDANAQAYLGLAYTEGRGVRQDYTEAVKWFRKAAEQGHANAQAIWDLFL

SEQ ID NO: 1567 - DNA, 93 bp, Haemophilus influenzae
  n 25, 26, 76, 91: n is any nucleotide
  Name: NTH0862
gtgggcgtattcaagtggagacgcnnccaagcctttcattgggtttatggtttgcaagttcctcatcatggttcanagcccaatttagtgnaa

SEQ ID NO: 1568 - protein, 31 aa, Haemophilus influenzae
  Xaa 9, 26, 31: Xaa is any amino acid
  Name: NTH0862
VGVFKWRRXQAFHWVYGLQVPHHGSXPNLVX

SEQ ID NO: 1569 - DNA, 453 bp, Haemophilus influenzae
  Name: NTH0863
atgaaactcacaaaaacacttcttaccaccgcacttttcggtgcttctgtattttcttttcaatccaccgcttgggcggatacgctggaacagcaattccaacaaggtttaaccgcttatgagcaaagcaactatcaaaccgcctttaaactttggttacctatggcagagcagggatatgcaaaggctcaatttaatttgggcgtgatgtatgctaaggggcaaggcgtcaaacaagatgattttgaagcggtgaagtggtttcgcaaagcggcggagcagggatatgcagaggctaaatttaatttgggccatatgtattctaagggacgaggcgtcaaacaagatgattttgaagcagtgaactggtatcgcaaagcggcggagcagggagatgcagatgctcaagctatattgggattcttatatcttttaggagaaagaggtgtcaag

SEQ ID NO: 1570 - protein, 151 aa, Haemophilus influenzae
  Name: NTH0863
MKLTKTLLTTALFGASVFSFQSTAWADTLEQQFQQGLTAYEQSNYQTAFKLWLPMAEQGYAKAQFNLGVMYAKGQGVKQDDFEAVKWFRKAAEQGYAEAKFNLGHMYSKGRGVKQDDFEAVNWYRKAAEQGDADAQAILGFLYLLGERGVK

SEQ ID NO: 1571 - DNA, 174 bp, Haemophilus influenzae
  Name: NTH0864
atgccaactttacaatgcgaattttggaatgtagggcaagggttattttcaagtgggcgtattcaaatgggagacgcccaagcctttcattgggtttatggtttgcaagttcctcatcatggttcaaagccaattttagtgaataaaaataaaagattatccattcattcaatt

SEQ ID NO: 1572 - protein, 58 aa, Haemophilus influenzae
  Name: NTH0864
MPTLQCEFWNVGQGLFSSGRIQMGDAQAFHWVYGLQVPHHGSKPILVNKNKRLSIHSI

SEQ ID NO: 1573 - DNA, 657 bp, Haemophilus influenzae
  Name: NTH0865
atgaaactcacaaaaacacttcttaccaccgcacttttcggtgcttctattttttcttttcaatccaccgcttgggcggatacgccggaacagcaattccaacaaggtttaaccgcttatgagcaaagcaactatcaaaccgcctttaaactttggttacctctggcggagcagggagatgcacaggctcaaggtggtttgggcatgatgtatgaaagaggacttggcgtaaaacaagatgatttcaaagcagtgaactggtatcgcaaagcggcggagcagggggatgcagatgctcaattaaatttgggtgcgatgtatgcaatcggacgtggcgtaaaacaagatggtgttgaagcggtgaagtggtttcgcaaagcggcagagcagggaaatgcaaaggctcaaaatggtttgggcatgatgtatgacggaggacttggcataaaacaagattatttcaaagcggtgaaatggcatcgcaaagcggcggagcagggatatggaggtgctcaagttatgttgggattctcatatctttcgggaaaaggtgttcaagtaaataaatctttagccaaagaatggtttggtaaggcttgtgataatggtgaacaagtgggttgtgaatattatggcaagctaaatagaggggaacgc

SEQ ID NO: 1574 - protein, 219 aa, Haemophilus influenzae
  Name: NTH0865
MKLTKTLLTTALFGASIFSFQSTAWADTPEQQFQQGLTAYEQSNYQTAFKLWLPLAEQGDAQAQGGLGMMYERGLGVKQDDFKAVNWYRKAAEQGDADAQLNLGAMYAIGRGVKQDGVEAVKWFRKAAEQGNAKAQNGLGMMYDGGLGIKQDYFKAVKWHRKAAEQGYGGAQVMLGFSYLSGKGVQVNKSLAKEWFGKACDNGEQVGCEYYGKLNRGER

SEQ ID NO: 1575 - DNA, 174 bp, Haemophilus influenzae
  Name: NTH0866
atgccaactttacaatgcgaattttggaatgtagggcaagggttattttcaagtgggcgtattcaaatgggagacgccccagcctttcattgggtttatggtttgcaagttcctcatcatggttcaaagccaattttagtgaataaaaataaaagattatccattcattcaatt

SEQ ID NO: 1576 - protein, 58 aa, Haemophilus influenzae
  Name: NTH0866
MPTLQCEFWNVGQGLFSSGRIQMGDAPAFHWVYGLQVPHHGSKPILVNKNKRLSIHSI

SEQ ID NO: 1577 - DNA, 444 bp, Haemophilus influenzae
  Name: NTH0867
atgcgattcacaaaaacactttttaccaccgcacttttaggtgcttctatcttttcttttcaatccaccgcttgggcggatacgctggaacagcaattccaacaaggttctgaagccactacgagaggcgattatcaaaccacctttaaatttttgttacctctggcggagcagggaaatgcagaggctcaattgatgttgggcgtgatgtatgcaagaggaataggcgtcaaacaagatgattttgaagcggtgaagtggtatcgccaagcggcggagcagggatatgcaaatgctcaagctatattgggattctcatatcttttaggacaaagcggtgttcaagtaaataaatctttagccaaagaatggtttggtaaggcttgtgataatggtgatcaaaatggttgcgaatattatggcaagttaaatagaggggagctc

SEQ ID NO: 1578 - protein, 148 aa, Haemophilus influenzae
  Name: NTH0867
MRFTKTLFTTALLGASIFSFQSTAWADTLEQQFQQGSEATTRGDYQTTFKFLLPLAEQGNAEAQLMLGVMYARGIGVKQDDFEAVKWYRQAAEQGYANAQAILGFSYLLGQSGVQVNKSLAKEWFGKACDNGDQNGCEYYGKLNRGEL

SEQ ID NO: 1579 - DNA, 357 bp, Haemophilus influenzae
  n 344, 345, 346, 347, 348: n is any nucleotide
  Name: NTH0868
ttggacgcattgacagcacttaccagcgagcttaccagcgagcttatactacgtcagaagcagtatgaatactatcgggaaaaattgttaagtgaagaagaacttgggaaggttgggtttgagtggaaaacaattgatgaaatctcaaagaaaatttcttcaggcggaacgcctacaacatcaaataatggctattatgacaacggtactattccatggttaagaactcaagaagtagattttaaagaaatttgggataccaacataaaaattactgaagatgctctaaataattctagtgcaaaaggattcccggggtacgagtccgaattcggtaacagaannnnnttaattaat

SEQ ID NO: 1580 - protein, 119 aa, Haemophilus influenzae
  Xaa 115, 116: Xaa is any amino acid
  Name: NTH0868
LDALTALTSELTSELILRQKQYEYYREKLLSEEELGKVGFEWKTIDEISKKISSGGTPTTSNNGYYDNGTIPWLRTQEVDFKEIWDTNIKITEDALNNSSAKGFPGYESEFGNRXXLIN

SEQ ID NO: 1581 - DNA, 270 bp, Haemophilus influenzae
  Name: NTH0869
ttgcctgctgggtctattagtggtgcaccaaaagaaaaaaccacacaaattattcaacaagcagaaaaacaaaagcgcggttattacacgggaatttttggcatatttgatggcaaaacactacaaagtgcggtagcaattcgatttatttctcaagtagatgaaaaattttattttcatagtggaggcgggattaccattcatagcaatgcgcaagatgaatatgaagaattattagaaaaagtctatttaccgattgaaggtgctgat

SEQ ID NO: 1582 - protein, 90 aa, Haemophilus influenzae
  Name: NTH0869
LPAGSISGAPKEKTTQIIQQAEKQKRGYYTGIFGIFDGKTLQSAVAIRFISQVDEKFYFHSGGGITIHSNAQDEYEELLEKVYLPIEGAD

SEQ ID NO: 1583 - DNA, 258 bp, Haemophilus influenzae
  n 210: n is any nucleotide
  Name: NTH0870
atgtatcctctatttgaaaccctttgtattgaaaacgggaaaattcaaaatatcgatttacaccaagcgcgatatgaacgtagtttgcgtgaatattatggcaaaagtgcggtgaaaatttttaatcttttttcccttattcaactgcctgaagatttacaaaatcaattagttcgctgccgcattgattacaatgccgaaaccacacanattcaatattttgaataccaacgaaaaatctaccgcacttttcacctg

SEQ ID NO: 1584 - protein, 86 aa, Haemophilus influenzae
  Xaa 70: Xaa is any amino acid
  Name: NTH0870
MYPLFETLCIENGKIQNIDLHQARYERSLREYYGKSAVKIFNLFSLIQLPEDLQNQLVRCRIDYNAETTXIQYFEYQRKIYRTFHL

SEQ ID NO: 1585 - DNA, 213 bp, Haemophilus influenzae
  Name: NTH0871
atgattatcaaaaatggaaaagtgacagattgttccatcggtaatttaatttttcgccaaggaaaaaaatggtacacgccagacacgccattgcttttaggcacacaacgagaaaaattattacaagaagggaaaattcaagaacgcacaatattccaagaagatattgtcaattttgatgaaattaaaatcattaacgcaatgaatagctta

SEQ ID NO: 1586 - protein, 71 aa, Haemophilus influenzae
  Name: NTH0871
MIIKNGKVTDCSIGNLIFRQGKKWYTPDTPLLLGTQREKLLQEGKIQERTIFQEDIVNFDEIKIINAMNSL

SEQ ID NO: 1587 - DNA, 402 bp, Haemophilus influenzae
  Name: NTH0872
ttgattaaaaaaaagctaaattacggcacagtcattttatttattttaaagggagttgttatggaaattgtgaataaacaatcttttcaagaagtgttggaatacgtgcgtatgtatcgtttaaaaaatagaattaaacgagatatggaagacaataatcgtaagattcgcgataaccaaaaacgcatattgttattggataatttaaatcaatatattcgtgatgatatgactattgcagaagtacgcggaattattgaaagtatgcgtgatgattatgaaagccgtgtggatgattatacaattcgcaatgctgaactttctaagcaacgccgtgaagcgagtacgaaaatgaaagaacagaaaaaagcacacgcagaattattgaaaaatgctgaaaaa

SEQ ID NO: 1588 - protein, 134 aa, Haemophilus influenzae
  Name: NTH0872
LIKKKLNYGTVILFILKGVVMEIVNKQSFQEVLEYVRMYRLKNRIKRDMEDNNRKIRDNQKRILLLDNLNQYIRDDMTIAEVRGIIESMRDDYESRVDDYTIRNAELSKQRREASTKMKEQKKAHAELLKNAEK

SEQ ID NO: 1589 - DNA, 435 bp, Haemophilus influenzae
  n 426, 427, 428, 429, 430: n is any nucleotide
  Name: NTH0873
atgtcacaagtctttaattttagcgcaggtcctgcgatgattttcccagaagtgttgcaaaaagcacaaaatgaacttacaaactggctcaatcaaggtgtttctgtaatggaagtaagccatcgtggaaagtattttatggaactcgttacccaagcggaaaaagatctacgtgaggtttacaatattcctgataactatcgtgtacttttcttacaaggtggcgctcgcggtcaatttgccgcaattccgatgaacttaatcggtaaaaaaggcaaagccctttatttaaatagtgggcattggtcagctacagcggcaaaagaagcaagaaattttgcagaaattgatgaaatcactatcgtagaaaatggcgaacagactcgaattaccgatcttgattttagccatatcgctgatcaatannnnnttaat

SEQ ID NO: 1590 - protein, 145 aa, Haemophilus influenzae
  Xaa 142, 143, 144: Xaa is any amino acid
  Name: NTH0873
MSQVFNFSAGPAMIFPEVLQKAQNELTNWLNQGVSVMEVSHRGKYFMELVTQAEKDLREVYNIPDNYRVLFLQGGARGQFAAIPMNLIGKKGKALYLNSGHWSATAAKEARNFAEIDEITIVENGEQTRITDLDFSHIADQXXXN

SEQ ID NO: 1591 - DNA, 702 bp, Haemophilus influenzae
  Name: NTH0874
atgccatttcaaggccgtgaattggcgtttaaattagggttaagtggtacgcaaaacaaacagttacagaatatctttatgggcttatctcgtttgtttttagaaaaagatttatctttagtggaagtcaatccacttgttctaactaaccaaggctatttggtttgtctcgacgccaaaatatctgtcgatgataacgctttatttcgccataaagatctcttagcactgcaagatttaactcaaaatgatgcccgtgaagcagaagctgaaaaattccagttaaactatgtggctttagagggcgatattggttgtatggtaaacggggctgggcttgcaatgggcaccatggatattgtgaaactctatggtgggaagcctgcgaattttcttgatgtgggtggtggtgcaacgaaagagcgggttgctgaagcgttcaaaatcattttaaccgatccttccgttaaagtgattttagtgaatatttttggtggcattgttcgttgtgatttgattgctgaaggcgtgattgctgcagtaaatgaagtgggcgtgagagtgcctgtggttgtgcgattagaaggaacgaatgctgaaatgggtcgccaaattttagcgcaaagcgacgttaatattcttacagcacagagtttacaacaagctgcagaattagctgtgaatgcagcaaaaggagaacac

SEQ ID NO: 1592 - protein, 234 aa, Haemophilus influenzae
  Name: NTH0874
MPFQGRELAFKLGLSGTQNKQLQNIFMGLSRLFLEKDLSLVEVNPLVLTNQGYLVCLDAKISVDDNALFRHKDLLALQDLTQNDAREAEAEKFQLNYVALEGDIGCMVNGAGLAMGTMDIVKLYGGKPANFLDVGGGATKERVAEAFKIILTDPSVKVILVNIFGGIVRCDLIAEGVIAAVNEVGVRVPVVVRLEGTNAEMGRQILAQSDVNILTAQSLQQAAELAVNAAKGEH

SEQ ID NO: 1593 - DNA, 879 bp, Haemophilus influenzae
  Name: NTH0875
atggcgattttaattgataaaaatactaaagtgatttgccaaggttttactggtggacaaggggcttttcattccgaacaagcattagcctacggaacgcaattagttggtggcgtatcgccaaataaaggtggaaccactcatcttggtttacctgtatttaatacagttcgtgaagctgtcgaaaatacgggggcaacagcgacagttatttatgtgccagcatcattttgtaaagatgccataattgaagccattgatgcagggattcagttaattgtctgtattactgagggtattcctacattggatatgcttaaagtgaaacagaaattaaatgaaacgggcgtagtaatgattgggccaaattgcccaggtgtgattacgcctgatgaatgtaaaatcggcattatgcccgctcacatacataaaaaaggtaaagtggggattgtttctcgttctggaactttaacttatgaagcggtaaaacaaactacagatgaaggctttggacaatcgacttgtgtgggtatcgggggagatcctattccaggttctagttttattgatattcttgaaagatttcaacaagatcccgaaacagaagccattgtgatgattggcgagattggcggctctgcagaggaagaagcagcaatcttcattaaagataatgttactaaaccagtggttgcgtatattgcgggtatcactgcgccaaaaggaaaacggatggggcatgcgggagccattattagcggcggaaaaggtactgcagtagaaaaaattgcagcgttagaagccgctggtgtgacctgtgtaaaaagcctcgctgaaattggtgaagccttgagaaagctattaaaatcatctaaaaat

SEQ ID NO: 1594 - protein, 293 aa, Haemophilus influenzae
  Name: NTH0875
MAILIDKNTKVICQGFTGGQGAFHSEQALAYGTQLVGGVSPNKGGTTHLGLPVFNTVREAVENTGATATVIYVPASFCKDAIIEAIDAGIQLIVCITEGIPTLDMLKVKQKLNETGVVMIGPNCPGVITPDECKIGIMPAHIHKKGKVGIVSRSGTLTYEAVKQTTDEGFGQSTCVGIGGDPIPGSSFIDILERFQQDPETEAIVMIGEIGGSAEEEAAIFIKDNVTKPVVAYIAGITAPKGKRMGHAGAIISGGKGTAVEKIAALEAAGVTCVKSLAEIGEALRKLLKSSKN

SEQ ID NO: 1595 - DNA, 207 bp, Haemophilus influenzae
  Name: NTH0876
atgagccaatttttctatatccaccctgaaaatccacaagcgcgcttgattaatcaagccgtagagattttacaaaaaggcggtgtgattgtgtatccaacggattcgggatatgccttgggctgtatgatgggcgataaacacgcaatggatcgcattgtagcaattcgtaaattgcctgaaggacataattttaccttgggtgtg

SEQ ID NO: 1596 - protein, 69 aa, Haemophilus influenzae
  Name: NTH0876
MSQFFYIHPENPQARLINQAVEILQKGGVIVYPTDSGYALGCMMGDKHAMDRIVAIRKLPEGHNFTLGV

SEQ ID NO: 1597 - DNA, 195 bp, Haemophilus influenzae
  n 142, 154, 157, 160, 190, 191, 192, 193, 194: n is any nucleotide
  Name: NTH0877
ttgccccaatggtgggaaacgtgcctcattttgaacagcaacaagcggattattacaatctatttaacctccgccgccgtaaacaacctatccaaagtgcggccaatttcagaatatttcttaatcgcagccttaggttatncgcggggggatnctnctngaagtcgacctgcaggcagcaagtatggcnnnnnt

SEQ ID NO: 1598 - protein, 65 aa, Haemophilus influenzae
  Xaa 48, 52, 53, 54, 64, 65: Xaa is any amino acid
  Name: NTH0877
LPQWWETCLILNSNKRIITIYLTSAAVNNLSKVRPISEYFLIAALGYXRGDXXXSRPAGSKYGXX

SEQ ID NO: 1599 - DNA, 978 bp, Haemophilus influenzae
  n 917, 929, 932, 935, 965, 966, 967, 968, 969: n is any nucleotide
  Name: NTH0878
atgataatgcgctcaccggttgatttttacctgcacgcttttagctacggtcgccaattacttgatttgggcgatcgaacaaacatagagtttgagcacgaattttgtggcgtggcactatgtgcttacaacgaaaaaagtgcggttaaattaacaaagatttctcaacttggtttaccgaacgaaatcttccaaatgctgagtgctgaacaactcagtgaaaaagtgggattaccgcttaattgcgaaggcggttggattgaacaaggggcttggcttgcaccaagacaatttgttcaaaatgccttttcatttcttgaaaagcaaggtgtaatcattaaaacctcacaaaaaattaccgcactttctcaacaagaaaaaggttgggaactagaaaatacgcaaggtcaaaaatactgccatgaagtcgtcattcttgcgaacggatataaaattactgattttgttcaaacagaaaagctaccgctctaccctatccgcgggcaagttagccaaattccaacatcagaaaacttactcaaactgaaatctgtgctttgttatgatggctatcttactccagccaatcaattaaaaacctcacattgcatcggcgcaagccatgttcgtgataatgttgatcgccactttagtgaacaagaacaacaagaaaaccaacaaaaactccaacaaaatatcgcccaaccttggactcaagatgtgaatacatcagataatctcgctcgtgtaggcatccgctgctctgtaagagatcttgccccaatggtgggaaacgtgcctcattttgaacagcaacaagcggattattacaatctatttaacctccgccgccgtaaacaacctatccaaagtgcggccaatttcagaatatttcttaatcgcagccttaggttatncgcggggggatnctnctngaagtcgacctgcaggcagcaagtatggcnnnnnttaattaat

SEQ ID NO: 1600 - protein, 326 aa, Haemophilus influenzae
  Xaa 306, 310, 311, 312, 322, 323: Xaa is any amino acid
  Name: NTH0878
MIMRSPVDFYLHAFSYGRQLLDLGDRTNIEFEHEFCGVALCAYNEKSAVKLTKISQLGLPNEIFQMLSAEQLSEKVGLPLNCEGGWIEQGAWLAPRQFVQNAFSFLEKQGVIIKTSQKITALSQQEKGWELENTQGQKYCHEVVILANGYKITDFVQTEKLPLYPIRGQVSQIPTSENLLKLKSVLCYDGYLTPANQLKTSHCIGASHVRDNVDRHFSEQEQQENQQKLQQNIAQPWTQDVNTSDNLARVGIRCSVRDLAPMVGNVPHFEQQQADYYNLFNLRRRKQPIQSAANFRIFLNRSLRLXAGGXXXKSTCRQQVWXXLIN

SEQ ID NO: 1601 - DNA, 180 bp, Haemophilus influenzae
  Name: NTH0879
gtggaaagtacggtagattttgattgtatttttagcccacttaaacattcccgttttttgccaaagcctttacgttttgtcacattaaagcctgcggattcaagtccttttctaaccgcacttgctgcggtgaaagtggcaaaagaaccattgggttttgtgaaacgaaacattaattta

SEQ ID NO: 1602 - protein, 60 aa, Haemophilus influenzae
  Name: NTH0879
VESTVDFDCIFSPLKHSRFLPKPLRFVTLKPADSSPFLTALAAVKVAKEPLGFVKRNINL

SEQ ID NO: 1603 - DNA, 591 bp, Haemophilus influenzae
  Name: NTH0880
ttgcaacgttattggccttcattgattctaggttgtcatcgtattcattttggagagacaacgttagatttatggcttggtaatgtatcagaaaacttgccacaacttggtgattatatgaatgaacgtattgatgcttggtttttagatggttttgcgccgagcaaaaatcctgaaatgtggaatgatgatctctataaattaatgtttcgtttcacaaaacccaatggttcttttgccactttcaccgcagcaagtgcggttagaaaaggacttgaatccgcaggctttaatgtgacaaaacgtaaaggctttggcaaaaaacgggaatgtttaagtgggctaaaaatacaatcaaaatctaccgtactttccacaccttggtatcttgctcagcctgcgaaaatggaaaaacaagatgtcgctattatcggcggtggtatcgcttctttttgtgcagccatttccttagtaaaacgtggggcaaaagtcaccatttattgtgaagatgatgcgctcgctctcaatgcctcaggcaataaacaaggcgcattttatccgcaacttagcgatgataatgcgctcaccggt

SEQ ID NO: 1604 - protein, 197 aa, Haemophilus influenzae
  Name: NTH0880
LQRYWPSLILGCHRIHFGETTLDLWLGNVSENLPQLGDYMNERIDAWFLDGFAPSKNPEMWNDDLYKLMFRFTKPNGSFATFTAASAVRKGLESAGFNVTKRKGFGKKRECLSGLKIQSKSTVLSTPWYLAQPAKMEKQDVAIIGGGIASFCAAISLVKRGAKVTIYCEDDALALNASGNKQGAFYPQLSDDNALTG

SEQ ID NO: 1605 - DNA, 162 bp, Haemophilus influenzae
  n 34, 77, 108: n is any nucleotide
  Name: NTH0881
atgtttctacaaggtatcaacttgggaacgtggnatagccacaacgaggctaatttgtcatttgctgaaacaggatntggtacaggattaaatatcttcgcggtaacncaattattccgtgaatttcgccagcaacacgagaatcattcctttaaaacgcct

SEQ ID NO: 1606 - protein, 54 aa, Haemophilus influenzae
  Xaa 12, 26: Xaa is any amino acid
  Name: NTH0881
MFLQGINLGTWXSHNEANLSFAETGXGTGLNIFAVTQLFREFRQQHENHSFKTP

SEQ ID NO: 1607 - DNA, 279 bp, Haemophilus influenzae
  Name: NTH0882
gtgcgggaagaattagaagaagttcaagctgaaattaaccgcacttcgattgaacaaaataaagtggaagaggaaatcggcgatttattgttcgcaaccgtcaatcttgctcgccacttaaaatgtgatcctgaagatgcattgcggaaagcaaatttaaaatttgaacgtcgttttcgagcagtagagcaagcggttcaacaacaaggtaagcaagtgaataatgtgccacttattgaattagatttgttatgggatgaagtgaaaaaacaagaaaac

SEQ ID NO: 1608 - protein, 93 aa, Haemophilus influenzae
  Name: NTH0882
VREELEEVQAEINRTSIEQNKVEEEIGDLLFATVNLARHLKCDPEDALRKANLKFERRFRAVEQAVQQQGKQVNNVPLIELDLLWDEVKKQEN

SEQ ID NO: 1609 - DNA, 831 bp, Haemophilus influenzae
  Name: NTH0884
atgtatccttattctaaggatcgcccttttcttaaacaagtgcgggaaaaattacgctattatggctataaatggttatatcaaaagcaatgtcatcaattagtggatttccttaatacagaaacgcaatggcagtctttatttacacaagattattatcgtactaatacaattctgacgaccttttgcgataaacgtttttctgcttcagaacgtttaacggcgattacggagaatttacgtttggcagaagaaaaaatgggacgttcgctttgccaacaattattagatcaacaacatatcgtgctaacccaattaactgaggatttgcgtttatcgttgagtattaatcatatcgatccctttgaaggatatttttctattaatattcgcaatcaaaataacgaacgagtatatgatgcgtctttcacttttttaagcccgaataaattgcttatcgcctcaattcaaggcccctcaagcgacaatgcacaagaacttgtgaaacaggctacgaaagcattacacggtatgcgaccaatgtttatgttggttaatgcgttcaaaatgcttgctgaaaaatggcaatgtgagttagtgggcattccgcacaaagcacaaggaaaataccgtctttctgctcgcagtaagattttgtttaattacgatgaattttggcaagaaaaccaaggagaatatcgccataactattggcaattacctttgcatattgaacgcaaacaattagaagatatcgcaagtaaaaaacgttctatgtatcgtaaacgttatgaaatgctagaccaaatggcactggatattcagcaactt

SEQ ID NO: 1610 - protein, 277 aa, Haemophilus influenzae
  Name: NTH0884
MYPYSKDRPFLKQVREKLRYYGYKWLYQKQCHQLVDFLNTETQWQSLFTQDYYRTNTILTTFCDKRFSASERLTAITENLRLAEEKMGRSLCQQLLDQQHIVLTQLTEDLRLSLSINHIDPFEGYFSINIRNQNNERVYDASFTFLSPNKLLIASIQGPSSDNAQELVKQATKALHGMRPMFMLVNAFKMLAEKWQCELVGIPHKAQGKYRLSARSKILFNYDEFWQENQGEYRHNYWQLPLHIERKQLEDIASKKRSMYRKRYEMLDQMALDIQQL

SEQ ID NO: 1611 - DNA, 147 bp, Haemophilus influenzae
  Name: NTH0885
gtgggttttaaacaaaaaagaattttggcaaatgaagtgataatggctaaaataacgaaaaattttattaaatttcacaaaatattgagttatgtccacgaaaaatcattttattttccccacttacgttcaaatgtatccttattc

SEQ ID NO: 1612 - protein, 49 aa, Haemophilus influenzae
  Name: NTH0885
VGFKQKRILANEVIMAKITKNFIKFHKILSYVHEKSFYFPHLRSNVSLF

SEQ ID NO: 1613 - DNA, 666 bp, Haemophilus influenzae
  Name: NTH0886
atgaagcaatttatggatgaaaatttccttctttcaacggatacagcaaaaattctctatcatgattatgccaaaaataaacctatttttgattatcactgtcatttaaatccaagagaagtggcggaaaatcgtcaatttaatgatttagctgaaatttggctagagggtgatcactacaaatggcgagctttgcgtacagctggagtaccagaagaattgattacagggaaggctactaactatcaaaaatatttggcttgggcgaaaacagtccccctttgtattggtaatccaatttatcactggacacatttagaattacgccgtccttttggtataaccaatatgttatttaatccgcaaaatgcggaaaaaatttggcatcaatgtaatgaaatgttgcaacaacctgaattttctgcgcgaggcattatgcagaaaatgaacgtgaaattagtggggacaacagatgatcccattgattctttgcaatatcatcaagcaatcaagaatgatgaaagttttgatattgatgttgtaccaagttggcgacctgataaagtattcaaaattgagttgccacaatttaatgactaccttgtacagttaagtgaaattgcagatgtagatatttatacgtttgcagatttaaaaaaagcgtgg

SEQ ID NO: 1614 - protein, 222 aa, Haemophilus influenzae
  Name: NTH0886
MKQFMDENFLLSTDTAKILYHDYAKNKPIFDYHCHLNPREVAENRQFNDLAEIWLEGDHYKWRALRTAGVPEELITGKATNYQKYLAWAKTVPLCIGNPIYHWTHLELRRPFGITNMLFNPQNAEKIWHQCNEMLQQPEFSARGIMQKMNVKLVGTTDDPIDSLQYHQAIKNDESFDIDVVPSWRPDKVFKIELPQFNDYLVQLSEIADVDIYTFADLKKAW

SEQ ID NO: 1615 - DNA, 855 bp, Haemophilus influenzae
  Name: NTH0887
atggagtttactatgaatattgcagcaacccataacttagaaaataaactaattataatcacgggggctggcggagtgctatgttcatttctagctaagcagttagcgtatactaaagctaatattgccttgttagatttgaatttcgaggcagcagacaaagcagcaaaagaaattaaccaatcaggtggaaaagcaaaagcttataaaactaatgtgttagaacttgaaaatattaaagaagtgcgtgatcaaatagctattgattttggcacttgtgatattttaattaatggtgctggtgggaataatccaaaagcgacaacagataatgagttccatcaatttgatttaaatgaaacgacaagaacattctttgatttagataaatctggtatagaatttgtatttaatctcaattacttaggttcattattaccaacccaagttttttcaaaagatatgcttggtaaacaaggggcaaatattattaatatttccagtatgaatgcctttacaccacttacaaagatacctgcttactctggtgcaaaagctgcaatcagtaattttactcaatggcttgctgtatatttctcaaaagttggtattcgttgtaatgctatcgcaccaggatttttagttagtaatcaaaaccgcactttattatttgatactgaaggaaaaccaacagatagagcaaataaaatcctcactaacacaccaatgggacgttttggtgagtcagaagaattgctcggtgcattacttttcttaatagatgaaaattattctgcttttgtcaatggcgtagttttacctgttgatggcggtttttctgcgtatagtggagta

SEQ ID NO: 1616 - protein, 285 aa, Haemophilus influenzae
  Name: NTH0887
MEFTMNIAATHNLENKLIIITGAGGVLCSFLAKQLAYTKANIALLDLNFEAADKAAKEINQSGGKAKAYKTNVLELENIKEVRDQIAIDFGTCDILINGAGGNNPKATTDNEFHQFDLNETTRTFFDLDKSGIEFVFNLNYLGSLLPTQVFSKDMLGKQGANIINISSMNAFTPLTKIPAYSGAKAAISNFTQWLAVYFSKVGIRCNAIAPGFLVSNQNRTLLFDTEGKPTDRANKILTNTPMGRFGESEELLGALLFLIDENYSAFVNGVVLPVDGGFSAYSGV

SEQ ID NO: 1617 - DNA, 561 bp, Haemophilus influenzae
  Name: NTH0888
atgcgaaagttttttaaatatttcttatttattgttgtttttttattccacggttttatgttttctgtggtgaattatgtgttccctcattatgatgtgacgcgtgttactggcgtagaagttaaacgtgttgataaagatggcccaatcacaaaatcgaatccagctgatggcccaacacgcgatgtatattacatcaatacgcaaaatgacgatggcaaaattatggtgtatcgcaatgaagatacacgttggggtttcccgttctatttcaaatttggatcggccaatttacaggctgaagcgcaggctttgggtaatgacaacaaacttgtgcaaattaaatactatggttggcgtattacgatgatggatgaatatcgcaatgcaacctcaattaaagaaattactgctgatgatacaccaagcaatccgattgtttcgtggattttatatgtatttttgctggcgacattatttttggccaatccaattattccgggctgttttgacaggataaataatatcccaacggtcgcaaaaggcggcgcgtttctttta

SEQ ID NO: 1618 - protein, 187 aa, Haemophilus influenzae
  Name: NTH0888
MRKFFKYFLFIVVFLFHGFMFSVVNYVFPHYDVTRVTGVEVKRVDKDGPITKSNPADGPTRDVYYINTQNDDGKIMVYRNEDTRWGFPFYFKFGSANLQAEAQALGNDNKLVQIKYYGWRITMMDEYRNATSIKEITADDTPSNPIVSWILYVFLLATLFLANPIIPGCFDRINNIPTVAKGGAFLL

SEQ ID NO: 1619 - DNA, 780 bp, Haemophilus influenzae
  Name: NTH0889
atgttcattgttgactcccactgccatttagatgcgttggattatgaaaatttacataaaaatatctcggatgtggtggaaaaagcacgtgcgcgtgatgtgaaacatttgctcgcgattggtgtaaccttaagccgttttgagcaggcttatgactctttacgggaatttaataatgtctcgcttgcttgcggtgtccatcccctcgattttgaagaggaaccttatgacgcagaacgcttattgcgtttatcgcaagatccaaaagtgattgcgattggcgaaattggcttagattattattacagtgcggacaataaagcggcacaacaagcggtgtttggtagccaaatcgatattgcaaaccaattagataagcctgtaattattcatacacgttctgcaggcgatgacaccattgcaatgttacgcgaacatcatgctgaaaagtgcggtggcgttattcattgttttacggaaaccatggaatttgcgaaaaaagcgttggatttaggattttacatttcttgttctggcattgtaacctttaaaaatgccgaagcgattcgtgaggttattcgttatgtgccaatggatcgcttattggtggaaacggattcgccttatcttgcgccagtgccttacagaggaaaagaaaatcaaccagcgtatacgagagaagtatgtgaatacgtggcaaccttaaagggcgtttctgcagaggcgtttgctcaaatcactacacaaaatttcgagcgtttatttaaaattcgtgtagaa

SEQ ID NO: 1620 - protein, 260 aa, Haemophilus influenzae
  Name: NTH0889
MFIVDSHCHLDALDYENLHKNISDVVEKARARDVKHLLAIGVTLSRFEQAYDSLREFNNVSLACGVHPLDFEEEPYDAERLLRLSQDPKVIAIGEIGLDYYYSADNKAAQQAVFGSQIDIANQLDKPVIIHTRSAGDDTIAMLREHHAEKCGGVIHCFTETMEFAKKALDLGFYISCSGIVTFKNAEAIREVIRYVPMDRLLVETDSPYLAPVPYRGKENQPAYTREVCEYVATLKGVSAEAFAQITTQNFERLFKIRVE

SEQ ID NO: 1621 - DNA, 459 bp, Haemophilus influenzae
  Name: NTH0890
gtgaaatcagaaagtgcggctgaaaatcaggaaattttgaccgcacttgcgatgaatcttgggcgtccgcttttagcattagaaactttacaacaagggctgattgaacagcgtaaaaacttcttacgtcaattttgggtgttctatcgccgacgttcgccattggaattgcttccgttgtttgataaagaacgctatgttcagcaagtggattggattttggcttttctttctgattgtttaaaacataaacttgaaattgatagtcatcgacaagtggctgatcttggccgtggcatcgaacaattcagcgatgagcaaactgcccttggtttattacaagccattaaaattatgcaaaaagtgcggtcagatttgcttacaattaatggtgtgaatcttgaattaatgctattagatggcttgacgcgattagtcacagaagtatttgaaacgcaa

SEQ ID NO: 1622 - protein, 153 aa, Haemophilus influenzae
  Name: NTH0890
VKSESAAENQEILTALAMNLGRPLLALETLQQGLIEQRKNFLRQFWVFYRRRSPLELLPLFDKERYVQQVDWILAFLSDCLKHKLEIDSHRQVADLGRGIEQFSDEQTALGLLQAIKIMQKVRSDLLTINGVNLELMLLDGLTRLVTEVFETQ

SEQ ID NO: 1623 - DNA, 123 bp, Haemophilus influenzae
  Name: NTH0892
ttggttttatacacgccttggtgtgttgcttgtaaagaatttgaaaagctgacgttttcagatctcacaagtgcaacagcaatttcaaaatatcttattgttacaagtgaatatgacaaagaa

SEQ ID NO: 1624 - protein, 41 aa, Haemophilus influenzae
  Name: NTH0892
LVLYTPWCVACKEFEKLTFSDLTSATAISKYLIVTSEYDKE

SEQ ID NO: 1625 - DNA, 180 bp, Haemophilus influenzae
  Name: NTH0893
ttgttacaagtgaatatgacaaagaatagcccagaaaataaagcattaatggaacgctttaatgtgatgggattgcctacgattttattttttgatcagcaaaataatgaaattcaaggaagtagagtaacgggctttatggatgctgatgctttttccaattggttaaaagccttgcat

SEQ ID NO: 1626 - protein, 60 aa, Haemophilus influenzae
  Name: NTH0893
LLQVNMTKNSPENKALMERFNVMGLPTILFFDQQNNEIQGSRVTGFMDADAFSNWLKALH

SEQ ID NO: 1627 - DNA, 402 bp, Haemophilus influenzae
  Name: NTH0894
atgaacaatcttgaaaaatatcgcccttatttcttggcatttttacgtatcgttgccgcttatatgtttattttacatggcacagcaaaacttttggaatttccaatttctatgactggaggaaatggtgcagtaggcgatccaatgctactagtggcaggcgtaattgaaattgttggttccattttattaatcttaggtttatttacacgccaagctgcgtttattttgtcaggggaaatggcgtatgcctatttctttatgcacgtagcaggaaaaggaaacctatttttcccaattgcaaatggcggcgagcttgcattactttactcagttctctttctatattttgtattttctggcgcaggtgcttgtgctttagataataagttttttaaaaag

SEQ ID NO: 1628 - protein, 134 aa, Haemophilus influenzae
  Name: NTH0894
MNNLEKYRPYFLAFLRIVAAYMFILHGTAKLLEFPISMTGGNGAVGDPMLLVAGVIEIVGSILLILGLFTRQAAFILSGEMAYAYFFMHVAGKGNLFFPIANGGELALLYSVLFLYFVFSGAGACALDNKFFKK

SEQ ID NO: 1629 - DNA, 117 bp, Haemophilus influenzae
  Name: NTH0895
gtgggcaaaaataaggataaaattatgaaactacaactaaactactttttaaaaaacttattatctaaagcacaagcacctgcgccagaaaatacaaaatatagaaagagaactgag

SEQ ID NO: 1630 - protein, 39 aa, Haemophilus influenzae
  Name: NTH0895
VGKNKDKIMKLQLNYFLKNLLSKAQAPAPENTKYRKRTE

SEQ ID NO: 1631 - DNA, 144 bp, Haemophilus influenzae
  Name: NTH0896
ttggacgatctgtcattgtattttcctttcattaaatggttaaaaataagcgagttggattataacgcaaacgtttgcttaaatatagaaaagattaaatataatttcttaaagtgcggtaaaaaatgcgataaatttcaggca

SEQ ID NO: 1632 - protein, 48 aa, Haemophilus influenzae
  Name: NTH0896
LDDLSLYFPFIKWLKISELDYNANVCLNIEKIKYNFLKCGKKCDKFQA

SEQ ID NO: 1633 - DNA, 702 bp, Haemophilus influenzae
  n 693, 694, 695, 696, 697: n is any nucleotide
  Name: NTH0897
atgacagatcgtccaattcgtcaggctttactaagtgtgtctgataaaacgggtattgtagagtttgctcaaggtttagttaaacgtggtgtaaaactactttcaacaggtggaacggcaaaacttttagcacaaaatggtttacctgtaattgaagtgtctaattacacaggtttccctgaaatgatggacggtcgagtgaaaaccttacatccaaaaatacacggtgggattcttggtcgtcgtggtacggacgatgccattatgcaacaacatagtattgaaggcattgatatggttgttgtgaatttatatccctttgcagctaccgttgctaaaccagattgcaccttgactgatgcggtagaaaatatcgatattggggggccaaccatggttcgttctgcggcgaaaaaccataaagatgtagcgatcatagtgaataataatgattttaacgccattcttacagaaatggataaacaccaaaacagcctaacttttgaaactcgttttgatcttgcgattaaagcatttgaacataccgctcaatatgattctatgattgccaactatttcggtcagctagtaaaaccttatcatattgcagaggaagaagaggcgaatgcgaagtgcggtcaattcccacgaactttaaatcttaattcggtgcgggtaccgagtccgaatcgnnnnnttaat

SEQ ID NO: 1634 - protein, 234 aa, Haemophilus influenzae
  Xaa 232, 233: Xaa is any amino acid
  Name: NTH0897
MTDRPIRQALLSVSDKTGIVEFAQGLVKRGVKLLSTGGTAKLLAQNGLPVIEVSNYTGFPEMMDGRVKTLHPKIHGGILGRRGTDDAIMQQHSIEGIDMVVVNLYPFAATVAKPDCTLTDAVENIDIGGPTMVRSAAKNHKDVAIIVNNNDFNAILTEMDKHQNSLTFETRFDLAIKAFEHTAQYDSMIANYFGQLVKPYHIAEEEEANAKCGQFPRTLNLNSVRVPSPNRXXN

SEQ ID NO: 1635 - DNA, 1656 bp, Haemophilus influenzae
  Name: NTH0898
ttgagctttccttatttatattcgagtattttaatgactgacaaaattacttttaatgacttaggcttacctgagttcatcttaaaagctgtttctgacttaggttttgaaaccccttctccaattcaacaagcttgtatcccacatttgctcaatggcaatgatgtgctaggtatggcacaaacgggtagtggtaaaaccgctgcttttgcactgcctttattagcgcaaatcgatccaagtgaaaaacatccacaaatgttagtgatggcgcctacacgcgaacttgctattcaagttgccgatgcgtgtgaacaatttgttaaatatgcacacggcactcgcattgttaccttatatggtggccaacgttatgacatccaacttcgtgcattaaaacaaggcgcacaagtggttgtgggtacaccaggccgtattcttgaccatattcgtcgcagaacattaaatctttctgaacttcgttttatcgtattagatgaagccgatgaaatgctacgcatgggtttcattgatgatgtagaaaccgtcatggcagaattaccagaaaatcatcaaactgcgttattctctgcaacaatgcctgaaccgatccgtcgtattacgaaacgttttatgaatgatccacaagaagtgaagatcaaagtgaataacgaaaatgccccagatatcgaccaaagttgttggtatgtacacggcgtgcgtaaaaacgaagctcttcttcgtttcttagaagtggaagattttgatgcagcgattatttttgctcgcactaaaactggtactttagacattacagaactacttgaaaaaaatggtttccgttctgccgcacttaatggcgatatgacacaacaattacgcgaacaaaccctcgatcgcttacgtaacggcagtttagatattgttgtggcaaccgatgtggctgcacgcggtattgatattgaacgtatcagccttgtggtgaactacgacattccgcttgatgcagaatcttatgtacaccgaattgggcgtactggtcgtgctggtcgttctggtcgtgctttattatttgttgaacctcgcgagcgtcgtttacttcgtaatattgaacacctaatgaaaaaaggtatcaatgaagtagaattgccaaatcatcttgtgttacaagaatgccgccgcaaaaaatttgtcgccaaaattacgaaacaactcgagcatcacgatttagaacaatatcgtagtttattagaagacttattcacagccgatcaggatcaagaagatattgctgcagcaatgttgatgctgcttcaaggcaaacaaaaattaattcttccacctgatccgccaatggaaaaacgtcgtcgtgaacgtaatgatcgcggtgatcgccgtgaaaatccacgttcagctgaacgtcgtggcgaacgtaaaggctatggaaatccacaaccaatggatttatatcgtatcgaagtcggtcgtgcagatggtgtaaaagctcgccatatcgttggtgcgattgctaacgaaggcgatattaacagccgttatattgggcatattaaactttatgatgactacactaccgtggaattgccacaaggcttgccgaaagattatttgcacatttcgctaaaaccgcgtattgaa

SEQ ID NO: 1636 - protein, 552 aa, Haemophilus influenzae
  Name: NTH0898
LSFPYLYSSILMTDKITFNDLGLPEFILKAVSDLGFETPSPIQQACIPHLLNGNDVLGMAQTGSGKTAAFALPLLAQIDPSEKHPQMLVMAPTRELAIQVADACEQFVKYAHGTRIVTLYGGQRYDIQLRALKQGAQVVVGTPGRILDHIRRRTLNLSELRFIVLDEADEMLRMGFIDDVETVMAELPENHQTALFSATMPEPIRRITKRFMNDPQEVKIKVNNENAPDIDQSCWYVHGVRKNEALLRFLEVEDFDAAIIFARTKTGTLDITELLEKNGFRSAALNGDMTQQLREQTLDRLRNGSLDIVVATDVAARGIDIERISLVVNYDIPLDAESYVHRIGRTGRAGRSGRALLFVEPRERRLLRNIEHLMKKGINEVELPNHLVLQECRRKKFVAKITKQLEHHDLEQYRSLLEDLFTADQDQEDIAAAMLMLLQGKQKLILPPDPPMEKRRRERNDRGDRRENPRSAERRGERKGYGNPQPMDLYRIEVGRADGVKARHIVGAIANEGDINSRYIGHIKLYDDYTTVELPQGLPKDYLHISLKPRIE

SEQ ID NO: 1637 - DNA, 126 bp, Haemophilus influenzae
  Name: NTH0899
atggcaaatcaggtttataactttgttgagtatcgttttgccgcgtttgaactcatgaaattaaaaccggttcaaacagaagacgaaaaagaagagaaaagtgcggtaacaaaagcgattgttttc

SEQ ID NO: 1638 - protein, 42 aa, Haemophilus influenzae
  Name: NTH0899
MANQVYNFVEYRFAAFELMKLKPVQTEDEKEEKSAVTKAIVF

SEQ ID NO: 1639 - DNA, 192 bp, Haemophilus influenzae
  Name: NTH0900
gtgacaatggggcatattgaacgtgagcatttatctgctgcaaaatgcatagtgccaaatgacgaattattagcaaataaagcattagaaaatattttagaaaaaattatttttaacaggctggaaaatttcaatcttcaaaacacaagagatttattattacctagattgttaaatggtgaactcaatgga

SEQ ID NO: 1640 - protein, 64 aa, Haemophilus influenzae
  Name: NTH0900
VTMGHIEREHLSAAKCIVPNDELLANKALENILEKIIFNRLENFNLQNTRDLLLPRLLNGELNG

SEQ ID NO: 1641 - DNA, 1056 bp, Haemophilus influenzae
  Name: NTH0901
atggtgaactcaatggatagaactaccgattatttagaacgacttttcattgaggaactaaactctgaaggcgaaattattatcagcggaaacagttttttccgacatgaaattttatatactcttgatcctgaagcatataaagacgtttttgaattttggaaaacagaaagaaaacaaagaaacttaaatgaagccaatagaatattggatattacttcagataatcgaaatcgatttattcgattaaaagaactcttcaaagagaaaaagattatcccctttattggagctgggatgtccatgtctacaggtttaccttcttggagcgaatttcttcgtagtgttcaacaagaaactagaactgatcgtttctattttgaagatctcttatcgcaaggtgaatttgaagaagctgctcagtatctagatgactgtagtccttcacacttacaagagcagttagataatatatttggtagaaaatatctatttaatgaaataaatggtgtaatttgccttttaccaaaattttttaataatactcctattattacaacaaattatgacaatatacttagtactgtttatcaaaaatgcgattacccattttctgatgaactaaatggattatacctagaagacctttataataaacttcttgataaacaaaatttcttattaaagatacatggtacttttgataaaccacaaaatcgaatactaacaaaaaatgactacgataaacactacaatgaccaaactagtaaattgaaaaattgtgtagaaagcttattttcaagttctctattatttatcggttgtagtttaactattgatcgcttaattaaggcgctagccgagattgttcaagaaaaaggcagtgaaaatctacctagacattatgcttttttattttcagatcctaaaaaggacgtgaacagaattaacaaaaaagaagaattagcaaaatccaatatttttccaatttggtatgatggcgatcatgatgaaagcattgaagccttgctggaattattaaatgatggagaacaa

SEQ ID NO: 1642 - protein, 352 aa, Haemophilus influenzae
  Name: NTH0901
MVNSMDRTTDYLERLFIEELNSEGEIIISGNSFFRHEILYTLDPEAYKDVFEFWKTERKQRNLNEANRILDITSDNRNRFIRLKELFKEKKIIPFIGAGMSMSTGLPSWSEFLRSVQQETRTDRFYFEDLLSQGEFEEAAQYLDDCSPSHLQEQLDNIFGRKYLFNEINGVICLLPKFFNNTPIITTNYDNILSTVYQKCDYPFSDELNGLYLEDLYNKLLDKQNFLLKIHGTFDKPQNRILTKNDYDKHYNDQTSKLKNCVESLFSSSLLFIGCSLTIDRLIKALAEIVQEKGSENLPRHYAFLFSDPKKDVNRINKKEELAKSNIFPIWYDGDHDESIEALLELLNDGEQ

SEQ ID NO: 1643 - DNA, 744 bp, Haemophilus influenzae
  n 624, 633, 635, 658, 683, 689, 694, 701, 702, 711, 712, 713, 715, 718, 735, 739: n is any nucleotide
  Name: NTH0903
atgatggagaacaataaaatgctcaacgaaaacgacatcgaacaactcacccttcaacgcctgcaatccctcggttgggaatatcgctatggtaaagatttgcctgttcatgagggcgaattttcccgtggcaatttgagcggtgtagtttttattgagcaactgcgtgaggcggtgcgtaaacttaatccgcagctgcctgaaagtgcggttgattctgtggtgaaatccgcgacaaaaagcgatattggcgacttggttgtgcgtaatcagacgttttataaattgttgcgtgatggtgtacgggtagaatatcaagatgatggtgagcagaaaatcgagatggcgcgtttggtggattttgagcatggggaaaacaaccgctttgtcgccgtcaatcagctggaaatccgcagccgtaaaggaggtaaacggattcccgatattatcggctttgtaaatgggctgcctttggtggtatttgagctcaaaaatccgctgcgtgaatcggcggatttattgcaggcgtttaatcagtttgaaacctataaagatgaaattgccgagctgtttgtttacaaccaagccctgattatttcagacggcattgccgcccgtttgggntcgctttcngnagattttcaacgctttacgccgnggaaagtgggctatgaaaaaaatanaagcgngcggntatattnngaccaacannncncancccgcccatggctttangccnccctg

SEQ ID NO: 1644 - protein, 248 aa, Haemophilus influenzae
  Xaa 212, 220, 228, 230, 232, 234, 237, 238, 239, 240, 245, 247: Xaa is any amino acid
  Name: NTH0903
MMENNKMLNENDIEQLTLQRLQSLGWEYRYGKDLPVHEGEFSRGNLSGVVFIEQLREAVRKLNPQLPESAVDSVVKSATKSDIGDLVVRNQTFYKLLRDGVRVEYQDDGEQKIEMARLVDFEHGENNRFVAVNQLEIRSRKGGKRIPDIIGFVNGLPLVVFELKNPLRESADLLQAFNQFETYKDEIAELFVYNQALIISDGIAARLGSLSXDFQRFTPXKVGYEKNXSXRXYXDQXXXXRPWLXAXL

SEQ ID NO: 1645 - DNA, 99 bp, Haemophilus influenzae
  n 3, 13, 17, 34, 37, 39, 40, 41, 50, 51, 58, 63, 69, 94: n is any nucleotide
  Name: NTH0904
gtnatcacagggnggcntaaagccatgggcgggntgngnnntgttggtcnnaatatanccgcncgcttntatttttttcatagcccactttccncggcg

SEQ ID NO: 1646 - protein, 33 aa, Haemophilus influenzae
  Xaa 5, 6, 12, 13, 14, 17, 20, 23, 32: Xaa is any amino acid
  Name: NTH0904
VITGXXKAMGGXXXVGXNIXARXYFFHSPLSXA

SEQ ID NO: 1647 - DNA, 318 bp, Haemophilus influenzae
  n 309, 310, 311, 312, 313: n is any nucleotide
  Name: NTH0905
ttgtctaaaaaatacaggaaaaacgcaccgcacttttggagtgattttagaggaacttttagtaaggatattgttatgacagatcgcgttattatttttgataccaccttgcgtgatggggaacaggcgttaaaagcaagtttgacggtaaaagaaaaattacagatcgctttagcacttgaacgcttaggtgtggatgtaatggaagtggggtttcccgtttcttctcaaggggattttgaatcggtacaaaccattgcgcgccatatcaaaaacgctcgtgttgccgcgttttctcgagccagtagnnnnnttaat

SEQ ID NO: 1648 - protein, 106 aa, Haemophilus influenzae
  Xaa 103, 104, 105: Xaa is any amino acid
  Name: NTH0905
LSKKYRKNAPHFWSDFRGTFSKDIVMTDRVIIFDTTLRDGEQALKASLTVKEKLQIALALERLGVDVMEVGFPVSSQGDFESVQTIARHIKNARVAAFSRASXXXN

SEQ ID NO: 1649 - DNA, 141 bp, Haemophilus influenzae
  Name: NTH0906
ttggcattttatattaaaaataaacctactcacactttattaaatatatatttaactaataaatttaataaaatcagaatatttaaccaatttaatcgtcatcaacaaatttttcttattggattttttacattttcaaaa

SEQ ID NO: 1650 - protein, 47 aa, Haemophilus influenzae
  Name: NTH0906
LAFYIKNKPTHTLLNIYLTNKFNKIRIFNQFNRHQQIFLIGFFTFSK

SEQ ID NO: 1651 - DNA, 1119 bp, Haemophilus influenzae
  Name: NTH0907
atgaatgacattacctacacattactccgtttaatgcaagtgcctaaacttggcggcgttggcattgataaaattttgtccaatattaccttaaatgaattacttaattatgatgatgttgctttccgacaaatgggatggggagccattcaaattcgccgttggttcaaacctgaagcaaaatttattgagccagcactcgcgtggtcacaaaaagagggaaatcatttagtaaattatttttcccctttttatccctttttattgaaacaaaccgcaaactttccgccactattatttgtaaaaggaaatttaaccgcactttcacaacgccaaatggcaatggttgggagccgttattgcacgacttatggagaatattgggcaaaacattttgcaacagaactttcattagcgggttttaccataacaagcggtttagcattaggaattgatggtcattgtcatcaggctgtcgtcaatattcaagggcaaactattgcggtcttaggcagtggattagaacaaatctatccctctaaacatcaaagattatcagcacaaatcatcgaaaataatggggcattagtctctgaatttttacctaaccaagcacctattgctgctaattttccacgccgtaatcggattattagtgggctttcagtcggcacgctcgttgttgaagccaccgaaaaaagtggatcacttattactgcacggtatgcgttggaacaaaaccgagaggtttttgctgtgccaggcaatattcaaaatgaatcaagtcaaggttgtcatcgcctgattaaacaaggcgcaatgttggtagaaaatgcaaaggacattttggaaacgctctaccaacattctatccacagccaaactgaaattgattttgaccagatcgccgtgcctaattacacgccaccacccgatcctcgccgattagtagaagcaccaagccacccgaaactttattcacgtattggctatactcctgtgagcattgatgatttagctgaagaatttaatttaagtgtcgatgttttacttgttcaattgctcgatcttgagctacaagatcttatcataagtgaaaatggcttatataaacgcatt

SEQ ID NO: 1652 - protein, 373 aa, Haemophilus influenzae
  Name: NTH0907
MNDITYTLLRLMQVPKLGGVGIDKILSNITLNELLNYDDVAFRQMGWGAIQIRRWFKPEAKFIEPALAWSQKEGNHLVNYFSPFYPFLLKQTANFPPLLFVKGNLTALSQRQMAMVGSRYCTTYGEYWAKHFATELSLAGFTITSGLALGIDGHCHQAVVNIQGQTIAVLGSGLEQIYPSKHQRLSAQIIENNGALVSEFLPNQAPIAANFPRRNRIISGLSVGTLVVEATEKSGSLITARYALEQNREVFAVPGNIQNESSQGCHRLIKQGAMLVENAKDILETLYQHSIHSQTEIDFDQIAVPNYTPPPDPRRLVEAPSHPKLYSRIGYTPVSIDDLAEEFNLSVDVLLVQLLDLELQDLIISENGLYKRI

SEQ ID NO: 1653 - DNA, 855 bp, Haemophilus influenzae
  Name: NTH0908
gtgaaaatggcttatataaacgcatttaacgtaaatttttatgctaagatacgcccattcttttttcataaaaggacgattatgttagccattatctcccctgccaaaacccttgattttgaaagtgcggtaaaaaattttcctgtttttcaaccgcactttactgattacagcgaacaacttattgaggtttgtcgtaaactttctccgcaagatctttcatcattaatgtctatcagcgataaattagcagggcttaatgttgcacgttttgctgaatggacaaaaattcacaatgaagacaattctcgccctgcactctttgcatttaaaggcgatgtttatacgggtttagatgctgattccctttcggaagatgatgtcatttttgcacaatcccatttacgtatgctttctgggctttatgggcttttaaaaccacttgatttaatgcaaccttaccgattagaaatggggacaaaattagccaatccgaaaggaaaagatctgtatgccttttggggaaatgtgattacccaagcagttcaacaagctattgatgcacaaggcgataatgtgttagtcaatctagcctctgatgaatattataaatctgttaaagaaaaccaacttaacgccaaaattatcaagccagttttcttagacaataaaaatggaaaatacaaagtaattagcttttatgctaaaaaagcgcgaggattaatgtgccgttatcttattcaaaatcgtttaaccgacattgaacagttaaaagaatttgatttaggtggttattggtttgattcagcatcctccactgaaactgaatttgtctttaagcgagatattaatgaa

SEQ ID NO: 1654 - protein, 285 aa, Haemophilus influenzae
  Name: NTH0908
VKMAYINAFNVNFYAKIRPFFFHKRTIMLAIISPAKTLDFESAVKNFPVFQPHFTDYSEQLIEVCRKLSPQDLSSLMSISDKLAGLNVARFAEWTKIHNEDNSRPALFAFKGDVYTGLDADSLSEDDVIFAQSHLRMLSGLYGLLKPLDLMQPYRLEMGTKLANPKGKDLYAFWGNVITQAVQQAIDAQGDNVLVNLASDEYYKSVKENQLNAKIIKPVFLDNKNGKYKVISFYAKKARGLMCRYLIQNRLTDIEQLKEFDLGGYWFDSASSTETEFVFKRDINE

SEQ ID NO: 1655 - DNA, 156 bp, Haemophilus influenzae
  n 137, 147, 148, 149, 150, 151: n is any nucleotide
  Name: NTH0909
ttgtctttaagcgagatattaatgaataaaatttttgttattttgaccgcacttatacttcagggctgtgcaactaagctgacccaattaaatgtgcctacgcagttagaatataatggggaaccgaggctgatatncgtaaaacannnnnttaat

SEQ ID NO: 1656 - protein, 52 aa, Haemophilus influenzae
  Xaa 46, 49, 50, 51: Xaa is any amino acid
  Name: NTH0909
LSLSEILMNKIFVILTALILQGCATKLTQLNVPTQLEYNGEPRLIXVKXXXN

SEQ ID NO: 1657 - DNA, 318 bp, Haemophilus influenzae
  n 309, 310, 311, 312, 313: n is any nucleotide
  Name: NTH0910
atgacagtctgctcacgccgaaactttgtttctggcatgggggcagtgatccttatgacgggaacatctttaccttcttttgcaaaagaagacaaggcggataaacctaaacgttacgcaatgatacatgatgaaaatgcgtgtatcggttgtacagcctgtatggactcatgtcgtgatgtaaaccaagtgccagaaggcgtttctcgcttagagattctacgtagtgaaccttatggggaatttccaaatcaagaatacgagttctttcgtcaatcttgccaacattgtacaaatgcaccttgggtnnnnnttaat

SEQ ID NO: 1658 - protein, 106 aa, Haemophilus influenzae
  Xaa 104, 105: Xaa is any amino acid
  Name: NTH0910
MTVCSRRNFVSGMGAVILMTGTSLPSFAKEDKADKPKRYAMIHDENACIGCTACMDSCRDVNQVPEGVSRLEILRSEPYGEFPNQEYEFFRQSCQHCTNAPWVXXN

SEQ ID NO: 1659 - DNA, 294 bp, Haemophilus influenzae
  Name: NTH0912
atgcgttttgaaggagatattttcggtaataaaaaaccgatgtattcagttcaagaacaaaaccaagtttgttttgcttgccatcaacctgacaaacttcgtgaaaaattatgggctcatgatgtacacgcaatgaaattgccttgcgcaagttgccatacgcttcaccctaaagaagacgcaatgaaaggtattcaaccaaaacaacgcgttaaactttgcgtagattgccatggtaaacaacaaaaacgtaaagctgaacaagataaactaaccaaacaaaaggataaacaa

SEQ ID NO: 1660 - protein, 98 aa, Haemophilus influenzae
  Name: NTH0912
MRFEGDIFGNKKPMYSVQEQNQVCFACHQPDKLREKLWAHDVHAMKLPCASCHTLHPKEDAMKGIQPKQRVKLCVDCHGKQQKRKAEQDKLTKQKDKQ

SEQ ID NO: 1661 - DNA, 831 bp, Haemophilus influenzae
  Name: NTH0913
ttgcgttggtgcgtagatgaaatggaacgtcgttatcagttgctttcagctttacgcgtacgaaacattgaaggctttaatgaaaaaattgatgaatacgaagcaatgggaatgcctgtgccaaatccaatttggcgaccgagcgatacgatggatgcaatgccaccagcgttgaaaaaattgagttatattgtggttattgtcgatgagtttgctgatttaatgatggtagcgggtaagcaaatcgaagaactgattgcacggttggcacaaaaagcgcgagctattggtatccatttaattttagccacacaacgcccctctgtggatgtgattactggtttaattaaagcaaatattccaagtcgcattgcctttacggtggcaagtaaaattgactcacgtactattcttgatcaagggggtgcagaagcccttttagggcgtggagatatgctttattctggacaaggttcatctgatttaatccgcgtacatggagcctatatgagtgatgatgaagtcatcaatattgccgatgattggcgagcacgcggtaaacctgattatattgatggaattttagaaagtgctgacgatgaggaaagtacagaaaaagggatatcaagcggtggagaattagatccactctttgatgaagtaatggactttgttattaatactggtacaacttcagtatcttctattcaacgtaaattcagcgtaggttttaaccgagcagcgcgtattatggatcaaatggaagagcaagggattgtcagcccaatgcaaaatggtaagcgtgaaattttatcgcatcgtccagaatac

SEQ ID NO: 1662 - protein, 277 aa, Haemophilus influenzae
  Name: NTH0913
LRWCVDEMERRYQLLSALRVRNIEGFNEKIDEYEAMGMPVPNPIWRPSDTMDAMPPALKKLSYIVVIVDEFADLMMVAGKQIEELIARLAQKARAIGIHLILATQRPSVDVITGLIKANIPSRIAFTVASKIDSRTILDQGGAEALLGRGDMLYSGQGSSDLIRVHGAYMSDDEVINIADDWRARGKPDYIDGILESADDEESTEKGISSGGELDPLFDEVMDFVINTGTTSVSSIQRKFSVGFNRAARIMDQMEEQGIVSPMQNGKREILSHRPEY

SEQ ID NO: 1663 - DNA, 615 bp, Haemophilus influenzae
  Name: NTH0914
atgaaaaaaacaaccttaaaatttgccgcacttaccttacttggtttgagtaatttggcattggctgatgcggcaagtgaattacaaatgcgtttagctaaagtcgatgtattaagtgcagaatttgtgcaaacagtgacttctggaagtggaaaaaatgttcaacaaggaagtggcaaacttcaaattaaacgcccaaatttattccgtatggagactaaaacccctcaagaaacccagattatttctgatggtaaaaccttatggttctacgatccatttgtgcaacaagtgaccgcacaatgggtaaaaaatgcggtaaataatactccttttgttttgcttaccagcaatgataatagccattggcatcaatatacggtaacacaacaatcggatacctttgtgttaaaaccaaccttatccacaagcaacattaagcaatttgatattcgtgttgatgctaatggaatattgcgaaatttcagtacgacagagaaagatgggcaaaccaatctttatgttttacgtaatattacgaatcaaaccttgtctgatagcttgttccaattcaagccagaaaaaggcgttgaagtggatgaccaacgtaaaaaa

SEQ ID NO: 1664 - protein, 205 aa, Haemophilus influenzae
  Name: NTH0914
MKKTTLKFAALTLLGLSNLALADAASELQMRLAKVDVLSAEFVQTVTSGSGKNVQQGSGKLQIKRPNLFRMETKTPQETQIISDGKTLWFYDPFVQQVTAQWVKNAVNNTPFVLLTSNDNSHWHQYTVTQQSDTFVLKPTLSTSNIKQFDIRVDANGILRNFSTTEKDGQTNLYVLRNITNQTLSDSLFQFKPEKGVEVDDQRKK

SEQ ID NO: 1665 - DNA, 576 bp, Haemophilus influenzae
  n 541: n is any nucleotide
  Name: NTH0917
atgtctaacctcaattttgattttgccgaaaatgattttcgcccactggcggccaagatgcgtccaacaaatctagaacaatattttgggcaaagccatttaattggcgagggcaagccactgcgaaaagctatccaagctgggcatattcattctatgattttgtggggcccaccaggtacggggaaaacaacccttgcagaaatcatagcacaacgtattaatgcagaagtagagcgaatttctgcggtgacgagtggtatcaaagaaattcgtgaagcgattgatcgtgcaaaacaaaatcgtcttgcggatcgtaaaactatcttatttgtggatgaagtccatcgttttaataaaagccagcaagatgcatttttaccgcacattgaagacggaaccgttatttttattggggcgacaacagaaaatccctcttttgagctaaataatgcgttgctttctcgtgcccgagtgtatgtgctgaaatcactcacaacggctgaaattgaacaagttttgcagcaagctgtagaagatnctgaacgaggattgggtaaagaggggtaccgagcc

SEQ ID NO: 1666 - protein, 192 aa, Haemophilus influenzae
  Xaa 181: Xaa is any amino acid
  Name: NTH0917
MSNLNFDFAENDFRPLAAKMRPTNLEQYFGQSHLIGEGKPLRKAIQAGHIHSMILWGPPGTGKTTLAEIIAQRINAEVERISAVTSGIKEIREAIDRAKQNRLADRKTILFVDEVHRFNKSQQDAFLPHIEDGTVIFIGATTENPSFELNNALLSRARVYVLKSLTTAEIEQVLQQAVEDXERGLGKEGYRA

SEQ ID NO: 1667 - DNA, 858 bp, Haemophilus influenzae
  Name: NTH0918
gtggcgaacccacaattagccgcattgtttgataaatatatcggttcagaatggcgttgtgatttaagtcaaatcgaaaaacttaaaccatttacgcaagaaaaagcatttaaagaggctgttgctgacattaaatttgctaataaagtgaaattagcggaatacgtaaaacgcgagttaggggtagagcttgatccgcacgccttatttgacgtgcaagtaaaacgtattcacgaatataaacgccaaatgttgaacgtattgcatattattgctcgctacaatgaaatgcttgccaaccctgaaaaagattggcaacctcgcgtatttattttagcaggtaaagcggcttcggcttactatgctgcgaaacaaacgatccatttaattaatgatgttgctaatgtcatcaataatgatgagcgtttgaaaggccgtttaaaagttgtatttattccaaattacagcgtgagccttgcacagcttatcatcccagcagcagatatttcagagcaaatatcccttgcaggcacagaggcttctggcaccagtaatatgaagtttgccttaaatggcgcattgacactcggtacacttgacggtgcgaacgtagagatcttggaaaatgtgggcgaaaatcacattttcatcttcggtaatacggtagaacaagtggaacaacttcgtcgcgacggctatcgttcatttgaatactatcaaaacgatgctcaattacgcacagtcgtggatcaaattattgagggtaaattctcaccagaagaacctcaacgttatcatcaactattacaaggcttgcaataccacgattattatcaagcttttgctgatttccgcagt

SEQ ID NO: 1668 - protein, 286 aa, Haemophilus influenzae
  Name: NTH0918
VANPQLAALFDKYIGSEWRCDLSQIEKLKPFTQEKAFKEAVADIKFANKVKLAEYVKRELGVELDPHALFDVQVKRIHEYKRQMLNVLHIIARYNEMLANPEKDWQPRVFILAGKAASAYYAAKQTIHLINDVANVINNDERLKGRLKVVFIPNYSVSLAQLIIPAADISEQISLAGTEASGTSNMKFALNGALTLGTLDGANVEILENVGENHIFIFGNTVEQVEQLRRDGYRSFEYYQNDAQLRTVVDQIIEGKFSPEEPQRYHQLLQGLQYHDYYQAFADFRS

SEQ ID NO: 1669 - DNA, 969 bp, Haemophilus influenzae
  Name: NTH0919
ttgggcaatggtggtttaggtcgtttagccgcttgttttatggattctattgcgacccttggtttaccgggtatgggctacggtattcgttatgaatatggtatgttccgccaaaaaattgaaaatggtcagcaagtcgagcgtcctgatgcatggcttgaaaaaggagcaccttgggaatttattcgtccatctaaacgctttaccgtagaatttggtggaaacattcatttcgaaggcaaaaaatgtatttggcaagataccgaaaaagtaaccgcacttgcttacgatcaaatgatcccaggttatcaaaataattctgcagcaacattacgtttatggtcggcacacgcaggcgaagtgtttaaccttgccgacttcaaccgtggcgaacatttagccgcattagaagagcactccgcaaataaaaatttatcacgtgtactttaccctgatgattctacttggaatggtcgcgaattgcgtttacgtcaagagtatttcttagtctctgcatcgcttcaagatattttacgccgtcacaaacgcacccacgacagccttgaaaacttggcggataaagtggcgatccacttaaatgatacccacccagcgttagcgattcctgaattaatgcgtattttagtggacgatgaaggtttcgagtggaaaaaagcgtgggagatgacgcgtaacattttctcttacacctgccatactttaatgtccgaagcgttagaaacttggcctgtggaaatgatggcaaaaatcttgccacgtcatttacagatgatttttgaaattaacgatcacttcttagaatatgtccgcacttatgtaacgactgacaacgattttatccgccgtgtttctcttatcgaagaaggctaccaacgcaaagtgcgtatgggatggctatccgtagtaggttcacacaaaatcaacggggttgccgaaattcattcgatt

SEQ ID NO: 1670 - protein, 323 aa, Haemophilus influenzae
  Name: NTH0919
LGNGGLGRLAACFMDSIATLGLPGMGYGIRYEYGMFRQKIENGQQVERPDAWLEKGAPWEFIRPSKRFTVEFGGNIHFEGKKCIWQDTEKVTALAYDQMIPGYQNNSAATLRLWSAHAGEVFNLADFNRGEHLAALEEHSANKNLSRVLYPDDSTWNGRELRLRQEYFLVSASLQDILRRHKRTHDSLENLADKVAIHLNDTHPALAIPELMRILVDDEGFEWKKAWEMTRNIFSYTCHTLMSEALETWPVEMMAKILPRHLQMIFEINDHFLEYVRTYVTTDNDFIRRVSLIEEGYQRKVRMGWLSVVGSHKINGVAEIHSI

SEQ ID NO: 1671 - DNA, 351 bp, Haemophilus influenzae
  n 331: n is any nucleotide
  Name: NTH0920
atgataatggataactttgattctccattccaatataatcgtcctgaaatgaccgttgaagcgattaaaaaatcaatcgtttacaaacttattttcttaatcggtcgctctccacgtgaagccagccaacgcgattggctcaatgcaacacttcacgctgtgcgtgatttagtaacagagggttggatcactactgctcgccaaactcgagcagaagattctcgccgtgtttactacctttcaatggaatttttaatcgggcgtacgctatctaatgcaatgattgcagaaggcatttatggattagcacaggaagcactttctgaattanatgtggatttagaagagttt

SEQ ID NO: 1672 - protein, 117 aa, Haemophilus influenzae
  Xaa 111: Xaa is any amino acid
  Name: NTH0920
MIMDNFDSPFQYNRPEMTVEAIKKSIVYKLIFLIGRSPREASQRDWLNATLHAVRDLVTEGWITTARQTRAEDSRRVYYLSMEFLIGRTLSNAMIAEGIYGLAQEALSELXVDLEEF

SEQ ID NO: 1673 - DNA, 129 bp, Haemophilus influenzae
  Name: NTH0921
gtgaatgttgtttacacagcctacaaagtagttcgaattttatgcttatctttgcaaaaaacaagcacaaccacaccgcttgcaaaatattctttcacaagcggtgtgattgttaagaaagtttacgaa

SEQ ID NO: 1674 - protein, 43 aa, Haemophilus influenzae
  Name: NTH0921
VNVVYTAYKVVRILCLSLQKTSTTTPLAKYSFTSGVIVKKVYE

SEQ ID NO: 1675 - DNA, 759 bp, Haemophilus influenzae
  Name: NTH0923
atgcctacggtttgcaaaggctggctttctgggttaaaagcgcgaggtcgtttggtggggattttaaatggtgtggacgaaaatatttggcatccgaacgtggatcaatacattccgcgccattacaagctcaaatatatggcaggcaaaaagaaaaacaaagccgaactgcaagcctatttcaatttgccacaagatgaatctgccttggcatttgtgatggttacccgtttaaccgagcaaaaaggtgttgatttattaatcgaaagtgcagacgaaatcgtcaaacaaggcggtcagttgatgattttaggttcaggtgcaccgcactttgaacaaggtattcgtgagcttgctgaacgttatccgcaaaatattgcggtaaaaatcggctacgatgaagccctttcgcatttaatggtggcaggtggcgatgtgattttagtgccaagtcgtttcgagccttgtggcttaacccaactttatggtttgcaatatggcacactgccacgtgttcgtaaaacaggtggtttagcggatacggtggtggatagcacttcagaaagcatcaaagctcgcaccgcaacaggttttgtgtttgaaagtgcaacgcctgaagctctccgccattgcttgcaacgtgcctttgccttatggcaaaaaccgcgtgcatgggcgatggttcgtacagatgcaatggaacaagacttcagctggcgtaaggctgcagagcaatatagaacactttatgaacgcttg

SEQ ID NO: 1676 - protein, 253 aa, Haemophilus influenzae
  Name: NTH0923
MPTVCKGWLSGLKARGRLVGILNGVDENIWHPNVDQYIPRHYKLKYMAGKKKNKAELQAYFNLPQDESALAFVMVTRLTEQKGVDLLIESADEIVKQGGQLMILGSGAPHFEQGIRELAERYPQNIAVKIGYDEALSHLMVAGGDVILVPSRFEPCGLTQLYGLQYGTLPRVRKTGGLADTVVDSTSESIKARTATGFVFESATPEALRHCLQRAFALWQKPRAWAMVRTDAMEQDFSWRKAAEQYRTLYERL

SEQ ID NO: 1677 - DNA, 144 bp, Haemophilus influenzae
  Name: NTH0924
atggaaacattccctcaccggccgatgaaagaacaaggggtggaacaaaaagaaaaacgcggggccgatcgaacagggacgatggcagaagaaaggcggaggcttaatgggcgggatacaaaaaagaaagcggggttgttaaaa

SEQ ID NO: 1678 - protein, 48 aa, Haemophilus influenzae
  Name: NTH0924
METFPHRPMKEQGVEQKEKRGADRTGTMAEERRRLNGRDTKKKAGLLK

SEQ ID NO: 1679 - DNA, 315 bp, Haemophilus influenzae
  n 306, 307, 308, 309, 310: n is any nucleotide
  Name: NTH0925
atggaattagtatttatccgtcacggttttagtgaatggaatgcgaaaaacttattcacaggctggcgtgatgtgaatttaactgaacgtggtgtggaagaagcaaaagctgcgggtaaaaaactgttagacaaaggttatgaatttgatatcgcatttacctctgttttaactcgagcaatcaaaacttgtaatatcgtgttagaagaatcccatcaattatggattccgcaagtaaaaaactggcgtttaaatgaacgtcattatggtgctttacaaggtttagatgggtaccgagtcgatatnnnnnttaat

SEQ ID NO: 1680 - protein, 105 aa, Haemophilus influenzae
  Xaa 102, 103, 104: Xaa is any amino acid
  Name: NTH0925
MELVFIRHGFSEWNAKNLFTGWRDVNLTERGVEEAKAAGKKLLDKGYEFDIAFTSVLTRAIKTCNIVLEESHQLWIPQVKNWRLNERHYGALQGLDGYRVDXXXN

SEQ ID NO: 1681 - DNA, 1230 bp, Haemophilus influenzae
  Name: NTH0926
atgttgcgttttggcgttaatcaaaaaacatcattattattaaccgcacttttaagctgcggtttattaatattttcgcctgtcagccaatcttccgatctcaatcaaattcaaaaacaaattaagcaacaagaatctaaaatagagaagcaaaaacgtgagcaagctaagttacaagcaaatttaaaaaaacacgagagtaaaattaacagtgttgagggcgaactgcttgaaacagaaataagtttaaaggaaattcgtaagcaaattgccgatgcagataagcaactcaaacaattagaaaaacaggaacgtgagcaaaaagcacgattaaccaaacaaatagatataatttatcgttcaggcattaatccatcgctgattgaacgaatgtttgcccaagatccgacaaaagcagagcgaatgaaagtttattatcagcatttaaatcaagttcggattgaaatgattaataatttaaaagcaacgcaagcacaaattgcagtacaaaaaaaggcgattttctctcaacaaaagaatcaccgaaatcaactttccacacaaaaaaaacaacaacaagcattgcaaaaagcacagcaagagcatcaatctacgctgaatgaactcaataaaaatttagccctagatcaagataaattgaatgcactaaaagcaaacgaacaagcacttcgtcaagaaattcaacgagctgaacaagcagcgcgcgaacaagaaaaacgtgaaagagaggcacttgctcaacgccaaaaagctgaagaaaaacgaacatcaaaaccttatcaaccaactgtacaagaacgccaattacttaatagtacaagcggtttaggggcggcaaaaaaacaatattccttaccagtttctggttcaattttgcatacttttggttctatccaagcaggcgaagtacgttggaaaggtatggtaattggcgcatcagcaggcacgcctgttaaagcaattgctgctggacgcgtcattttagcgggatatttaaatggttatggttatatggttattgttaaacacggcgaaactgatttaagtttatatggcttcaatcaagccgtatcagtgaaagttggtcagcttgtttcagcagggcaggttattgctcaagtaggaaatacaggggaaatatcacgttctgcgctttattttggtattagccgtaaaggaacgccagtaaatcctgcagggtgggttcgt

SEQ ID NO: 1682 - protein, 410 aa, Haemophilus influenzae
  Name: NTH0926
MLRFGVNQKTSLLLTALLSCGLLIFSPVSQSSDLNQIQKQIKQQESKIEKQKREQAKLQANLKKHESKINSVEGELLETEISLKEIRKQIADADKQLKQLEKQEREQKARLTKQIDIIYRSGINPSLIERMFAQDPTKAERMKVYYQHLNQVRIEMINNLKATQAQIAVQKKAIFSQQKNHRNQLSTQKKQQQALQKAQQEHQSTLNELNKNLALDQDKLNALKANEQALRQEIQRAEQAAREQEKREREALAQRQKAEEKRTSKPYQPTVQERQLLNSTSGLGAAKKQYSLPVSGSILHTFGSIQAGEVRWKGMVIGASAGTPVKAIAAGRVILAGYLNGYGYMVIVKHGETDLSLYGFNQAVSVKVGQLVSAGQVIAQVGNTGEISRSALYFGISRKGTPVNPAGWVR

SEQ ID NO: 1683 - DNA, 321 bp, Haemophilus influenzae
  n 308, 309, 310, 311, 312: n is any nucleotide
  Name: NTH0927
gtgggttcgttgatgaatattctgataaaaagtgcggtaaaaaatttcattgttttttctaccgcactttatacctctttttcttttgctcaaagtaaacttgctattgtgattgatgatgtaggctatcattccaaagaagatgcagcaatttttgcgatgccacgtgaaatttccgtagcaattattcctgctgcgccctatgctcgagcacgtaatcaagaagcaaaatctcaaggtagagatattttaatccatatgccgatgcaaccagtaagtgcagtgaaaatagaagacggtgggctgcnnnnnttaattaat

SEQ ID NO: 1684 - protein, 107 aa, Haemophilus influenzae
  Xaa 103, 104: Xaa is any amino acid
  Name: NTH0927
VGSLMNILIKSAVKNFIVFSTALYTSFSFAQSKLAIVIDDVGYHSKEDAAIFAMPREISVAIIPAAPYARARNQEAKSQGRDILIHMPMQPVSAVKIEDGGLXXLIN

SEQ ID NO: 1685 - DNA, 543 bp, Haemophilus influenzae
  n 530, 531, 532, 533, 534: n is any nucleotide
  Name: NTH0928
ttgttccccccccaacccacactcccctctcccttttccgtctgtactgtccaatctttttcattctcctttcttctctcttatccttacctcccttccttccccctttctttctccttcctgtctctccctcctccccgtctcatacttctttctcttttgtttctcctttcttcacttttttccttcgttctcctatacattttactctcatgttttctttttattgcatcttctagcttatctttccctcttctctttctcttgtttttctgtaatctcttctcgcagcgccattttatctcctattactctccatttgttttgttctttcatctcatgcatcagttcttattattcttcttgctgctgcggtctaactctgttgtttccgctttctctattctcttttcttgttttctcattattctttttatttatgttgtttcttctatctacaactcatccttcgccatatttattgtttactcttttttcttttttctagatttgattattttatttagtcnnnnnttaattaat

SEQ ID NO: 1686 - protein, 181 aa, Haemophilus influenzae
  Xaa 177, 178: Xaa is any amino acid
  Name: NTH0928
LFPPQPTLPSPFSVCTVQSFSFSFLLSYPYLPSFPLSFSFLSLPPPRLILLSLLFLLSSLFSFVLLYILLSCFLFIASSSLSFPLLFLLFFCNLFSQRHFISYYSPFVLFFHLMHQFLLFFLLLRSNSVVSAFSILFSCFLIILFIYVVSSIYNSSFAIFIVYSFFFFLDLIILFSXXLIN

SEQ ID NO: 1687 - DNA, 456 bp, Haemophilus influenzae
  Name: NTH0929
ttggggggggaacaaaatgggggagagaatgaggggaataaacaaaaggcggagattcggagggtaggggatagtcgggcttatttaattgatgagaaaggaagatggcaacaaatcacccaagatcattctattctttctgaattattgactgatttccccgataaaaaagaagaagattttgccaagatttatggcggcgtttcttcttgtttagtcgccgattattccgaatttcaagataaaattttttatcaagaaattgaaattcagcaaggggaaagtttattactttgttctgacggcttgaccgacgggctttcagatgaaatgcgcgaaaaaatttggcagaaatatcccgatgataaatatcgccttacggtttgccgcaagatgattgagaagcaatcgttttcggatgatttgtcggtagtttgttgtcattctattattgag

SEQ ID NO: 1688 - protein, 152 aa, Haemophilus influenzae
  Name: NTH0929
LGGEQNGGENEGNKQKAEIRRVGDSRAYLIDEKGRWQQITQDHSILSELLTDFPDKKEEDFAKIYGGVSSCLVADYSEFQDKIFYQEIEIQQGESLLLCSDGLTDGLSDEMREKIWQKYPDDKYRLTVCRKMIEKQSFSDDLSVVCCHSIIE

SEQ ID NO: 1689 - DNA, 972 bp, Haemophilus influenzae
  Name: NTH0930
atgtttgaaaaaattgaacctactaatattcgttttattaaattaggcataaaaggatgttgggaaaaagattgtattgataaaaatagtacagcaagtacaaaaaatacgattcgtcttggctatgaatctacatcagagattcacaaagaatgtttgaataatcaatgggatagttgtattgaatattgtaaaacttattggagtgaccatacaggaactgtttcaaatcacttgagacaaattcaagatttttatcaacttggggaagatacactttggatcaccttctttggacgtaaattatattgggctttttgcagtaaagaggttgttgaggaaagcgatggttctagaacaagaaaagttattagtaacaatgggaattggtcttgcgttgatgctaacggtaaagagcttttagtcgataatcttgatggtagagtaacaaaggtccaagcctatagagggacgatttgtggtgttgagatggaggactatttaatacgtcgtataaatggtgaagttattgaggaaattacagaagcgaaagaggcgtatgaaacattaattaaatcagttgaaaaattaattaaaggtttatggtggagtgactttgaacttttaacggatcttgttttttctaaattaggatggcaacgatactctgttttaggtaaaacggagaaaggaatagatcttgatttgtattcgtcttcaacgcagaagagagtatttgtgcaaattaagtcagatacggatattaaacaattagacgaatatgtttcgaactttgaaagtgaatataaaaactatggttattcagaaatgtattacgtatatcattctggtttagaaaacatagatgaaaaacaatatcaagctaaaggaattaagcttgtaaatggccgaaaaatggcagagcttgtaattagtgctggtttagttgaatggttgattaacaaacgttct

SEQ ID NO: 1690 - protein, 324 aa, Haemophilus influenzae
  Name: NTH0930
MFEKIEPTNIRFIKLGIKGCWEKDCIDKNSTASTKNTIRLGYESTSEIHKECLNNQWDSCIEYCKTYWSDHTGTVSNHLRQIQDFYQLGEDTLWITFFGRKLYWAFCSKEVVEESDGSRTRKVISNNGNWSCVDANGKELLVDNLDGRVTKVQAYRGTICGVEMEDYLIRRINGEVIEEITEAKEAYETLIKSVEKLIKGLWWSDFELLTDLVFSKLGWQRYSVLGKTEKGIDLDLYSSSTQKRVFVQIKSDTDIKQLDEYVSNFESEYKNYGYSEMYYVYHSGLENIDEKQYQAKGIKLVNGRKMAELVISAGLVEWLINKRS

SEQ ID NO: 1691 - DNA, 165 bp, Haemophilus influenzae
  Name: NTH0931
atgtctgaatataaattaaacccaccgacagtgtcttcttatactgaaaatatgatgcttaaagttttatttgagcataaaggtttttccgaagtgtttcgggagactagctggcgaagtgatgaaattgccagtgcatttgggctgcctgaagaattgagagaa

SEQ ID NO: 1692 - protein, 55 aa, Haemophilus influenzae
  Name: NTH0931
MSEYKLNPPTVSSYTENMMLKVLFEHKGFSEVFRETSWRSDEIASAFGLPEELRE

SEQ ID NO: 1693 - DNA, 240 bp, Haemophilus influenzae
  Name: NTH0932
ttgccaaattttcatacgcctgtttccataactcaggtaaaagtgcggtggatttttggagttttttataccgctcttttaaaagccgacgagcaaccgtgcgtaaatttttatcattctctcaattcttcaggcagcccaaatgcactggcaatttcatcacttcgccagctagtctcccgaaacacttcggaaaaacctttatgctcaaataaaactttaagcatcatattttcagta

SEQ ID NO: 1694 - protein, 80 aa, Haemophilus influenzae
  Name: NTH0932
LPNFHTPVSITQVKVRWIFGVFYTALLKADEQPCVNFYHSLNSSGSPNALAISSLRQLVSRNTSEKPLCSNKTLSIIFSV

SEQ ID NO: 1695 - DNA, 204 bp, Haemophilus influenzae
  n 191, 192, 193, 194, 195: n is any nucleotide
  Name: NTH0933
ttggcaacgttggcagaatttttgcaactgaatcccgttgaacaggaacttctccgctttgccatgcatttacgtagtgaaggagctatgcgagatttgtttggctacttgccgaaatcggatttacaaagaacggctgcgatcatggcggatttacttaaacaggggtaccgagtccgaatcgtatacannnnnttaattaat

SEQ ID NO: 1696 - protein, 68 aa, Haemophilus influenzae
  Xaa 64, 65: Xaa is any amino acid
  Name: NTH0933
LATLAEFLQLNPVEQELLRFAMHLRSEGAMRDLFGYLPKSDLQRTAAIMADLLKQGYRVRIVYXXLIN

SEQ ID NO: 1697 - DNA, 726 bp, Haemophilus influenzae
  Name: NTH0934
atgcaaggtaaaattgctttagtgacaggggctagccgtggtatcggtcgtgcgattgcagaagaacttagttcaaaaggtgcatttgtaattggtaccgcaacctctgaaaagggtgcagaggcgatctcggcttatttaggggataaaggtaaaggtttagttttaaacgtaacggataaagaatctatcgaaactttacttgagcaaattaaaaatgattttggcgatattgatattctcgtgaataacgcaggtattactcgcgataatttattgatgcgtatgaaagatgaggaatggtttgatattatgcaaactaacttaacttctgtgtatcatctttctaaagccatgttacgttcaatgatgaaaaaacgttttggtcgtatcatcaatattggttcagtggttggttcaacgggtaatccaggacaaactaactattgtgcggcaaaagcgggtgtggttggtttttctaaatctttagcgaaagaagtagctgcacgtggtgttactgtaaatgtggttgcaccaggttttattgcaacagatatgacagaagtgcttacggatgaacaaaaagcggggatcttatctaatgttccagctggacgtttaggcgaagcaaaagacatagctaaagccgttgctttcttagcttctgatgatgcaggttatatcacgggtacaacgttacacgtgaatggtggcttatacttaagc

SEQ ID NO: 1698 - protein, 242 aa, Haemophilus influenzae
  Name: NTH0934
MQGKIALVTGASRGIGRAIAEELSSKGAFVIGTATSEKGAEAISAYLGDKGKGLVLNVTDKESIETLLEQIKNDFGDIDILVNNAGITRDNLLMRMKDEEWFDIMQTNLTSVYHLSKAMLRSMMKKRFGRIINIGSVVGSTGNPGQTNYCAAKAGVVGFSKSLAKEVAARGVTVNVVAPGFIATDMTEVLTDEQKAGILSNVPAGRLGEAKDIAKAVAFLASDDAGYITGTTLHVNGGLYLS

SEQ ID NO: 1699 - DNA, 144 bp, Haemophilus influenzae
  Name: NTH0935
atggcgcaagatggtgttttagcgcttgttgaagtggggccaggtaaagtattaaatggtttacccaaacgcattgtgggtgatttacaagcaatatctgtaaatgatgttgcatcattcaatgcggtagaagaatttttagcg

SEQ ID NO: 1700 - protein, 48 aa, Haemophilus influenzae
  Name: NTH0935
MAQDGVLALVEVGPGKVLNGLPKRIVGDLQAISVNDVASFNAVEEFLA

SEQ ID NO: 1701 - DNA, 666 bp, Haemophilus influenzae
  Name: NTH0936
atgaaaaaattcgcaatggtcttcccaggtcaaggctcccaaactgtcggtatgcttgctgatcttgccactgaatatccaatcgttattgaaacatttaaacaagcatctgatgcgcttggttatgatttatggtatcttgttcaacaaggtccagctgaagaacttaataaaacttggcaaactcagcccgcacttttagctgcttcagtcgctatttatcgcgtatggcaagaaaaatttcctcaattaaaaccagaagtgatggcaggccatagcttgggtgagtattctgccttggtttgtgctggggtgttggatttccaagatgcgattaaattagtggaattgcgcggaaaattaatgcaacaagctgtgcctgaaggcactggcgcaatgtatgcaatcattggtttagataatgaagcaattattaatgcttgcaaacaagcagaggaaggcgaagtcgtatctgcggtgaactttaactcaccgggtcaagtagttattgcgggtgcgaaagctgcagttgagcgtgcggctgcattatgtaaagaagcaggggcgaaacgtgcattgccgttagctgtgagcgtaccttctcactgtgcattaatgaaacctgcagccgagcaattagcggtaacacttgagaatattcaaata

SEQ ID NO: 1702 - protein, 222 aa, Haemophilus influenzae
  Name: NTH0936
MKKFAMVFPGQGSQTVGMLADLATEYPIVIETFKQASDALGYDLWYLVQQGPAEELNKTWQTQPALLAASVAIYRVWQEKFPQLKPEVMAGHSLGEYSALVCAGVLDFQDAIKLVELRGKLMQQAVPEGTGAMYAIIGLDNEAIINACKQAEEGEVVSAVNFNSPGQVVIAGAKAAVERAAALCKEAGAKRALPLAVSVPSHCALMKPAAEQLAVTLENIQI

SEQ ID NO: 1703 - DNA, 126 bp, Haemophilus influenzae
  Name: NTH0937
ttgcgtctgtttgagcgtagcgagttcagcaaattgccgttaagaaaattgaaacaaagcaaagaacagcgatttaactggggcgtgttttctttgcctactttcttttacacgagtaaaagaaag

SEQ ID NO: 1704 - protein, 42 aa, Haemophilus influenzae
  Name: NTH0937
LRLFERSEFSKLPLRKLKQSKEQRFNWGVFSLPTFFYTSKRK

SEQ ID NO: 1705 - DNA, 135 bp, Haemophilus influenzae
  Name: NTH0938
ttgaccgcactttttgtgttaaatgtcaggggttcgcctgacggcgacctactttcttttactcgtgtaaaagaaagtaggcaaagaaaacacgccccagttaaatcgctgttctttgctttgtttcaattttct

SEQ ID NO: 1706 - protein, 45 aa, Haemophilus influenzae
  Name: NTH0938
LTALFVLNVRGSPDGDLLSFTRVKESRQRKHAPVKSLFFALFQFS

SEQ ID NO: 1707 - DNA, 333 bp, Haemophilus influenzae
  Name: NTH0939
atgcaaggtaacgaaacgttcaaattggcagttcgtgaactttcaaatgtggtggaagaaacacttttagcaaataatttagataaaaaagatttagactggcttgtgccacaccaagcaaatttacgtattattacagcaacagctaaaaaattagaaatggatatgtcgcaagtggtggtaacgttagataaatacgctaacaacagtgcagcaactgttcctgtcgctttagatgaggctattcgagatggtcgtattcaacgtgggcagttactattattagaagcctttggcggtggttggacttggggttcagcgttagtgagattt

SEQ ID NO: 1708 - protein, 111 aa, Haemophilus influenzae
  Name: NTH0939
MQGNETFKLAVRELSNVVEETLLANNLDKKDLDWLVPHQANLRIITATAKKLEMDMSQVVVTLDKYANNSAATVPVALDEAIRDGRIQRGQLLLLEAFGGGWTWGSALVRF

SEQ ID NO: 1709 - DNA, 675 bp, Haemophilus influenzae
  Name: NTH0940
gtggttgatcaagggatttcttatcttaatttgatgcttgaatataaagctgattttattgtggaatataatgaaaagcaaaaagccccacttaaaagaaatgatgtggattggtcacaatctaaggtgatttttgtttcacctacttttaatgatttccaaattcaagccacaaattttaaagatttacctattgaattatgggaagttaatcgctttgataatgatattattacgctcaatattattaataaatcaaaatcagcaccgaatattaaagctgtttctattgaaaaaaatgaagaattttctacattaaaagaaataaaagtttatcaagaatctgatcacttaagtgataaatcagattttattcaagaactatacgaagattttaaacaaggcattttaaatttagatcctaatatcgaaattaatactagaaaactttacattgcattcaaaaaagatcgaaatattgcagatattcgtatccaacaaaagaatttaaaaatttggattaatcttccttatggagagttagacgatcctaaaaatttagcaaaaaatgtatctaatactggtcactgggggaatggagattatgaaatcaccattgaaagcacccaatatcttgaatacattatgagtttaattaaacaagctattaaggat

SEQ ID NO: 1710 - protein, 225 aa, Haemophilus influenzae
  Name: NTH0940
VVDQGISYLNLMLEYKADFIVEYNEKQKAPLKRNDVDWSQSKVIFVSPTFNDFQIQATNFKDLPIELWEVNRFDNDIITLNIINKSKSAPNIKAVSIEKNEEFSTLKEIKVYQESDHLSDKSDFIQELYEDFKQGILNLDPNIEINTRKLYIAFKKDRNIADIRIQQKNLKIWINLPYGELDDPKNLAKNVSNTGHWGNGDYEITIESTQYLEYIMSLIKQAIKD

SEQ ID NO: 1711 - DNA, 1029 bp, Haemophilus influenzae
  Name: NTH0941
atgcacaatcttatttttgccattctttgcagcgtagcagtttcagttttactgaaaattgcccgtaaaaaaaatatcattattgaacaagctatcgcattcaactacattacagccatcactttcagttatttcttacttaaacctgattttaaaggcttagagtttactgattacattgcacaaagcgaaaattcacccatttttttagcactaggtttattgctacctagcgtatttattattatgtcaaaagcagtggagtttgctggaattgtacgttcagatgcagcgcaacgtctttcgttatttcttcccattttagcagcgtttttaatttttcatgaaacactaagccaatctaaaatcattggcgttgtattagcctttattggtttattttgtttattaactaagccaactcaagggcaaagtgcggtcaattttaaaggtgttttaggattaatcggcgtctggtttggttacggcatcattgatattttattcaaacaagtagcgaaaagcggtggtgcatttcctgcaacattgtttatttctttctcgcttgcagcttgcgttatgtttatctatttattcttaaaacgtgcgcaatggacatcatcaagtgtaattggcggcatcgttttaggtgtattgaatttctttaatattttattctatataaaagcacatcaaagttttgctggaaatccgacgcttgttttcgcgggaatgaatatcggggtaatttgcctaggtacgataactggcgcattagtttttaaagaaaaaatcagtaagctaaattggctaggtattatttttagtttatcggctattttctgcctatattatttagacaaactcatcccgtacaagagagtagtcatggcaaaagacttcagcttttttatttacgattatgcacagtttttcgttaatcccgccatacatcgccctctccaatttgttgtcgttctcacgcacgctcactcaccacttccgtccacccccttacttccctttttc

SEQ ID NO: 1712 - protein, 343 aa, Haemophilus influenzae
  Name: NTH0941
MHNLIFAILCSVAVSVLLKIARKKNIIIEQAIAFNYITAITFSYFLLKPDFKGLEFTDYIAQSENSPIFLALGLLLPSVFIIMSKAVEFAGIVRSDAAQRLSLFLPILAAFLIFHETLSQSKIIGVVLAFIGLFCLLTKPTQGQSAVNFKGVLGLIGVWFGYGIIDILFKQVAKSGGAFPATLFISFSLAACVMFIYLFLKRAQWTSSSVIGGIVLGVLNFFNILFYIKAHQSFAGNPTLVFAGMNIGVICLGTITGALVFKEKISKLNWLGIIFSLSAIFCLYYLDKLIPYKRVVMAKDFSFFIYDYAQFFVNPAIHRPLQFVVVLTHAHSPLPSTPLLPFF

SEQ ID NO: 1713 - DNA, 93 bp, Haemophilus influenzae
  Name: NTH0942
gtgaaaagtgatgagatagggggaaaaatagggaaaggagggatgaaaagtaaagaggggatgagagaatgggagagagaggggggggaatat

SEQ ID NO: 1714 - protein, 31 aa, Haemophilus influenzae
  Name: NTH0942
VKSDEIGGKIGKGGMKSKEGMREWEREGGEY

SEQ ID NO: 1715 - DNA, 375 bp, Haemophilus influenzae
  Name: NTH0945
atgatcgaacttagtcacgaagaagaattgcgttataaccgtcaaattattcttaaaagcgtagattttgacgggcaagaaaaacttaaagcaagcaaaatgctgatcgttgggcttggtggcttaggatgtgcagccagccaatatctcgcagcggcaggcgttggaaatttaacactgttggatttcgatacagtttcgctttcgaatcttcaacgacaagtcctacactgcgatacgcgcttgaatatgccaaaggtggaatccgctaaaattgcactggaacaaatcaatccacatataaacatagagacgattaatgcgaagttggacgaagaaaaactggctgaaatcattccgcactttgatattgtt

SEQ ID NO: 1716 - protein, 125 aa, Haemophilus influenzae
  Name: NTH0945
MIELSHEEELRYNRQIILKSVDFDGQEKLKASKMLIVGLGGLGCAASQYLAAAGVGNLTLLDFDTVSLSNLQRQVLHCDTRLNMPKVESAKIALEQINPHINIETINAKLDEEKLAEIIPHFDIV

SEQ ID NO: 1717 - DNA, 1212 bp, Haemophilus influenzae
  Name: NTH0946
atgcttacattggatcaagctcgctcgaaaatgcttgaacagcttcccttcccgactcaaactgaatacctaaatttacaagaagccgccaatcgaatttgtgcagaagatattatttcgcctatcaatgttccctctttcgataactcagcaatggatggttatgctgtacgtttatcggatttacaacaatctttaaccctttcagtggcagggaaatcttttgcaggtaatccattcaaagaggaatggccatcaaaaagtgcggtcagaattatgactggcgcgatgattcctgaaggcacagatgcagtgataatgcaagagcaagtaacactcaatgaagacggcaccatcacttttagtgaattacctaaaccaaatcaaaacatccgtcgtattggtgaagatgtaaaaaaaggggatgttgtattagaacaaggcgcaccgctcaccccagtttccttgccattattagcctctctaggcattgcagaagtaaaatgctatcgtcaattaaaagtcggtgtactctcaactggcgatgaacttgtggaagtcggcaagccattacaaagcggacaaatatatgacactaaccgtttcaccgtaaaattactgctagaaaaactaaactgtgaagtcattgatttaggactattacctgataacgaagctgaatttgaaaaagcatttattgccgcacaaagccaagccgatttagtgattaccagtggcggtgtttccgttggtgaagcggatttcactaaagcagtattggaaaaagtaggcaaagtaaatttctggaaaattgcaatcaaacccggcaaaccattcgcttttggtaaattagaaaatgcttggttctgtggtttacccggcaatcctgtttccgcattagtaacattctatcaacttgtacagccattaatcgctaaactgcaaggacaaaaacaatggaaaaatccaccgcacttttcagccattgctacaatgaatttgaaaaaagcagtgggacgtttagacttccaacggggtttttattacatcaatgaacaaggtcaaattgaagtgcaatcagtaggtttccaaggttctcatctctttagtgcttttgtaaaaagcaattgttttatcgtgttagaacaagaacgtggcaatgtctctgcgggcgaaacagtgacaattgagcctttcaatcatttattagga

SEQ ID NO: 1718 - protein, 404 aa, Haemophilus influenzae
  Name: NTH0946
MLTLDQARSKMLEQLPFPTQTEYLNLQEAANRICAEDIISPINVPSFDNSAMDGYAVRLSDLQQSLTLSVAGKSFAGNPFKEEWPSKSAVRIMTGAMIPEGTDAVIMQEQVTLNEDGTITFSELPKPNQNIRRIGEDVKKGDVVLEQGAPLTPVSLPLLASLGIAEVKCYRQLKVGVLSTGDELVEVGKPLQSGQIYDTNRFTVKLLLEKLNCEVIDLGLLPDNEAEFEKAFIAAQSQADLVITSGGVSVGEADFTKAVLEKVGKVNFWKIAIKPGKPFAFGKLENAWFCGLPGNPVSALVTFYQLVQPLIAKLQGQKQWKNPPHFSAIATMNLKKAVGRLDFQRGFYYINEQGQIEVQSVGFQGSHLFSAFVKSNCFIVLEQERGNVSAGETVTIEPFNHLLG

SEQ ID NO: 1719 - DNA, 165 bp, Haemophilus influenzae
  Name: NTH0947
atgagcaaaatttcactggatgcactgaatgtaacaaatgccttgattgaaaaaggttttgatacacctatgattgatccaacacaggctatagatgaatctttagatatctttgcgaactccatgtctgaagcattgatgctgatgggcttaaacttgtcaata

SEQ ID NO: 1720 - protein, 55 aa, Haemophilus influenzae
  Name: NTH0947
MSKISLDALNVTNALIEKGFDTPMIDPTQAIDESLDIFANSMSEALMLMGLNLSI

SEQ ID NO: 1721 - DNA, 96 bp, Haemophilus influenzae
  n 83, 84, 85, 86, 87: n is any nucleotide
  Name: NTH0948
atgacgcactatattttattgattatcggcaccgcattaattaacaattttgtattggtaaaattcttaggactttgcccttnnnnnttaattaat

SEQ ID NO: 1722 - protein, 32 aa, Haemophilus influenzae
  Xaa 28, 29: Xaa is any amino acid
  Name: NTH0948
MTHYILLIIGTALINNFVLVKFLGLCPXXLIN

SEQ ID NO: 1723 - DNA, 126 bp, Haemophilus influenzae
  Name: NTH0949
atgattagctgcgttttttatttcaataacaaaatcgcaacttaccatttccccttagcaaaattttctattgttcttgcttccataaatagggataataacgcccctattcaaaaggcaaaaaaa

SEQ ID NO: 1724 - protein, 42 aa, Haemophilus influenzae
  Name: NTH0949
MISCVFYFNNKIATYHFPLAKFSIVLASINRDNNAPIQKAKK

SEQ ID NO: 1725 - DNA, 1059 bp, Haemophilus influenzae
  Name: NTH0950
atgttgaacgatattttaacaggctatggaatttttattctggaaattttaacaattttattactcattcttgctattgttggtttgattatttcttatcgccaacataacaagtctaaagtgggagaattagaaattaaagatttatcagaagaatttaatgaacaagttcgtttattacgtgattttaatctttctgaagaagaacaaaaacaacgcactaaagctgaaaaaaaagcagaaaaacaaaatgctaaaaaacgcaaagaaaaattgaaaaaaggcgatactttagaagatgaaaagaaagcttgcgtatatgtattagatttttgcggcgatatttcagcctcagaaacaaccgcacttcgtgaagaaatttcagcaattttaaatgtagcaaaaccagaagacgaagtattactacgtttagaaagcccaggcggtattgtgcataattatggatttgcagcctctcaattgtctcgcttaaaacaaaaaggcataaaattaactgttgccgtcgataaagtggctgcaagtggcggttatatgatggcttgcgttgccgataaaattgtatccgcaccttttgctgttattggttctattggcgttgtcgctcaaattccaaatgttcatcgactattgaaaaaacacgatgtcgatgtagatgtaatgactgcgggcgaatttaaacgtacagtgaccgtattgggtgagaacactgaaaaaggcaaacaaaaatttcaacaagaattggaagaaacacataaattattcaaacaatttgtctcacaaaatcgcccttgcctagatattgataaaatcgcaacaggcgaacattggtttggacaacaagccattgcattacaacttgtagatgaaatctcaacgagtgatgatttaattttggaaaaaatgaaagaaaaacaggtacttaatgttaaataccgtttaaaaaaatccctaataaaaaaattcggacgacaagctgaagaaagtgcaattaatatcattcatcgttatagtacaaaacagtctagagactttatgtac

SEQ ID NO: 1726 - protein, 353 aa, Haemophilus influenzae
  Name: NTH0950
MLNDILTGYGIFILEILTILLLILAIVGLIISYRQHNKSKVGELEIKDLSEEFNEQVRLLRDFNLSEEEQKQRTKAEKKAEKQNAKKRKEKLKKGDTLEDEKKACVYVLDFCGDISASETTALREEISAILNVAKPEDEVLLRLESPGGIVHNYGFAASQLSRLKQKGIKLTVAVDKVAASGGYMMACVADKIVSAPFAVIGSIGVVAQIPNVHRLLKKHDVDVDVMTAGEFKRTVTVLGENTEKGKQKFQQELEETHKLFKQFVSQNRPCLDIDKIATGEHWFGQQAIALQLVDEISTSDDLILEKMKEKQVLNVKYRLKKSLIKKFGRQAEESAINIIHRYSTKQSRDFMY

SEQ ID NO: 1727 - DNA, 636 bp, Haemophilus influenzae
  Name: NTH0951
ttgccacattatgcacaagtacggcaacctttgctggaatgggtttccacttcatctaaccttgagtttttagcgattgatggtcaaaaagcctctaaatctctcggaaaagctaagccatttactgtagatgatacccaaagccatcaggttggtgtgcgtttaaatgaaattgttggttcaggatcgaatcaatctctttttgaatctaatcctgtgattgtgacattcaaaggtaatgctgaagatttagttatttccgccccagctattcgtaatcttgatagtggcgataaattcaatcaaatgccaaatattactgtgaaaacaaaatcaggtaatgctatttcagcgaaagtggatgtgttaaaacaagaaggtttattcccaagtggtaatgtgctaaatgatcttgctgaatataatgcgtctggtgcagcggcatcagtttctaaatttactgcaacaacttctgctaattcaatggttgctgtgccagcaggtaatgcaaaagcgaataaaggcaaagtggttgttcagggcgaaaacgttgcagagcaacaacttcaatattggttccaacaagcggataaagaaactcaaacacgttttttaaactgggcaaaatcccataaa

SEQ ID NO: 1728 - protein, 212 aa, Haemophilus influenzae
  Name: NTH0951
LPHYAQVRQPLLEWVSTSSNLEFLAIDGQKASKSLGKAKPFTVDDTQSHQVGVRLNEIVGSGSNQSLFESNPVIVTFKGNAEDLVISAPAIRNLDSGDKFNQMPNITVKTKSGNAISAKVDVLKQEGLFPSGNVLNDLAEYNASGAAASVSKFTATTSANSMVAVPAGNAKANKGKVVVQGENVAEQQLQYWFQQADKETQTRFLNWAKSHK

SEQ ID NO: 1729 - DNA, 318 bp, Haemophilus influenzae
  Name: NTH0952
atgaatattcggttaaatgctaaagtaatttctacaattcctgtttttattgccgtaaatattgcggcagtgggaatatggttttttgatatttcttcgcaatcaatgcctttgattctagggattattgcaggtggtttggtggatttggataaccgtttaactggacgattgaaaaacgtattttttacccttattgccttttctatttcttcctttattgtgcagttacatattggcaagcctatccaatatattgtgttaatgacggtgctgacatttattttcactaatgattggtgccgtggggcagcgtta

SEQ ID NO: 1730 - protein, 106 aa, Haemophilus influenzae
  Name: NTH0952
MNIRLNAKVISTIPVFIAVNIAAVGIWFFDISSQSMPLILGIIAGGLVDLDNRLTGRLKNVFFTLIAFSISSFIVQLHIGKPIQYIVLMTVLTFIFTNDWCRGAAL

SEQ ID NO: 1731 - DNA, 381 bp, Haemophilus influenzae
  Name: NTH0953
gtgaaaataaatgtcagcaccgtcattaacacaatatattggataggcttgccaatatgtaactgcacaataaaggaagaaatagaaaaggcaataagggtaaaaaatacgtttttcaatcgtccagttaaacggttatccaaatccaccaaaccacctgcaataatccctagaatcaaaggcattgattgcgaagaaatatcaaaaaaccatattcccactgccgcaatatttacggcaataaaaacaggaattgtagaaattactttagcatttaaccgaatattcatttcaaatccttatcaaaatagaaaagtgagcaacaaggctcactttttattgtataaagtgcggtcattatttatgggattttgcccagtt

SEQ ID NO: 1732 - protein, 127 aa, Haemophilus influenzae
  Name: NTH0953
VKINVSTVINTIYWIGLPICNCTIKEEIEKAIRVKNTFFNRPVKRLSKSTKPPAIIPRIKGIDCEEISKNHIPTAAIFTAIKTGIVEITLAFNRIFISNPYQNRKVSNKAHFLLYKVRSLFMGFCPV

SEQ ID NO: 1733 - DNA, 822 bp, Haemophilus influenzae
  Name: NTH0954
atgtactggttcagaaatgcaattatttaccaattaacaaaacaaatagactttgagaatatcgaaaaacaactcaaagaatgtgaatttactccgtgtggttcagcagatgttagccatttcggttggtctgctccgctcgtcaccagcgaaaatttagcacatcaagcgaacggaaaaatcttacttgtagctaaacgagaagagaagattttgcctgtggaagttgtgaatcgtgaactcaataaacgaatcactgcacttgaagaaaaagaacagcgaaaattaaagaaagtagaacgatcatctttaaaagatgacgtgatagctactctacttccgcaagcattttctcgcatcaaaacgaccgcactttacatcgacacgttgaaacaacttatctttgttgatgcagcatcaagtaaaacagctgaggatgcactcgcacttttgcgcaaatcgctaggtagtttgctagtagtaccgttggcgtttaactgtgcgccgtgtgaagtaatgacaagatgggttacagatactgcacctgattggctaatcttgcgtaaggaagtggaaatccgcgaaaaagaagatcttggcgttattcactgcaagcaaaaagatgttgaagacgaggaaattattgagcttgttcaaaatggcttgatctctaaactcgcgcttgagtgggaaaacaaccttaaattcgtattaatcgaagatggcacgctgaaacgcctgaaatttgacgacaatatcaccgagcagaacgatgatattgtaaaagaagatgtaactgctcgttttgaaggaaactttgcc

SEQ ID NO: 1734 - protein, 274 aa, Haemophilus influenzae
  Name: NTH0954
MYWFRNAIIYQLTKQIDFENIEKQLKECEFTPCGSADVSHFGWSAPLVTSENLAHQANGKILLVAKREEKILPVEVVNRELNKRITALEEKEQRKLKKVERSSLKDDVIATLLPQAFSRIKTTALYIDTLKQLIFVDAASSKTAEDALALLRKSLGSLLVVPLAFNCAPCEVMTRWVTDTAPDWLILRKEVEIREKEDLGVIHCKQKDVEDEEIIELVQNGLISKLALEWENNLKFVLIEDGTLKRLKFDDNITEQNDDIVKEDVTARFEGNFA

SEQ ID NO: 1735 - DNA, 879 bp, Haemophilus influenzae
  n 874, 875, 876, 877, 878: n is any nucleotide
  Name: NTH0955
atgattgcgatatacacaaacaatagcaccattaatactcgccttagctttagattgccaaccaagcgcaacagctatagattgcttgccagatatttccgctaccgactgatcgcctgtattagtcgctaccgaccgatagcctgtattagtcgctgccgaccgatcgcctgtattagtcgctaccgaccgatagcctgtattagtcgctgccgaccgatagcctgtattagtcgctgccgaccgatcgcctgtattagtcgctaccgaccgatagcctgtattagtcgctgccgactgatcgcctgtattagtcgctgccgactgatcgcctgtattggttgctgccgaccaattgcctgtattggttgctgccgactgatcgcctgtattagtcgctaccgaccgatagcctgtattagtcgctgccgactgatcgcctgtattagtcgctgccgactgaccgcctgtattagtcgctgccgactgatcgcctgtattagtcgctaccgaccgatagcctgtattagtcgctgccgactgatcgcctgtattagtcgctaccgaccgatagcctgtattagtcgctgccgactgatcgcctgtattagtcgctgccgactgaccgcctgtattagtcgctgccgactgatcgcctgtattagtcgctaccgaccgatagcctgtattagtcgctaccgaccgatagcctgtattagtcgctgccgactgatcgcctgtattagtcgctgccgactgatcgcctgtattggttgctgccgaccaattgcctgtattggttgctgccgactgatcgcctgtattggttgctgccgaccaatcgcctgggtaccgagtccgaatcgtataccannnnnt

SEQ ID NO: 1736 - protein, 293 aa, Haemophilus influenzae
  Xaa 292, 293: Xaa is any amino acid
  Name: NTH0955
MIAIYTNNSTINTRLSFRLPTKRNSYRLLARYFRYRLIACISRYRPIACISRCRPIACISRYRPIACISRCRPIACISRCRPIACISRYRPIACISRCRLIACISRCRLIACIGCCRPIACIGCCRLIACISRYRPIACISRCRLIACISRCRLTACISRCRLIACISRYRPIACISRCRLIACISRYRPIACISRCRLIACISRCRLTACISRCRLIACISRYRPIACISRYRPIACISRCRLIACISRCRLIACIGCCRPIACIGCCRLIACIGCCRPIAWVPSPNRIPXX

SEQ ID NO: 1737 - DNA, 1062 bp, Haemophilus influenzae
  Name: NTH0956
atgagccatattatgtttggcggatttacccatgaccctgcggtggaattagctcaattattggtacaaattttgcccaatggattagataagatcttttttgctgatagtggttctgttgcagtggaagtagcgatgaaaatggctattcaatatcagcacgctaaaggagaagtacaacgacaaaaatttgccactattcgttcaggttatcacggcgatacgtggaatgcgatgtcagtgtgcgatccaaccacagggatgcatcatttatttcatcatagcctgcctgtacaatattttcttcctcaacccaacattccatttaatgaatcttggaatgattgtgtcattgaacctttagctgatttacttaagaaaaaaggtagcgaaatcgccgcactgattttagaacctgttgtgcaaggtgcgggtggtatgtatttttattcgccaacttatttagtgaaagcgcaagcgctttgtaaacaatatggtgtattgctgatctttgatgaaatcgccacgggatttggtcgaacagggaaattatttgcagctgaacacgcaggcatttcgccagatattatgtgtatcggtaaagcattaacgggtggttatttaactttatcggcaagtattacgaccactgaaattgcgcaaattatttgtagcggtgaggctaaatgctttatgcacgggcccacttttatggcaaacccgttggcttgtgcaattgcagcggaatctatccgtttattgttggaaagtccttggcagcaaaatattcagcgaattgagcattccttaaaacaacagctttcgcctttagctgaaaaagattacgtcaaagaagttcgtgcattaggggcgattggggtggttgaaatgaaaagtgcggtaaatatgaaaactttagttccacgttttgtggaacaaggtgtttggattcgacctttcggaaaattggtttatgttatgccaccatttgtgattaaagatgatgaacttcagaaattaacggaaggcatgattttggctttaattcaggaatatgaacat

SEQ ID NO: 1738 - protein, 354 aa, Haemophilus influenzae
  Name: NTH0956
MSHIMFGGFTHDPAVELAQLLVQILPNGLDKIFFADSGSVAVEVAMKMAIQYQHAKGEVQRQKFATIRSGYHGDTWNAMSVCDPTTGMHHLFHHSLPVQYFLPQPNIPFNESWNDCVIEPLADLLKKKGSEIAALILEPVVQGAGGMYFYSPTYLVKAQALCKQYGVLLIFDEIATGFGRTGKLFAAEHAGISPDIMCIGKALTGGYLTLSASITTTEIAQIICSGEAKCFMHGPTFMANPLACAIAAESIRLLLESPWQQNIQRIEHSLKQQLSPLAEKDYVKEVRALGAIGVVEMKSAVNMKTLVPRFVEQGVWIRPFGKLVYVMPPFVIKDDELQKLTEGMILALIQEYEH

SEQ ID NO: 1739 - DNA, 1137 bp, Haemophilus influenzae
  Name: NTH0958
atggatgctttcaaacagcaactggaacagcttagcgcacaaaatcaatatcgttcaattccagatttagttcatcaaggacgatatattatgcgagaaaatcgcaaaatgctgaatatgtcatctaatgattatttaggtttggcatcaaatgaaaacttgcgccagtcttttttacagcaatacggcggtaatttcccctcttttaccagttcttcatcgcgtttattaacgggcaactttcctatttataccgatttggaagagcttgtcgcacaacgtttccaacgggaaagtgcgttattatttaacagcggctatcacgccaatatcggcattttgcctgctttgacgacgaaaagtttgattttggcagataaattagtgcatgccagcatgattgatggcattcgtttaagccaatgtgagttctttcgttatcgtcataatgattatgaacatttgaaaaatctgcttgaaaaaaacgtcggaaaatttgaccgcacttttatcgttaccgaatctgttttcagtatggacggcgacgtggcggatttgaaacagcttgttcaattaaaaaaacaatttcccaatacttatctttatgtggatgaagcccatgcaataggcgtttacggtaaaaacggattaggtattgccgaacgagctaatgtgatagctgatatagatttgttggttggcacttttggcaaggccttagcttcaatgggggcttatgtcgtctgtgatcaaatattaaaagaatgtttgattaatcaaatgcgcccattgattttttcaaccgcattgccgccgtttaatgtggcttggacttattttatttttgaacgattgccgcaattctcaaaagaaagaagccatcttgagcggttaagtgcatttttacgccaagaagtggaacacagaacgcaaataatgccaagccaaacttgcatcgttccctatattttaggcgaaaacgaagcaacccttgctaaggcgaaagatctgcaagagcaaggttattattgtttgccaatcagaccgccgacagtaccaaaaggtacatccagaatacgattgtctttgacggcagatatgacaatggatgaagtgaaacagtttgtggcatgctta

SEQ ID NO: 1740 - protein, 379 aa, Haemophilus influenzae
  Name: NTH0958
MDAFKQQLEQLSAQNQYRSIPDLVHQGRYIMRENRKMLNMSSNDYLGLASNENLRQSFLQQYGGNFPSFTSSSSRLLTGNFPIYTDLEELVAQRFQRESALLFNSGYHANIGILPALTTKSLILADKLVHASMIDGIRLSQCEFFRYRHNDYEHLKNLLEKNVGKFDRTFIVTESVFSMDGDVADLKQLVQLKKQFPNTYLYVDEAHAIGVYGKNGLGIAERANVIADIDLLVGTFGKALASMGAYVVCDQILKECLINQMRPLIFSTALPPFNVAWTYFIFERLPQFSKERSHLERLSAFLRQEVEHRTQIMPSQTCIVPYILGENEATLAKAKDLQEQGYYCLPIRPPTVPKGTSRIRLSLTADMTMDEVKQFVACL

SEQ ID NO: 1741 - DNA, 501 bp, Haemophilus influenzae
  n 492, 493, 494, 495, 496: n is any nucleotide
  Name: NTH0959
gtgaaaacgaaattttatgatcatcaaggtgagcatttaatagtttattttgctggctgggggacacctcttgatgctgtagttcatttgattttgccaacagatcatgatttattaatttgctatgattatcaagatttaaatttggattttgatttttccgcctatcggcacatccgtttggtggcgtggtctatgggcgtttgggcggcagagcgagtattacaaggaatcaccttacaatcagcaacagcagtgaatggaacaggtttaccttgtgatgatagcttcggtattccctatgctatttttaaaggtacgttagataatctcacagaaaatactcgttcaaagtttgaacgtagaatttgtggtgacaaagttcttttgaacgttatcaacaattttctgcacgaccatttaacaaaattcatcaagaactcaccgcacttttgcgatgatgggtaccgagtccgatattcgtataccagnnnnnttaat

SEQ ID NO: 1742 - protein, 167 aa, Haemophilus influenzae
  Xaa 164, 165, 166: Xaa is any amino acid
  Name: NTH0959
VKTKFYDHQGEHLIVYFAGWGTPLDAVVHLILPTDHDLLICYDYQDLNLDFDFSAYRHIRLVAWSMGVWAAERVLQGITLQSATAVNGTGLPCDDSFGIPYAIFKGTLDNLTENTRSKFERRICGDKVLLNVINNFLHDHLTKFIKNSPHFCDDGYRVRYSYTXXXN

SEQ ID NO: 1743 - DNA, 240 bp, Haemophilus influenzae
  Name: NTH0960
gtgaaactttcttataaagaacaacgagaactagaacaacttccacaactattggaagagttggaaactaaaatcaccgtacttcaagctgaaatagccgatccagcatttttccaacaagctcacgatattaccgacgctaaattaaaagcattggcagatactgaagccgaattagaaacagcatttttacgctgggaagaattagaagaaaagaaaaatttggctgacggtaaagct

SEQ ID NO: 1744 - protein, 80 aa, Haemophilus influenzae
  Name: NTH0960
VKLSYKEQRELEQLPQLLEELETKITVLQAEIADPAFFQQAHDITDAKLKALADTEAELETAFLRWEELEEKKNLADGKA

SEQ ID NO: 1745 - DNA, 252 bp, Haemophilus influenzae
  Name: NTH0961
gtggaagttgttctagttctcgttgttctttataagaaagtttcacggatttcggctttagaagtgcggtcatttttcaccgcactttcttcttttagtggttcagatttcttcgccttagcctgttcttccaccgctttgcttgcccaaaaattggcttgttgctgtttcgcatcaaagaatcctcccacatacttattcaaagccccttcacctttgaataataacatttggcgcaggattatcgataaa

SEQ ID NO: 1746 - protein, 84 aa, Haemophilus influenzae
  Name: NTH0961
VEVVLVLVVLYKKVSRISALEVRSFFTALSSFSGSDFFALACSSTALLAQKLACCCFASKNPPTYLFKAPSPLNNNIWRRIIDK

SEQ ID NO: 1747 - DNA, 198 bp, Haemophilus influenzae
  Name: NTH0962
atgttattattcaaaggtgaaggggctttgaataagtatgtgggaggattctttgatgcgaaacagcaacaagccaatttttgggcaagcaaagcggtggaagaacaggctaaggcgaagaaatctgaaccactaaaagaagaaagtgcggtgaaaaatgaccgcacttctaaagccgaaatccgtgaaactttctta

SEQ ID NO: 1748 - protein, 66 aa, Haemophilus influenzae
  Name: NTH0962
MLLFKGEGALNKYVGGFFDAKQQQANFWASKAVEEQAKAKKSEPLKEESAVKNDRTSKAEIRETFL

SEQ ID NO: 1749 - DNA, 951 bp, Haemophilus influenzae
  Name: NTH0963
ttgtttttagctaccacgccattaattgcggaagataatctaagtgcgggttcttttacggtagttttttcatctatgttggcaatgatgcgcccattaaaatccttaacgaatgtaaactctcaattccaacgtggaatggcagcatgtcaaacgctatttgccattttagatttagaaccagaaaaagataacggcacttataaagcagaacctgcgaaaggtgcgttagaatttaaaaatgtgagttttgcatatcagggaaaagaggaacttgcattaaataatatttcttttagcgtgcctgcaggaaaaaccgttgctttagtgggacgttctggatcgggcaaatcaaccattgctaatttagtgacacgtttttacgatattgagcaaggcgagattttactggatggcgtaaatatccaagattatcgtttatctaatttgcgtgagaactgtgctgtggtttctcaacaagttcatttatttaacgataccattgcgaataatattgcttatgccgcgcaggataagtattctcgcgaagaaattattgctgcagcaaaagcggcttatgctttagagtttatcgaaaaattaccgcaaggttttgatacggtaattggcgaaaatggtgcgagcctatctggtgggcaacgccagcgtttagcgattgctcgcgctttattgcgtaattcgccagtattaattttagatgaagctacatctgcactagatacggaatcagaacgcgccattcaatctgcattagatgaattgaagaaagatcgtactgttatcgtaatcgcccatcgtttatcaaccattgaaaatgcggatgaaattcttgtgattgatcacggagaaattcgtgagcgaggcaaccataaagcattgcttgaacaaaatggtgcttataaacagctatacagtatgcagtttagtggc

SEQ ID NO: 1750 - protein, 317 aa, Haemophilus influenzae
  Name: NTH0963
LFLATTPLIAEDNLSAGSFTVVFSSMLAMMRPLKSLTNVNSQFQRGMAACQTLFAILDLEPEKDNGTYKAEPAKGALEFKNVSFAYQGKEELALNNISFSVPAGKTVALVGRSGSGKSTIANLVTRFYDIEQGEILLDGVNIQDYRLSNLRENCAVVSQQVHLFNDTIANNIAYAAQDKYSREEIIAAAKAAYALEFIEKLPQGFDTVIGENGASLSGGQRQRLAIARALLRNSPVLILDEATSALDTESERAIQSALDELKKDRTVIVIAHRLSTIENADEILVIDHGEIRERGNHKALLEQNGAYKQLYSMQFSG

SEQ ID NO: 1751 - DNA, 132 bp, Haemophilus influenzae
  Name: NTH0964
ttgaaaacgcgagttgaaaaactcgcgttattttatccgcacttattagaaaggattttctatgcccttctggtattccaattccaaacttatttggctcttatcgcctttttctttattgttttggttgat

SEQ ID NO: 1752 - protein, 44 aa, Haemophilus influenzae
  Name: NTH0964
LKTRVEKLALFYPHLLERIFYALLVFQFQTYLALIAFFFIVLVD

SEQ ID NO: 1753 - DNA, 939 bp, Haemophilus influenzae
  Name: NTH0965
ttgttttggttgattagccaactgcgtcacgccttattttgtttggggataaaatcttcttatcgcgcaccaaaaccagtgataattgtgggaaatttgtctgttggtggaaatggcaaaacgcccgtggtggtgtggcttgtggaagaattaaaaaaacgaggtttgcgcgtaggtgtgatttctcgtggttacggcagtaaatctaaaacttatccgttattcgtcactgaaaatacgcgtccgattgaaggtggcgatgagccagtattgatcgctaaacgcaccaatgcgccagtcgtgatttccccgaatcgccagcaagcgattgaattactcttaagccaagcagagtgcgatattattgtttctgacgatggtttacagcattataaattacagcgtgatttggaaattgtcgtaatggacgctgagcgcgcattgggaaatggttttgtattgcctgcaggcccattgcgtgaattaccaagtcgattaaaatccgtagattttgtgatcactaatggtggaaaaaatcagtattcagatgcagttatgtatcttgtaccccatttcgcaattaatttaaaaaccaatgaaaaacgccaattaaaggaatttcaatctggtgttgccattgcagggattggcaatccacagcgtttttttactatgttagaaaagttagggattcaattagaacgaactcaagcatttcaagatcatcaacattttgaagcctctcaattagaaaaacttgctgaaaatcaaccgctctttatgacggaaaaagatgccgtaaaatgccaatcttttgccaacgataattggtggtatgtccctgtagatgcagagattattgaggctgaaaaacaatgtgaaaatttaccgcacttttgggacaaaatagacaaacttgtggcgcaatatagaaatggc

SEQ ID NO: 1754 - protein, 313 aa, Haemophilus influenzae
  Name: NTH0965
LFWLISQLRHALFCLGIKSSYRAPKPVIIVGNLSVGGNGKTPVVVWLVEELKKRGLRVGVISRGYGSKSKTYPLFVTENTRPIEGGDEPVLIAKRTNAPVVISPNRQQAIELLLSQAECDIIVSDDGLQHYKLQRDLEIVVMDAERALGNGFVLPAGPLRELPSRLKSVDFVITNGGKNQYSDAVMYLVPHFAINLKTNEKRQLKEFQSGVAIAGIGNPQRFFTMLEKLGIQLERTQAFQDHQHFEASQLEKLAENQPLFMTEKDAVKCQSFANDNWWYVPVDAEIIEAEKQCENLPHFWDKIDKLVAQYRNG

SEQ ID NO: 1755 - DNA, 762 bp, Haemophilus influenzae
  Name: NTH0966
atgtcatttaccgttattatccccgctcgttttgcatcaagtcgtttacctggaaaaccgcttgccgatattgcaggtaagccaatgattcaacatgtatttgagaaagcgctgcagtctggggcgaaccgagtgattattgccaccgataatgaaaatgtggctgatgttgccaaaaattttggcgcggaagtgtgcatgacttcggttaatcataattctggtacagaacgtttagcggaagttgtagaaaaattagcgattcctgacaatgaaatcattgtcaatattcaaggcgatgagcctttgattcctcccgttatcgtgcgacaagtggcagataatttagcaaaatttaatgtcaatatggcaagtcttgcggtaaaaattcatgatgctgaggaattattcaatccaaatgcagtgaaagttttgacggataaagacggctatgtgctatatttttcccgttcggttattccttacgatcgtgatcagtttatgaatttacaggatgttcagaaagtacagcttgcggacgcttacttacgtcatattggcatttacgcatatcgtgcggggttcataaaacaatatgtgcaatgggctccgactcaacttgaaaatctagaaaaacttgagcagcttcgtgtgttatataacggcgaacgcattcacgtagagcttgcgaaagaagtgcctgcagtgggggtggatactgctgaagatttggaaaaagtgcgggcaattttagcggcgaat

SEQ ID NO: 1756 - protein, 254 aa, Haemophilus influenzae
  Name: NTH0966
MSFTVIIPARFASSRLPGKPLADIAGKPMIQHVFEKALQSGANRVIIATDNENVADVAKNFGAEVCMTSVNHNSGTERLAEVVEKLAIPDNEIIVNIQGDEPLIPPVIVRQVADNLAKFNVNMASLAVKIHDAEELFNPNAVKVLTDKDGYVLYFSRSVIPYDRDQFMNLQDVQKVQLADAYLRHIGIYAYRAGFIKQYVQWAPTQLENLEKLEQLRVLYNGERIHVELAKEVPAVGVDTAEDLEKVRAILAAN

SEQ ID NO: 1757 - DNA, 231 bp, Haemophilus influenzae
  Name: NTH0967
atgtttgatgctaaaaagttcttagcggatgtctctcacgaacctggtgtttatcgtatgtatgacgataaagatcaggttatttatgttgggaaagcaaaggatctaaaaaaacgtctttcaagctattttcgtaaaaatctgagtagtaaaaaaacagaggcgttggtagcatcaattcatcatattgacaccatgctaacttcatctgaaacgggagcctttactgct

SEQ ID NO: 1758 - protein, 77 aa, Haemophilus influenzae
  Name: NTH0967
MFDAKKFLADVSHEPGVYRMYDDKDQVIYVGKAKDLKKRLSSYFRKNLSSKKTEALVASIHHIDTMLTSSETGAFTA

SEQ ID NO: 1759 - DNA, 120 bp, Haemophilus influenzae
  Name: NTH0968
gtgatgaatacgccgttttttattagctggcgttatcaacgtggcaaacaaaaaaatcctttagtcgcgttaattgcaaaattctctgcaattggtattgatttgggggttgcgcagttt

SEQ ID NO: 1760 - protein, 40 aa, Haemophilus influenzae
  Name: NTH0968
VMNTPFFISWRYQRGKQKNPLVALIAKFSAIGIDLGVAQF

SEQ ID NO: 1761 - DNA, 612 bp, Haemophilus influenzae
  Name: NTH0969
gtgttaaaaggcgtttctttttctatggaacctgcagagttggttgcgattgtggggagttcaggttcagggaaaagtactttattacatactttagggggacttgatcagccaagtagtggggaagtgtttattaatggacaatccttgcaaaaagcatcggctaatgaattagctgctttgcgtaatcgttatttaggatttgtgtaccaattccatcatttaatggcggattttaccgcacttgaaaatgtgatgatgccgatgttgattggtcatcaaaataaaactgaagcgaaagatcgcgctgaaaaaatgctaagtgcggtgggattaagccatagaattacccatcgtccttctgcgctttctggtggggaacgtcagcgtgtggcgattgcgcgtgctttagtgaataatccatcgttagttttagcggatgaacccacaggaaatctcgatcacaagaccactgaaagtatttttgagctgattcaacaacttaatcaagaacaaaatatcgcctttttattagtcactcacgatatggggcttgcggaaaaattatcacgccgtttagttatgcaagatggtcttttgaaggagggggcg

SEQ ID NO: 1762 - protein, 204 aa, Haemophilus influenzae
  Name: NTH0969
VLKGVSFSMEPAELVAIVGSSGSGKSTLLHTLGGLDQPSSGEVFINGQSLQKASANELAALRNRYLGFVYQFHHLMADFTALENVMMPMLIGHQNKTEAKDRAEKMLSAVGLSHRITHRPSALSGGERQRVAIARALVNNPSLVLADEPTGNLDHKTTESIFELIQQLNQEQNIAFLLVTHDMGLAEKLSRRLVMQDGLLKEGA

SEQ ID NO: 1763 - DNA, 102 bp, Haemophilus influenzae
  Name: NTH0970
gtgatagactcgcgcaagtttttgatgggattatctgccgctaaagtgcggttaaaacgagtaaaaaatgaacaactatttattaaaatgcgaaaatatcaa

SEQ ID NO: 1764 - protein, 34 aa, Haemophilus influenzae
  Name: NTH0970
VIDSRKFLMGLSAAKVRLKRVKNEQLFIKMRKYQ

SEQ ID NO: 1765 - DNA, 120 bp, Haemophilus influenzae
  Name: NTH0971
ttgcgcgagtctatcacacttttccttgagcttaaatttcaatacacccaaagtattcaaatcctgtttcaggaaaatgtttttcaagataacgttttaaatagcgttgggtttcttgac

SEQ ID NO: 1766 - protein, 40 aa, Haemophilus influenzae
  Name: NTH0971
LRESITLFLELKFQYTQSIQILFQENVFQDNVLNSVGFLD

SEQ ID NO: 1767 - DNA, 123 bp, Haemophilus influenzae
  Name: NTH0972
atgtataacggttacccagaatatgatcctattattagtcaagaaacccaacgctatttaaaacgttatcttgaaaaacattttcctgaaacaggatttgaatactttgggtgtattgaaatt

SEQ ID NO: 1768 - protein, 41 aa, Haemophilus influenzae
  Name: NTH0972
MYNGYPEYDPIISQETQRYLKRYLEKHFPETGFEYFGCIEI

SEQ ID NO: 1769 - DNA, 90 bp, Haemophilus influenzae
  Name: NTH0973
gtgcggaagatttttcaaggatttttgcttcaatttttttacttttctcgctttgcagctaaatgtggcgaacaaggatattcaaaaaca

SEQ ID NO: 1770 - protein, 30 aa, Haemophilus influenzae
  Name: NTH0973
VRKIFQGFLLQFFYFSRFAAKCGEQGYSKT

SEQ ID NO: 1771 - DNA, 270 bp, Haemophilus influenzae
  Name: NTH0974
atgggcaaggttatttttatatctggcattgatactgatgtgggaaaaacgattgccacaggcatttatgctaaaaaattgatggaacaaggctgctccgtgattacacaaaaaatgattcaaacaggctgtaaaaatatcgctgatgatttacttgtgcatcgaaagattcaagacattgatttaacggaagaagatttacaaggcaaaacctgcccttatgtttttgaatatccttgttcgccacatttagctgcaaagcgagaaaag

SEQ ID NO: 1772 - protein, 90 aa, Haemophilus influenzae
  Name: NTH0974
MGKVIFISGIDTDVGKTIATGIYAKKLMEQGCSVITQKMIQTGCKNIADDLLVHRKIQDIDLTEEDLQGKTCPYVFEYPCSPHLAAKREK

SEQ ID NO: 1773 - DNA, 669 bp, Haemophilus influenzae
  Name: NTH0976
atgatgcatttgcaagactatttaccaaatgggtcattagatagcgttttggaactaggttgcgggtctggtatgttgagtacgttgttgcagaaacagatttcagccaactattggttatttaatgatttgtgcgatgtgcgcactctactcactgaaaagctgattcaaccctttgatttttattgtggtgatgcagagaactttccttttcaacgacgatttgacttgattgcaagtgcatccgccgtgcaatggtttcaccaacccgacgcttttatcgcccattgcaaaacaggcttgaaaacaaacggattattggcggttgcaacctttggcgaagacaatttgaaagaagtccgccagatcacaaatataggattaaattacccgactttatcccaatggcaaaattggttagccaatgattttgagcttttatggtgtgaggattttaatgtaatactagactttgatacaccattggatgtactcaaacatctgaaatataccggtgtaacagcgactaaccaaaaaaattggacaagaaaaaatctcaatggatttattggcgattacttgtcggcgttcagtatgccgtcggacaaagtgcgcctgacttatcatccgttattttttatcgcacgctattctcacatagaaaatcag

SEQ ID NO: 1774 - protein, 223 aa, Haemophilus influenzae
  Name: NTH0976
MMHLQDYLPNGSLDSVLELGCGSGMLSTLLQKQISANYWLFNDLCDVRTLLTEKLIQPFDFYCGDAENFPFQRRFDLIASASAVQWFHQPDAFIAHCKTGLKTNGLLAVATFGEDNLKEVRQITNIGLNYPTLSQWQNWLANDFELLWCEDFNVILDFDTPLDVLKHLKYTGVTATNQKNWTRKNLNGFIGDYLSAFSMPSDKVRLTYHPLFFIARYSHIENQ

SEQ ID NO: 1775 - DNA, 1647 bp, Haemophilus influenzae
  Name: NTH0977
ttgcttactcacaatattgacgtacaagataaaatcgccatttttgcccataatatggaacgttggacaatcgctgacattgcaaccttacaaattcgagcaatcacagtgcctatttactcaaccaatacagcccagcaagcagaatttatcctaaatcacgccgatgtaaaaattctcttcgtcggcgatcaagagcaatacgatcaagcattggaaattgctcatcattgtccaaaattacaaaaaattgtggcaatgaaatctacaattcaattacaacaagatcctctttcttgcacttgggaaagttttattgaaacaggttcaaacgcccaacaagatgaactgactcaacgcttaaaccaaaaacaattatcggatttatttacgattatttatacctcaggcacaacgggagagcctaaaggtgtcatgttagattacgctaatctcgcgcatcaattagaaacgcacgatctttcacttaatgtgacagatcaggatatttcactttcttttttaccattctctcatatttttgaacgggcatgggcggcttatattcttcatagaggcgcaatactttgctatttagaagacaccaatcaagtacggtcagctttaacggaaattcgcccaactttaatgtgtgccgtcccacgtttttacgaaaaaatttatgcagccgtgctggataaagttcaaaaagcaccaaaacttcgccaaataatgttccattggacaatttctgtaggacaaaaacattttgatttacgtgcgaataacaaagctattccgttcttattgaagaaacaatttgctttagcggataaattagtactctcaaaacttcgccaattattgggtgggcgtataaaaatgatgccttgcggaggagcaaaattagaaccggctattgggttatttttccacgccattggtatcaacatcaaattaggctatggcatgacagaaacaaccgcaaccgtttcttgctggcatgatttccaatttaacccaaattcaatcggcacactcatgccaaaagcggaagttaaaattggggaaaataatgaaatcctcgtgcgtggcaaaatggtaatgaaaggctattacaagaagccagaagaaacggctcaagccttcacaaaagatggtttcttaaaaactggcgatgcgggagagtttgacgaacaaggaaatttatttattaccgatcgtatcaaagaattaatgaaaacctcaaacggtaaatatatcgcgccacaatatatcgaaagcaaaatcggtaaagataaatttatcgaacaaattgcaatcatcgcagatgcgaaaaaatatgtgtccgcactgattgtgccttgctttgatagtttggaagagtacgctaaacagatcaatattaaatatcatgaccgtttagaattattaaaaaattctgacattctgaaaatgtttgagcaacgtattaatgcggtgcaaaaagaattggctcactttgagcaagtaaagaaattcacgctactctctcaagcattcagcattaaattaggcgaaattacaccaacattaaaattgcgtagaaaagtgattttggaacgttatcgcaagcaaattgaagcaatgtatcattcacaagaagca

SEQ ID NO: 1776 - protein, 549 aa, Haemophilus influenzae
  Name: NTH0977
LLTHNIDVQDKIAIFAHNMERWTIADIATLQIRAITVPIYSTNTAQQAEFILNHADVKILFVGDQEQYDQALEIAHHCPKLQKIVAMKSTIQLQQDPLSCTWESFIETGSNAQQDELTQRLNQKQLSDLFTIIYTSGTTGEPKGVMLDYANLAHQLETHDLSLNVTDQDISLSFLPFSHIFERAWAAYILHRGAILCYLEDTNQVRSALTEIRPTLMCAVPRFYEKIYAAVLDKVQKAPKLRQIMFHWTISVGQKHFDLRANNKAIPFLLKKQFALADKLVLSKLRQLLGGRIKMMPCGGAKLEPAIGLFFHAIGINIKLGYGMTETTATVSCWHDFQFNPNSIGTLMPKAEVKIGENNEILVRGKMVMKGYYKKPEETAQAFTKDGFLKTGDAGEFDEQGNLFITDRIKELMKTSNGKYIAPQYIESKIGKDKFIEQIAIIADAKKYVSALIVPCFDSLEEYAKQINIKYHDRLELLKNSDILKMFEQRINAVQKELAHFEQVKKFTLLSQAFSIKLGEITPTLKLRRKVILERYRKQIEAMYHSQEA

SEQ ID NO: 1777 - DNA, 189 bp, Haemophilus influenzae
  Name: NTH0979
ttggcgtacaaacccaatgaagtgattgcatttggcgataattttaatgatttggatatgctacaacacgcaggacttggggtggcaatgggaaatgcgccagatgaaattaaacaagcggcaaatgtgattacggcaaccaataatgaagatggacttgcattgattttagaagaaaagtttcctgaa

SEQ ID NO: 1778 - protein, 63 aa, Haemophilus influenzae
  Name: NTH0979
LAYKPNEVIAFGDNFNDLDMLQHAGLGVAMGNAPDEIKQAANVITATNNEDGLALILEEKFPE

SEQ ID NO: 1779 - DNA, 615 bp, Haemophilus influenzae
  Name: NTH0981
atgatgtataaagcagtatttagtgattttgatggcaccttattaacctctcaacataccatttcccctcgaactgttgcggtaattaagcgtttaacggcgaatggcattccttttgtgccaatttcggcgcgttctcctctaggtattttgccttattggaaacagcttgaaacgaataatgtgcttgttgcatttagtggcgcgcttattttgaaccaaaatctcgaaccaatttatagcgtacaaatcgatccaaaagatattttagagattaataccgttttggcggaacatcctttgcttggcgtgaattattatacaaataatgattgccatgctcgtgacgtagaaaataaatgggtgatttatgaatgcagcgtgaccaaaattgagattcatccttttgatgaagtagcgacaagttcgccacataaaattcaaattattggggaagcagaagaaatcattgagattgaagttcttttaaagaaaaaatttccacatttaagtatttgccgttcccacgctaattttttagaggtaatgcacaagaatgcaaccaaaggaagtgcggtgcgttttttggaagattattttggcgtacaaacccaa

SEQ ID NO: 1780 - protein, 205 aa, Haemophilus influenzae
  Name: NTH0981
MMYKAVFSDFDGTLLTSQHTISPRTVAVIKRLTANGIPFVPISARSPLGILPYWKQLETNNVLVAFSGALILNQNLEPIYSVQIDPKDILEINTVLAEHPLLGVNYYTNNDCHARDVENKWVIYECSVTKIEIHPFDEVATSSPHKIQIIGEAEEIIEIEVLLKKKFPHLSICRSHANFLEVMHKNATKGSAVRFLEDYFGVQTQ

SEQ ID NO: 1781 - DNA, 435 bp, Haemophilus influenzae
  Name: NTH0982
ttgccacagaaaaatataaagggtttgccgacagaagagcagatattgcagtgggcaacaggtgctgttcaaccagaagggaatgaagtcgaaatgacggtgcgtattgtggatgaagccgaaagccatgaattaaatttaacttatcgtggaaaggatcgcccgactaacgtgctttcatttccatttgaatgccccgatgaggtggagttgccattgttaggggatctcgttatttgtcgtcaagtcgtggagcgagaagctgcagaacaagagaaaccattaatggcgcattgggcgcatatggtcgtgcatggttgtttacatttactcggttatgatcatattgaagacgatgaagcggaagaaatggaaagtttagaaacccaaattatgcaaggattaggctttgatgatccttatttagcagagaaa

SEQ ID NO: 1782 - protein, 145 aa, Haemophilus influenzae
  Name: NTH0982
LPQKNIKGLPTEEQILQWATGAVQPEGNEVEMTVRIVDEAESHELNLTYRGKDRPTNVLSFPFECPDEVELPLLGDLVICRQVVEREAAEQEKPLMAHWAHMVVHGCLHLLGYDHIEDDEAEEMESLETQIMQGLGFDDPYLAEK

SEQ ID NO: 1783 - DNA, 1722 bp, Haemophilus influenzae
  n 1717, 1718, 1719, 1720, 1721: n is any nucleotide
  Name: NTH0983
atgttaagcaagctagaacatcatgatttaacggaaaaagaacgcaattatattgaacgtctattacttcgtttaatcgctgaagcatggcataccaacgaaattcgtactgttcgcccaacgccatttgatgaggctaaatggggctttgcgatgttagaaaacagtttgtggcaagctgtgccagaatttttacgccaactcaacgaaaccgcccgtgaatttttaggttacgatttgccggtaggattaaaacctgtgcgtatttcctcttggatgggcggcgaccgtgatggaaatccatttgttaccgcacaaattaccaaaaaagtactttattttgcccgctggaaagcggcggatttattcttacaagacatcagcaaattagccgatgaactttcaatgatgaaatgtagcgatgaatttcgtgataaatacggcgaacatttagaaccctatcgtttcgtagtaaaaaatttacgcaatcaacttacagcaacattagcttattttgatgatcacttatctaatcgcacaccaagagtctccgaaagcgagattattttggaagataatcaactgtgggagccgctttacgattgttatcaatctttaattcaatgtggtatgcgcattattgcaaatggttcattgttggatattttgcaccgtattagttgttttggtgtgacgctttctcaaatggatattcgccaagaaagcactcgtcacaccgatgccattgctgaaatcatgcgctatattggtttgggcgattactctcaatggatggaagacgataaacaggctttcttaattcgtgaattaagctctcgccgtccattgattccgcaaaactggacgccatcgcctgaaaccaaagaaattttagatacttgtaaagtcattgctcaacaaaaacaaggtgtcattgcgtgttatgttatttcgatggcgcgcagtgcatctgatgttttagccgttcatttactcttaaaagaagctggcgtgccatatcatattcctgttgtgccattattcgaaaccttagaggatttagatgcagccgaaaaagtgatgactcaacttttcaatgtgggttggtatcgtggcgtgatcaataatcgtcaaatggtaatgattggctattcagattcggcaaaagatgcgggaatgatggctgcttcttgggcgcaataccgtgcgcaagaagccttagtaaatttaacagaaaaacttggcattgaactcactttattccacggacgtggtggcacaattggtcgtggcggtgcgccagcacatgcggcattactttctcagccacctcgttcattaaaaaatggtttacgtgtaacagaacaaggcgaaatgattcgtttcaaactgggtttacccgcagtagcagtagaaacctttgatctctacgccagcgccattttagaagcaaatcttttaccaccaccagaaccgaaaccagaatggcgtactataatggacgagctttccacgatttcttgcgatatttatcgtggtgtggtgcgtggcgataaagattttgtgccttatttccgcagtgcgacgccagaacaggaactctccaaattgccgcttggctctcgccctgcaaaacgcaatccaaatggcggtgtggaaagtttacgtgcgatcccgtggatttttgctgggggtaccgagtccgaattcgataacnnnnnt

SEQ ID NO: 1784 - protein, 574 aa, Haemophilus influenzae
  Xaa 573, 574: Xaa is any amino acid
  Name: NTH0983
MLSKLEHHDLTEKERNYIERLLLRLIAEAWHTNEIRTVRPTPFDEAKWGFAMLENSLWQAVPEFLRQLNETAREFLGYDLPVGLKPVRISSWMGGDRDGNPFVTAQITKKVLYFARWKAADLFLQDISKLADELSMMKCSDEFRDKYGEHLEPYRFVVKNLRNQLTATLAYFDDHLSNRTPRVSESEIILEDNQLWEPLYDCYQSLIQCGMRIIANGSLLDILHRISCFGVTLSQMDIRQESTRHTDAIAEIMRYIGLGDYSQWMEDDKQAFLIRELSSRRPLIPQNWTPSPETKEILDTCKVIAQQKQGVIACYVISMARSASDVLAVHLLLKEAGVPYHIPVVPLFETLEDLDAAEKVMTQLFNVGWYRGVINNRQMVMIGYSDSAKDAGMMAASWAQYRAQEALVNLTEKLGIELTLFHGRGGTIGRGGAPAHAALLSQPPRSLKNGLRVTEQGEMIRFKLGLPAVAVETFDLYASAILEANLLPPPEPKPEWRTIMDELSTISCDIYRGVVRGDKDFVPYFRSATPEQELSKLPLGSRPAKRNPNGGVESLRAIPWIFAGGTESEFDNXX

SEQ ID NO: 1785 - DNA, 909 bp, Haemophilus influenzae
  n 904, 905, 906, 907, 908: n is any nucleotide
  Name: NTH0984
atgtcagcttttcagccaactattaagcgtcgtgaatcgacaaaaatttatgtgggaaatgtaccaattggtggggatgcaccgattgccgtgcaatcaatgacaaatactcgcaccactgatgtggaagcgacagttgctcaaattaaatcattagaacgtgttggtgcagatattgttcgtgtatctgttccaacaatggatgctgcggaagcatttaaacaaattaaacaacaagtgaatgtcccgctcgtagcagatattcattttgactatcgtattgcgttaaaagtcgcagaatatggagtggattgtttacgtatcaatcctggcaacattggtcgtgaagatcgcgtccgtgccgttgttgattgtgcgcaagacaaaaatattccgattcgtattggtgtaaatgcaggctctttagaaaaagatttgcaagaaaaatatggcgaaccaacgccagaagccttgttagaatccgcattgcgtcatgtagaaattctagatcgtcttaacttcgatcagtttaaagtgagcgtaaaagcctccgatgtattcttagcggttgaatcttatcgtttactggctaaagcaattaaacagcctttacatttaggcattacagaagcaggtggcgcacgcgctggcgcagtaaaatctgcggtgggtttaggaatgttattagctgagggcattggtgatacactgcgcatctctttggcggcagatcccatagaggaaatcaaagtcggttttgatattttgaaatctttacggattcgttcaagaggaattaactttattgcttgcccaacctgttctcgccaagaatttgatgtaatcggtacagtaaatgcgctagaacaacgccttgaagatattattacaccaatggatgttnnnnnt

SEQ ID NO: 1786 - protein, 303 aa, Haemophilus influenzae
  Xaa 302, 303: Xaa is any amino acid
  Name: NTH0984
MSAFQPTIKRRESTKIYVGNVPIGGDAPIAVQSMTNTRTTDVEATVAQIKSLERVGADIVRVSVPTMDAAEAFKQIKQQVNVPLVADIHFDYRIALKVAEYGVDCLRINPGNIGREDRVRAVVDCAQDKNIPIRIGVNAGSLEKDLQEKYGEPTPEALLESALRHVEILDRLNFDQFKVSVKASDVFLAVESYRLLAKAIKQPLHLGITEAGGARAGAVKSAVGLGMLLAEGIGDTLRISLAADPIEEIKVGFDILKSLRIRSRGINFIACPTCSRQEFDVIGTVNALEQRLEDIITPMDVXX

SEQ ID NO: 1787 - DNA, 165 bp, Haemophilus influenzae
  Name: NTH0985
atgtctgaaactgatttttcatcgtttttgggttgtgaaacgctattttcttgtgctatttctggtaacagattatttgttatttctactggttgtgagactggtgctgctgtttctggtgcagatttattagtttcttctgttgtcacaagagcggtggtgggc

SEQ ID NO: 1788 - protein, 55 aa, Haemophilus influenzae
  Name: NTH0985
MSETDFSSFLGCETLFSCAISGNRLFVISTGCETGAAVSGADLLVSSVVTRAVVG

SEQ ID NO: 1789 - DNA, 921 bp, Haemophilus influenzae
  Name: NTH0986
ttgattaactttatgaatccaactactgagcaagtgctttctcctggtgagatttttcgtcaaacacgcgaagccttaaatctttctcttgaagatgtcgctaaagaaatcacgctacgcccttctatattagagcaacttgaaaataatgaatttattcaaaaatcaacgccttctatatttgtcaaaggttatgttcgcagctatgcaaaattcttacgtttgccagattctgtgtgggaaaatattgtttttgctgaaaccgaaaaaaatgatttagggaaaaatgcacgttcaacccgtgccgttaatcaatattcttctcacaatcgttggatcgggcgtttaaccgcaatagtattcgtgatggtaattggtatgactgggctttggtggtggcaaagttatcaacaaaatactcaagaacgcgatgatttagtgcaaagctatgttgcctctaccgaaaacaatcagcccaccaccgctcttgtgacaacagaagaaactaataaatctgcaccagaaacagcagcaccagtctcacaaccagtagaaataacaaataatctgttaccagaaatagcacaagaaaatagcgtttcacaacccaaaaacgatgaaaaatcagtttcagacattcaaagtgcgggcgaaaatccaagtatttctccaacgttacctatagcaaaaggcgatttagtgattgaaatactagcaaatagcagttggattagtgtaaaagataacgctcgccacgtattagcacaaaaagaatataaacaaggcgaaatattaacctttaatggcaatgaattttcattaattgtaggcgcaccaagcaatgtgcgtatcacttacaaaggcgagaattatcctctcaaagtggatggtcgcgtagcaaaattcaagctttcacaacct

SEQ ID NO: 1790 - protein, 307 aa, Haemophilus influenzae
  Name: NTH0986
LINFMNPTTEQVLSPGEIFRQTREALNLSLEDVAKEITLRPSILEQLENNEFIQKSTPSIFVKGYVRSYAKFLRLPDSVWENIVFAETEKNDLGKNARSTRAVNQYSSHNRWIGRLTAIVFVMVIGMTGLWWWQSYQQNTQERDDLVQSYVASTENNQPTTALVTTEETNKSAPETAAPVSQPVEITNNLLPEIAQENSVSQPKNDEKSVSDIQSAGENPSISPTLPIAKGDLVIEILANSSWISVKDNARHVLAQKEYKQGEILTFNGNEFSLIVGAPSNVRITYKGENYPLKVDGRVAKFKLSQP

SEQ ID NO: 1791 - DNA, 135 bp, Haemophilus influenzae
  n 122, 123, 124, 125, 126: n is any nucleotide
  Name: NTH0987
gtggggattatttctgtgcaaatgcctcaagcgagtttccccttctctttgtcgtatgttggatacctaatctctaccccctttttcaacccctttggtatttctccccgtcacacttctgnnnnnttaattaat

SEQ ID NO: 1792 - protein, 45 aa, Haemophilus influenzae
  Xaa 41, 42: Xaa is any amino acid
  Name: NTH0987
VGIISVQMPQASFPFSLSYVGYLISTPFFNPFGISPRHTSXXLIN

SEQ ID NO: 1793 - DNA, 678 bp, Haemophilus influenzae
  n 530, 669, 670, 671, 672, 673: n is any nucleotide
  Name: NTH0988
atggcgacaatgaaagatattgcacgactggcgcaagtttcgacttctacagtttcacatgtcattaatggatcgcgttttgttagcgatgaaattcgtgagaaagtgatgcgtattgtcgctgaactgaattacaccccttcagctgttgcacgaagccttaaggtgcgcgaaaccaaaactatcgggctacttgtcaccgcaacaaataatcccttctttgcggaagtgatggctggcgtggagcaatattgtcagaaaaatcaatataatcttattattgctacaacgggtggagatgccaaacgcctacaacaaaatctgcaaactctaatgcacaaacaagtggatggtttgcttttgatgtgtggtgatagccgttttcaggctgatatagagttagccatttcgctgccactggttgtgatggactggtggtttactgagttaaatgcagataaaatactcgaaaattcagcacttggtggctatttggcgacaaaagcattaattgatgcaggacatcgtanaattggcattattacgggaaatctcaaaaaatctgtcgcacaaaatcgtttgcaaggttataaaaatgcgctgtcgcaagcaaaaattgcgttaaatcctcattggattgtcgaaagtcattttgactttgaaggcggnnnnnttaat

SEQ ID NO: 1794 - protein, 226 aa, Haemophilus influenzae
  Xaa 177, 224, 225: Xaa is any amino acid
  Name: NTH0988
MATMKDIARLAQVSTSTVSHVINGSRFVSDEIREKVMRIVAELNYTPSAVARSLKVRETKTIGLLVTATNNPFFAEVMAGVEQYCQKNQYNLIIATTGGDAKRLQQNLQTLMHKQVDGLLLMCGDSRFQADIELAISLPLVVMDWWFTELNADKILENSALGGYLATKALIDAGHRXIGIITGNLKKSVAQNRLQGYKNALSQAKIALNPHWIVESHFDFEGGXXN

SEQ ID NO: 1795 - DNA, 966 bp, Haemophilus influenzae
  Name: NTH0989
ttgtcccattgtgtagaaagaaaaaatataacaatacaggataaaataatgaaaaaaaccctcacggttctcggtagtatcaatgctgatcacgttatttctgtgccttactttgctaaacccggtgaaacgctaacaggtcaaaattatcaaattgcctatggtggcaaaggtgccaatcaagcagtggcagccgctcgtttaggtgcaaaggtagcgttcattagttgcattggatcagatagcataggcaaaacaatgaaaaatgcgtttgagcaagaaggaattgatacaacccatattaataccgtttcacaggaaatgacaggaatggcatttattcaagtcgccaagtctagtgagaacagtattgtgttggctagcggtgcaaatgcacatttgggtgagatggtcgttcgtcaaagtgaggcgcaaattgcacaatcggattgcttgttaatgcaattagaaaccccactttctggtgtggagctggctgctcaaatcgctaagaaaaatggtgttaaggttgtgctaaatcctgctccagcgcagattttatcggacgaattattgagtttgattgatattattacaccaaatgaaacagaagctgaaatcctgacgggggtagcggtagccgacgagcaaagtgcggtgaaagctgcgagtgtttttcacgataaaggcattgaaaccgtaatgattacccttggcgcgaaaggtgtgtttgtcagtcgaaaaggtaaaagccgcatcattaagggcttttgtgtgcaagcaatagatactaccgcagctggtgatacatttaatggcggttttgttacggctttattggaagaaaaatcctttgatgaagccattcgttttggtcaagctgccgctgcgattagtgtgacgaaaaaaggggctcaatcctctattccaacgcgtcaagaaactttggaatttcttgaacacgct

SEQ ID NO: 1796 - protein, 322 aa, Haemophilus influenzae
  Name: NTH0989
LSHCVERKNITIQDKIMKKTLTVLGSINADHVISVPYFAKPGETLTGQNYQIAYGGKGANQAVAAARLGAKVAFISCIGSDSIGKTMKNAFEQEGIDTTHINTVSQEMTGMAFIQVAKSSENSIVLASGANAHLGEMVVRQSEAQIAQSDCLLMQLETPLSGVELAAQIAKKNGVKVVLNPAPAQILSDELLSLIDIITPNETEAEILTGVAVADEQSAVKAASVFHDKGIETVMITLGAKGVFVSRKGKSRIIKGFCVQAIDTTAAGDTFNGGFVTALLEEKSFDEAIRFGQAAAAISVTKKGAQSSIPTRQETLEFLEHA

SEQ ID NO: 1797 - DNA, 468 bp, Haemophilus influenzae
  Name: NTH0990
gtgatttatcgcacagaattaggcgataatgccaaggtgattcaacttgaaggtattgcaggaacatctgcggcacgcgaacgaggtgagggtttcaaacaagctattgatgctcataaattcaatgtgcttgccagtcagccagcagattttgatcgaacaaaaggtttgaatgtaacggaaaatttgttggcatctaaaggtgatgttcaagcaatttttgcgcaaaatgatgaaatggcattaggtgcattacgtgcggtgaaagccgcaaataaaaaagtccttatcgtaggttttgatggtaccgatgatggtgttaaagcggtaaaaagtggcaaaatggcagcaactatcgcacaacaacccgagcttattggttcattaggtgttgttaccgctgataaaatcttaaagggcgaaaaagttgaagcgaaaattccagtagatttgaaagtaataagtgaa

SEQ ID NO: 1798 - protein, 156 aa, Haemophilus influenzae
  Name: NTH0990
VIYRTELGDNAKVIQLEGIAGTSAARERGEGFKQAIDAHKFNVLASQPADFDRTKGLNVTENLLASKGDVQAIFAQNDEMALGALRAVKAANKKVLIVGFDGTDDGVKAVKSGKMAATIAQQPELIGSLGVVTADKILKGEKVEAKIPVDLKVISE

SEQ ID NO: 1799 - DNA, 117 bp, Haemophilus influenzae
  Name: NTH0991
atgatcgatttaaaattgagtggacaacacgatttgatgataaaagatcgtaaactagtacttgtagatggcatcaatcaaaaagcacaacagattaaggttgtgcttttaacgttt

SEQ ID NO: 1800 - protein, 39 aa, Haemophilus influenzae
  Name: NTH0991
MIDLKLSGQHDLMIKDRKLVLVDGINQKAQQIKVVLLTF

SEQ ID NO: 1801 - DNA, 669 bp, Haemophilus influenzae
  Name: NTH0992
atgacggatattttaaccgcactttctgaaattaatgtgtcattacctggaaaaattgttagttatgatgcggaaacggtgcgagcaacggtacaaccctctattcctaagcggttagccaatggcgaagtattaaatgcaccgcagattgtaaacgtgccggtaatgttccctatggcagacattaacggtgcggtagcacaagtgacattaccagtgaaagcgggagacggctgcttgctgattttttcgcagcgatctctagaaaattggttaagtggaagcaatgatgcgccagatgatccgcgaatgtttgatttatccgatgctttttgtgtaatgggcggtaatagtcgctctccaaatgccgatgttgagaacctttgtattaaatacggtagcggtaaaattaaaatcgcaccaaatggcaatattacgatcaattcgcctgatgtaagggtaacaacggataattttactgtgactgcgacaaccagcacctttaacggcaatgtaatcgtaaatggcggtatttcaacggcaggtaacagtggcagtgtatccgttagtggttctttaacgacaactggcgatgttatggcagatggtgtgtcattacaaagtcacaagcacaaaggcgatagcggtggtacaacagggaaaccatta

SEQ ID NO: 1802 - protein, 223 aa, Haemophilus influenzae
  Name: NTH0992
MTDILTALSEINVSLPGKIVSYDAETVRATVQPSIPKRLANGEVLNAPQIVNVPVMFPMADINGAVAQVTLPVKAGDGCLLIFSQRSLENWLSGSNDAPDDPRMFDLSDAFCVMGGNSRSPNADVENLCIKYGSGKIKIAPNGNITINSPDVRVTTDNFTVTATTSTFNGNVIVNGGISTAGNSGSVSVSGSLTTTGDVMADGVSLQSHKHKGDSGGTTGKPL

SEQ ID NO: 1803 - DNA, 762 bp, Haemophilus influenzae
  Name: NTH0993
atgcggtgcgtgctgtatcccggttatgcgcagaaaggtgacgtgttgttatgctctggcgatattgccacggcatattcgtatcacgaaggcgcagattgggtaacggagctttatgttttagatggcttggtagaaattcgcgatacggcggtttcattaggttatgtcggtggcgtgagttctacgcaaattactaatgatattgctgcaaaaatgggcgtaaccgtagttggtgcagataatttgaaatcacgcacttgggcaaatggttttagtttttacggtgccgcacgtaaagcgttagacaaagtcgttgcaggaacggggcttgagtggtcgatccaaaatggcgaactgcagattgtaaaccgcaatggcgtgacaaagcgatcgggttatgtgttggcaaaagatagcgggctaatcggttttcctgaacgcacacgtgaagcagcacgcagtaagaagcaggatacgccaaataaaaagaaagatgagaaatttgcctttgatcggcaagcgagggacggttggaatgtaaaaagcctgttactgcctatggtaaacccttgtgacaaaatcaagctggaaagtgtgacggtaacaaattggttccgcgtggaaaaaatcaagcattcgggggatagtcattctagcgattggcaaagcgaactacatttagtagatctaaacgcaccgactaaaacgcagatggaaacgcaaagtaaacatcgtaaaaaacgtaagaaaaaggacgat

SEQ ID NO: 1804 - protein, 254 aa, Haemophilus influenzae
  Name: NTH0993
MRCVLYPGYAQKGDVLLCSGDIATAYSYHEGADWVTELYVLDGLVEIRDTAVSLGYVGGVSSTQITNDIAAKMGVTVVGADNLKSRTWANGFSFYGAARKALDKVVAGTGLEWSIQNGELQIVNRNGVTKRSGYVLAKDSGLIGFPERTREAARSKKQDTPNKKKDEKFAFDRQARDGWNVKSLLLPMVNPCDKIKLESVTVTNWFRVEKIKHSGDSHSSDWQSELHLVDLNAPTKTQMETQSKHRKKRKKKDD

SEQ ID NO: 1805 - DNA, 156 bp, Haemophilus influenzae
  Name: NTH0994
ttgccacaagtggttggaaaagcgagtttttctgctgcggtgggcggttatggcagctgtaatgcgatggcaattggtgtcggctacacactaaaagcaaatatcaagttaaaaagcggtatcaattattcttttcttaaacacctgattttttcc

SEQ ID NO: 1806 - protein, 52 aa, Haemophilus influenzae
  Name: NTH0994
LPQVVGKASFSAAVGGYGSCNAMAIGVGYTLKANIKLKSGINYSFLKHLIFS

SEQ ID NO: 1807 - DNA, 150 bp, Haemophilus influenzae
  Name: NTH0995
ttgctgatctcttctcaagcctttgcggcgagtgacaattcaattagtacgaattacggcattaaagagtttggggcgtatagcctgatcattggtaatttaaagaataatacaattaatagtaaaatttccaatcaggctttaacgagt

SEQ ID NO: 1808 - protein, 50 aa, Haemophilus influenzae
  Name: NTH0995
LLISSQAFAASDNSISTNYGIKEFGAYSLIIGNLKNNTINSKISNQALTS

SEQ ID NO: 1809 - DNA, 156 bp, Haemophilus influenzae
  Name: NTH0996
ttgatatgtaaaggaaatacaaattttttcgtgcaaattccaatatttaactttaaaatacttgcctctgaacaaacattcattataaataaaagtcacaatatttattttataaataaaaaagtgcggttaaaatcatccgcactttttagttcg

SEQ ID NO: 1810 - protein, 52 aa, Haemophilus influenzae
  Name: NTH0996
LICKGNTNFFVQIPIFNFKILASEQTFIINKSHNIYFINKKVRLKSSALFSS

SEQ ID NO: 1811 - DNA, 1362 bp, Haemophilus influenzae
  Name: NTH0997
atgtttaaaatgaaaaatatcacgcttgctttgttgatgtctggtgcattggtgggatgtgccaatattggcgattcttatcaagcaagccttgaagattacaagcaatatgaagaaattaccaagcaatataatgtaaaagaaaattggtggtcgttatatgatgatgcgcaattaaatcgtgttatagagcaagctttaacaaacaataaagatttagctaaagctgctgtagcggtaaaccgtgcgctttatagtgcgaatttagtgggtgcaaatttagtgcctgcatttaatggttcaacttcatcagcagcacaacgccgagttgatatcagtacaaactctgccacttcacacaaaggttctttaaatgtgagctatacattagatctgtggcaacgtttggccaatactgttgatgcggcggaatggtcgcacaaagcaactgcagaagatatggaatcggctcgtttatcattaatcaattctgtagtaacaacttattatcaaattgcttatttaaatgatgctattagcacaaccaacgaaacgatcaaatattacacggatattggcaatattatgcaaacgcgtttagcgcaaggcgtggctgatgcagccagcgttgatcaagctcaacaagccatattaacggcgcgtaataacaaattaaattttgaaacccaacgcaaaacagcagaacaaacactgcgtaatcttctcaacctaaaaccaaatgaagcattaaatatcacgttcccacatattatgaatgtgaaaacggcaggcgtaaacttaaacgtgcctgtgtctgtaattgcaaatcgtcctgatgtaaaagcagcacaattccgtttaagcagtgcattcaaaaatgccaaagcaactcaaaaaagttggttcccagaggttaatttaggtgcaagcctttcttcaacagcaagcacagttggtacggcattacataaccctgtggctgctggcacagtaggaattagcttgccattcttaaattggaacaccgtaaaatggaacgttaaaatttctgaagctgactatgaaacagcacgtttaaattacgaacaacgtattaccacggctctcaataatgtggataccaactattttgcctttacccaagcgcaaagtacattaagtaatttacagcaaacccatagttacaatcagcgtatcacacaatattatcgaaatcgctataatgcgggcgtgtccgaattgcgcgaatggttagttgcagccaatacggaaaaatcatcacaacttgcgattttgaatgcaaaatatcaagtgctacaaagtgaaaatgcggtatatagctcaatggcgggatattatttg

SEQ ID NO: 1812 - protein, 454 aa, Haemophilus influenzae
  Name: NTH0997
MFKMKNITLALLMSGALVGCANIGDSYQASLEDYKQYEEITKQYNVKENWWSLYDDAQLNRVIEQALTNNKDLAKAAVAVNRALYSANLVGANLVPAFNGSTSSAAQRRVDISTNSATSHKGSLNVSYTLDLWQRLANTVDAAEWSHKATAEDMESARLSLINSVVTTYYQIAYLNDAISTTNETIKYYTDIGNIMQTRLAQGVADAASVDQAQQAILTARNNKLNFETQRKTAEQTLRNLLNLKPNEALNITFPHIMNVKTAGVNLNVPVSVIANRPDVKAAQFRLSSAFKNAKATQKSWFPEVNLGASLSSTASTVGTALHNPVAAGTVGISLPFLNWNTVKWNVKISEADYETARLNYEQRITTALNNVDTNYFAFTQAQSTLSNLQQTHSYNQRITQYYRNRYNAGVSELREWLVAANTEKSSQLAILNAKYQVLQSENAVYSSMAGYYL

SEQ ID NO: 1813 - DNA, 573 bp, Haemophilus influenzae
  Name: NTH1000
atggagaaaataatgaaaaaattaacattagcattggttttaggttcagctttagccgtgacaggttgttttgataagcaagaagcaaaacaaaaagttgaggatacgaaacaaactgtagcatcagtcgcatcagaaacaaaagatgctgcagctaatacaatgactgaagtaaaggaaaaagcacagcagctttctacagacgtgaaaaataaagtagcagagaaagtggaagatgcgaaagaagtaattaaatcagcaacagaaacagcatcagaaaaagcaactgaaataaaagaggcagtttcagaaaaagcaagtgagatgaaagaagctgcatcagaaaaagcaagtgagatgaaagaagctgcatcagaaaaagcaagtgagatgaaagaagctgcatcagaaaaagcaagtgaaatgaaagaagctgcatcagaaaaagcaagtgagatgaaagaagctgcatcagaaaaagtaggcgaaatgaaagaaaaagcaactgaaatgaaagaggcggtttcagaaaaagcaactcaagcagtagatgcagtgaaagaagcgacaaaa

SEQ ID NO: 1814 - protein, 191 aa, Haemophilus influenzae
  Name: NTH1000
MEKIMKKLTLALVLGSALAVTGCFDKQEAKQKVEDTKQTVASVASETKDAAANTMTEVKEKAQQLSTDVKNKVAEKVEDAKEVIKSATETASEKATEIKEAVSEKASEMKEAASEKASEMKEAASEKASEMKEAASEKASEMKEAASEKASEMKEAASEKVGEMKEKATEMKEAVSEKATQAVDAVKEATK

SEQ ID NO: 1815 - DNA, 819 bp, Haemophilus influenzae
  Name: NTH1001
atggagcgaggcaatggatcaacagaagatttaaccgcccgtattttagatttagcctcgccaattggtaaaggccaacgtgggttaatcgtagcaccaccaaaagcgggtaaaacaatgttgttgcaaaatattgcgcaaagtatcacgcataattaccccgatgtggaacttatcgtattattgattgatgaacgcccagaagaagtgacagaaatgcaacgttccgtaaaaggcgaagtcattgcgtctacttttgatgaacccgcaactcgtcacgttcaagtggcagaaatggtaatcgaaaaagcgaaacgttctgtagaacataaaaaagatgtggtcattttgcttgattctattactcgtttagcgcgcgcttacaatacagtcactccagcttcaggtaaaattttgtctggtggtgtggatgctaatgcgttgcatcgtccaaaacgtttctttggagctgcacgtaatgtggaagaaggcggcagtttaacgattattgcaacagcactagttgatactggttcgaaaatggatgaagtaatttttgaggaatttaaaggtacgggtaatatggaattgcacctttctcgtaaaattgcagaaagacgcgtattcccagccattgactttaaacgctctggtactcgtaaagaagacttactcacaacagcggacgaattacaaaaaatgtggattcttcgtaagattcttaatccaatggatgaagtggatgcaatggaattcttgattgataagctgatgatggcgaaaaccaacgaagagttttttgaagtgatgaaacgttcg

SEQ ID NO: 1816 - protein, 273 aa, Haemophilus influenzae
  Name: NTH1001
MERGNGSTEDLTARILDLASPIGKGQRGLIVAPPKAGKTMLLQNIAQSITHNYPDVELIVLLIDERPEEVTEMQRSVKGEVIASTFDEPATRHVQVAEMVIEKAKRSVEHKKDVVILLDSITRLARAYNTVTPASGKILSGGVDANALHRPKRFFGAARNVEEGGSLTIIATALVDTGSKMDEVIFEEFKGTGNMELHLSRKIAERRVFPAIDFKRSGTRKEDLLTTADELQKMWILRKILNPMDEVDAMEFLIDKLMMAKTNEEFFEVMKRS

SEQ ID NO: 1817 - DNA, 690 bp, Haemophilus influenzae
  Name: NTH1002
atgatttacttcacaatgtttttattaggcggcatcttagggatcgcattgtggttctacctatctggttttattacgcatttgcagcaagagatttatgcgacttacgttgaattatttccacaaaacagttctccatttcaaccgcactttgcctctattcaacaaaaaaagtgcggtcatattttgaggtatttttttagtattggggttggatttatatttttacaaattgccttcaaagattctatttttactgtatggatcggactcacacttattattctttggacaatcagttatcttgattggcactatcaacttatttctacgacaccctgtttatggttacttactctcggtttatttggcgcagacaataacttttcattgctaacgttatctgaaagcataaaaagtgcggctagtttttttattgttttctacgcaatctattggattgcaaaatgttattatagaaaagaagcctttggacggggagattattggctagcaatggcattaggaagttttattcatttagaaaccttaccgcactttttattattagcctcagtgcttggaatatgtttttcgcttattcataaaaagaaaaaagaatttataccttttgccccttttatgaacttatcggctatcattatttatctcgtcaaatattacggatat

SEQ ID NO: 1818 - protein, 230 aa, Haemophilus influenzae
  Name: NTH1002
MIYFTMFLLGGILGIALWFYLSGFITHLQQEIYATYVELFPQNSSPFQPHFASIQQKKCGHILRYFFSIGVGFIFLQIAFKDSIFTVWIGLTLIILWTISYLDWHYQLISTTPCLWLLTLGLFGADNNFSLLTLSESIKSAASFFIVFYAIYWIAKCYYRKEAFGRGDYWLAMALGSFIHLETLPHFLLLASVLGICFSLIHKKKKEFIPFAPFMNLSAIIIYLVKYYGY

SEQ ID NO: 1819 - DNA, 429 bp, Haemophilus influenzae
  Name: NTH1003
gtgaactttagtcaaagtttacaaattatgttgcaggccggcgtaccgcttaatcaggcactagacagttttcttcctcgcacacaaacttggcaaaccaagaaaacgcttgtaaacgatatggtattagataaagaagtgcggtcaattttgcaatgggtttctcaaggctatgcgttttctaatagcgtaagtagcgatcttttcccgatggaagcacaacaaatgctacaaattggcgaacaaagcggaaaactcgctttgatgctagagcatatcgcagataattaccaagaaaaacttaatcatcaaattgacttactctcacaaatgctagaaccattaatgatggtaatcatcggcagtctgattgggattattatgatgggaatgtatttacctatctttaatatgggatcagttattcaa

SEQ ID NO: 1820 - protein, 143 aa, Haemophilus influenzae
  Name: NTH1003
VNFSQSLQIMLQAGVPLNQALDSFLPRTQTWQTKKTLVNDMVLDKEVRSILQWVSQGYAFSNSVSSDLFPMEAQQMLQIGEQSGKLALMLEHIADNYQEKLNHQIDLLSQMLEPLMMVIIGSLIGIIMMGMYLPIFNMGSVIQ

SEQ ID NO: 1821 - DNA, 1179 bp, Haemophilus influenzae
  Name: NTH1004
ttgcagataaaacaatatttgactaactttctttttctcaatattttatcttcatttatcttctttattacaaatatgcaacttgacaaatacactgccaaaaaaattgttaaacgtgcaatgaagatcattcatcactctgtaaatgtaatggatcacgacggtgtgatcattgcgtcgggaaattcaacgcgtttgaatcaacggcacacaggagcggtgttggcgttgcgggaaaatcgtgtggtagagattgatcaagcgttggcacaaaaatggaattttgaagcgcaaccagggattaatttaccgattcattatttaggcaaaaatattggagtggtggggatttctggtgagccaactcaggtgaaacaatatgccgaactagtgaaaatgaccgcagaacttattgtggaacaacaggctttactcgaacaagaaagctggcatcgtcgttacaaagaagaatttattttgcaattattacattgcaatttgaattggaaaaagatggaacagcaggcgaaatttttttcttttgatttaaataaatctcgtgtggttgtattgattaagttacttaatccagccctggataatttacagcatctgatcaattatttggaacagtctgaatttgcacaggatgtggcaattttgtcccttgatcaggttgtggtcttaaagacttggcaaaactccaccgtactttctgctcaaatgaaaacgcttttacctgcagattattcaaaacaagattataaaattgctgtaggcgcttgtctaaatctaccgctttttgagcagcttcccttgtcttttcaaagtgcgcaaagcacgctttcttatggattaaaacatcatccacgcaagggtatttatgtgtttgatgagcatcgattgcctgtgttacttgctggattatcccattcttggcaagggaacgaattgataaaacccctttctccccttttctcagaagaaaatgcgacactttataaaacccttcaacaatattttttatcaaattgtgatctttatctcactgcggaaaaattatttgttcacccgaatactttgcgttatcgattgaacaaaatagagcaaataactggtttatttttcaataagatagatgataaattaacgctctatctcggaacgttgttagaacat

SEQ ID NO: 1822 - protein, 393 aa, Haemophilus influenzae
  Name: NTH1004
LQIKQYLTNFLFLNILSSFIFFITNMQLDKYTAKKIVKRAMKIIHHSVNVMDHDGVIIASGNSTRLNQRHTGAVLALRENRVVEIDQALAQKWNFEAQPGINLPIHYLGKNIGVVGISGEPTQVKQYAELVKMTAELIVEQQALLEQESWHRRYKEEFILQLLHCNLNWKKMEQQAKFFSFDLNKSRVVVLIKLLNPALDNLQHLINYLEQSEFAQDVAILSLDQVVVLKTWQNSTVLSAQMKTLLPADYSKQDYKIAVGACLNLPLFEQLPLSFQSAQSTLSYGLKHHPRKGIYVFDEHRLPVLLAGLSHSWQGNELIKPLSPLFSEENATLYKTLQQYFLSNCDLYLTAEKLFVHPNTLRYRLNKIEQITGLFFNKIDDKLTLYLGTLLEH

SEQ ID NO: 1823 - DNA, 138 bp, Haemophilus influenzae
  Name: NTH1005
atggcgttcagttttatcaaatttctaggtaagaaaaaggaagaatgggcattagccattacgggctatgtcgtgagtattcctattgtcttaccgattttacttattttcatcaaagctattcttgatttggggaaa

SEQ ID NO: 1824 - protein, 46 aa, Haemophilus influenzae
  Name: NTH1005
MAFSFIKFLGKKKEEWALAITGYVVSIPIVLPILLIFIKAILDLGK

SEQ ID NO: 1825 - DNA, 204 bp, Haemophilus influenzae
  Name: NTH1006
atgagtgaattacttattaatgactatacaagaaaaggttttgttgatggtctctgtgttcgcctgctcacaatttgtatccgtccaggaaaaccaaataaagcgacttcttcctttgtaagtagcattattcgagaacctttacatggtgaaacttcaatctgcccagttgctgaaaaatggcgttcagttttatcaaatttc

SEQ ID NO: 1826 - protein, 68 aa, Haemophilus influenzae
  Name: NTH1006
MSELLINDYTRKGFVDGLCVRLLTICIRPGKPNKATSSFVSSIIREPLHGETSICPVAEKWRSVLSNF

SEQ ID NO: 1827 - DNA, 117 bp, Haemophilus influenzae
  Name: NTH1007
gtggcgacattccatatttgtccactaacaaattttgatcacataatttgcgacaaaaatcttgttgaatctgcacagaatggcattagagaattaaatattaatttaactatcgta

SEQ ID NO: 1828 - protein, 39 aa, Haemophilus influenzae
  Name: NTH1007
VATFHICPLTNFDHIICDKNLVESAQNGIRELNINLTIV

SEQ ID NO: 1829 - DNA, 918 bp, Haemophilus influenzae
  n 11, 52, 127: n is any nucleotide
  Name: NTH1008
atgagtgtatntgtcgtcatcgtctttagcgaaataattcatcgagatatancaagccaggttacaaatattctcggtcaatctggtatgaaaatgtacaaggcgaaagtcaaaataaactcgattntttcgccccataacacgatgaaagcggccataatggcacgtgaagaagtggctgggtttgcatctgaagaagaggaaagttttatcgcatttgatacggaacgtggtcgtaatgcaaaatatattattttaacggatccccttgatggctcttcaaatattgatgtaaacgtatccgtcggtacaattttctccatttaccgtcgtgtatcccctattggctcacctgttaccttagaagattttatgcaaccaggtaataaacaagttgcctcgggttatattgtttatggttcatcaacaatgttggtttataccactggtcacggtgtgaatggtttcacttatgatccgtctatcggtacattctgtctttcccacgaaaatatgcaaatgccaaaagagggcaaaatttattccatcaatgaaggacaatacctgaaattcccacaaggtgtgaaaaaatatattaaatattgccaagaagaagataaagcgactcatcgcccttacgtatctcgctatattggttcacttgtagcagacttccaccgcaacttattaaaaggcggcatttatatttatccaagtgcaaccaactatccaaatggaaaactccgtttattatatgaaggcaatcctattgcatttttagcggagcaagctggcggtgtcgcaacagatggttatcgtcgaattttagatatcgaaccaaccgcacttcatgaacgtgttccactttttgttggttcagaagatatggtaaaaaaagcacaagaaatgaggaagatt

SEQ ID NO: 1830 - protein, 306 aa, Haemophilus influenzae
  Xaa 4, 18, 43: Xaa is any amino acid
  Name: NTH1008
MSVXVVIVFSEIIHRDIXSQVTNILGQSGMKMYKAKVKINSIXSPHNTMKAAIMAREEVAGFASEEEESFIAFDTERGRNAKYIILTDPLDGSSNIDVNVSVGTIFSIYRRVSPIGSPVTLEDFMQPGNKQVASGYIVYGSSTMLVYTTGHGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIEPTALHERVPLFVGSEDMVKKAQEMRKI

SEQ ID NO: 1831 - DNA, 594 bp, Haemophilus influenzae
  n 589, 590, 591, 592, 593: n is any nucleotide
  Name: NTH1009
ttgccgaaaaaatcttgccccgctattaaaactcccctattattcaccgcacttttttcttatttaggaacaaaaatgacagaacaaacctttattctcggcaaagatgctgcattagaagatagtattgcaaaatttcagcaaaaattgaccgcacttggttttaatattgaagaggcatcttggttgaatcctgtgccaaatgtgtggtctgtgcatattcgcgataaagactgtccgcagtgtttttctaatggtaaaggggcaagtaaaaaagcggcgttagcctctgcccttggcgaatattttgagcgtctttctactaattatttctttgccgatttctatttaggacaagaaattgcaaacggcgatttcgtacattatcccaatgaaaaatggttcccaattgaagacgatgctttactgcctaatggcattttagatgattatttattggattattttgatcccaatgccgagcttacgcctgaattattaatagatttacagtctggcaattatgatcgtgggatcgtggcgatgccttatgttcgtcaatcggacgaacaaaccgttaggggtctcnnnnnt

SEQ ID NO: 1832 - protein, 198 aa, Haemophilus influenzae
  Xaa 197, 198: Xaa is any amino acid
  Name: NTH1009
LPKKSCPAIKTPLLFTALFSYLGTKMTEQTFILGKDAALEDSIAKFQQKLTALGFNIEEASWLNPVPNVWSVHIRDKDCPQCFSNGKGASKKAALASALGEYFERLSTNYFFADFYLGQEIANGDFVHYPNEKWFPIEDDALLPNGILDDYLLDYFDPNAELTPELLIDLQSGNYDRGIVAMPYVRQSDEQTVRGLXX

SEQ ID NO: 1833 - DNA, 474 bp, Haemophilus influenzae
  Name: NTH1010
atgaaatttgaagtaatttataaatttttcttagtgtggggactagccttaagtttgcttttcgttgttgcaagtggcatttcaatgtggctaggatttccttttagtcaagccttagacattcatcttttctttgctggatttaccgtatttggtttgttactgcatttttatagccgtaagaagaaatgggtaaaaatcaacactcaatttgccgatctcatcacaaataatcgcatgccttcttactgcaatttagatcgcttgatgatgactttcgaacatttctctattcaacaaatcgccgagcaacttaatctttctctcccgattttattaaatgaattatcgcaagctcaaataaacataactgattcccaccgcactttatgcgaaaactttcctctcaacgatgaaaaaattttcgccgcaattacaattgccttaaaagtgcggttcaatccaactttactt

SEQ ID NO: 1834 - protein, 158 aa, Haemophilus influenzae
  Name: NTH1010
MKFEVIYKFFLVWGLALSLLFVVASGISMWLGFPFSQALDIHLFFAGFTVFGLLLHFYSRKKKWVKINTQFADLITNNRMPSYCNLDRLMMTFEHFSIQQIAEQLNLSLPILLNELSQAQINITDSHRTLCENFPLNDEKIFAAITIALKVRFNPTLL

SEQ ID NO: 1835 - DNA, 804 bp, Haemophilus influenzae
  Name: NTH1011
atgactatttacgacatcaattttgctgaactgtatcaacaacacttaatcgcttgtcatcattacaacttacctccgacaaaatgggataaaaaagccgtgaaaatggcagaaaatttggtcggtaagccttcagcatataatcagcaattattgcaagcaatgaatgtgcaaaccgatgaaacagtgttggatattggctgtgggcctggtacttttgctgtaccgctcgcacaacaaggttcaacggtatatgccttagattatagtaatggaatgttagattgcttggcgcagttcaaacagaaattggggttgcataatctcacaacatttcataaatcttggacggataattgggatgatgtgccacaagctgatgtagtgttggcatctcattcaacgttggtggacgatttggacgatatgatcgaaaaactctgtgccaaagcgaaaaaacgtgtgtttttgacttctgtcacacaacgccatttcttagatgagggcgtatttgaggcaattggccgtgaagatattggtttccccacttatatttatttactcaatcggttgtatcaaaaaggcattcaggcaaatttgaattttattgaaacggaatcgggttgttttcaaggtgaaatctacgaggatttattagcctcggtggaattttctttaggcgaactgtccgaaaaagaaaaacaaggtttgaaagccttttacgatcgtaaacaagccaataacgaactaatttttcatggacagaaaaaatgggcgttgatttggtggaatgtggatcgcatc

SEQ ID NO: 1836 - protein, 268 aa, Haemophilus influenzae
  Name: NTH1011
MTIYDINFAELYQQHLIACHHYNLPPTKWDKKAVKMAENLVGKPSAYNQQLLQAMNVQTDETVLDIGCGPGTFAVPLAQQGSTVYALDYSNGMLDCLAQFKQKLGLHNLTTFHKSWTDNWDDVPQADVVLASHSTLVDDLDDMIEKLCAKAKKRVFLTSVTQRHFLDEGVFEAIGREDIGFPTYIYLLNRLYQKGIQANLNFIETESGCFQGEIYEDLLASVEFSLGELSEKEKQGLKAFYDRKQANNELIFHGQKKWALIWWNVDRI

SEQ ID NO: 1837 - DNA, 699 bp, Haemophilus influenzae
  Name: NTH1012
atgttatttgctttacctgcgctgaatgataactacatttggctttatcaacgagaaaatctgccgcttattattgtcgatttgcctgaaacggacaagctgtttgcatggctagataagcaaaacgcaacgattgaagcggtgttgcttactcacgaacatgaggatcatacacaaggtgtgtcggcatttaaaaaacgttatccaacagtgccgatttatgggccgcaagaatgtgagaaaaaaggtgcgactcaagttgtgaacgaagggaagatccttaccgcacattatcaaattgatgtcattccgacggggggacacactaaacagcacgttagttttttagtggataatcatttattttgcggtgatgcgttattttctgcaggttgcggacgtgtttttacaggcaattatgcgcagatgtttgatggtttgcagcgtttgaatacattgcctgacgagacgattgtttgcccagctcatgaatataccttggggaatttagcatttgcggaaactgtgctggtggaaaaaagtgcggtagaaaaacaacgtatttttgttgaaacacaacgggctgaaaataaaccaagtttgccgacaaccttaaaacttgagcgagaaattaatccgtttttacaagcaaaaacacttgaagaatttaccgcacttcgcaaagctaaagatattttc

SEQ ID NO: 1838 - protein, 233 aa, Haemophilus influenzae
  Name: NTH1012
MLFALPALNDNYIWLYQRENLPLIIVDLPETDKLFAWLDKQNATIEAVLLTHEHEDHTQGVSAFKKRYPTVPIYGPQECEKKGATQVVNEGKILTAHYQIDVIPTGGHTKQHVSFLVDNHLFCGDALFSAGCGRVFTGNYAQMFDGLQRLNTLPDETIVCPAHEYTLGNLAFAETVLVEKSAVEKQRIFVETQRAENKPSLPTTLKLEREINPFLQAKTLEEFTALRKAKDIF

SEQ ID NO: 1839 - DNA, 546 bp, Haemophilus influenzae
  Name: NTH1014
atgactgccattcacggcgatgtggtggatgcagcaaaaattatctcgccttgtaaagtattagatttaggttgcggacaagggcgtaattcactttatttaagtttattaggctatgatgtaacctcttgggatcacaatgaaaacagcattgcctttttaaatgaaaccaaagagaaagaaaaccttaatatttctaccgcactttacgacattaacgccgccaacattcaagaaaactatgattttattgtttcaacggtggtgtttatgttcttaaatcgtgaacgtgtgccgtcaatcatcacaaatatgcaagaacataccaatgttggcggatataatttaatcgttgccgcaatgtccacagatgatgtgccttgcccacttccattctcattcacttttgctgaaaacgaattgaaagaatattacaaagattgggaattcttagaatataacgaaaatatgggcgaattacacaaaaccgatgaaaacggcaatcgcattaaaatgaaatttgccaccatgttagcgagaaagaaa

SEQ ID NO: 1840 - protein, 182 aa, Haemophilus influenzae
  Name: NTH1014
MTAIHGDVVDAAKIISPCKVLDLGCGQGRNSLYLSLLGYDVTSWDHNENSIAFLNETKEKENLNISTALYDINAANIQENYDFIVSTVVFMFLNRERVPSIITNMQEHTNVGGYNLIVAAMSTDDVPCPLPFSFTFAENELKEYYKDWEFLEYNENMGELHKTDENGNRIKMKFATMLARKK

SEQ ID NO: 1841 - DNA, 1623 bp, Haemophilus influenzae
  Name: NTH1015
atgcaacacaaactactcttctctgcaatcgctcttgctctttcctattctgtgcaagcagttatagtgcctgaaggaacacaattagatgaaaaacaacatatcgtcatcaataacggggctgaaccgcaaagttttgacccacacaaaaccgaaggtgtgccagaatctaacgttgcttatcaattacttgaaggcttagtcacctcagactctgaaggtaaacttcaaccgggtgcggctgaaagctgggaaaatacacctgacttcaaaacctggacattccatttacgtaaagatgctaaatggtcaaacggagatcctgttactgcacacgatttcgtgtttgcgtggcgtcgtttagtggatcctgcaactgctgcaccttatgcgagttacttaagttatttacaagttgaaaatgcgcaagacattattgacggtaagaaaaaaccggctgaattaggcgtggaagcaaaagatgattacacctttgtggttcatgcaaccaatcctgtgccttatgcagtcagtttaacgactcaccaatccttattgccattaccacaaaaagtagtcgaaaaattgggtgatgcatgggtgaaaaaagaaaactacgtgggtaacggtgcgtataagctggctaaccacatcattaacgaaaaaatcgaatttgaacgtaacccactttattggaacgataaagaaaccgtaatcaatagtgcgacattcctcgccattgaaaacccaagtaccgatgtagcacgttatcgtgcgggcgatttagacatgaccagttatggtttaccgccagaacaattcgctaaattaaaaaaagaattgctaggcgaagtatacgttactcgtaccctaggaacttattcttatgaattaaacaataagaaagcaccttttgataacgtgaatattcgtaaagccttgaacttatcccttgatcgtaatgtgatcaccgataaagtattgggccaaggtcaaacaccaacctatgtgtttaccccaacttacatcgaagaaggtcatctcattcaacaacctgcttattcaaaagaaccgatggcacaacgtaatgaagaagccattaaactcttagaagaagctggttacagtaaagcgaatccgttgaaattcagcattctttataataccaatgaaaaccacaaaaaagtggctattgctgcagcttctatgtggaaagctaacaccaaaggtttgattgatgtgaaattagaaaaccaagagtggaaaacttacattgatagccgtcgtgcaggtcgttacgatgtggcgcgtgctggatggcatgcggattacaaccaagcaacaacattcggcaactatttcttatctaattctagtaacaataccgcgaaatatgcgaatccagaatatgataaagcgatggcagaatcttacgcagcaactgatgcagaaggtcgtgcaaaagcttatgcgaaagccgaagaaattcttggaaaagattacggtatcgtaccaatctttaactatgtgaatccacgcttagtgaaaccttacgtaaaaggttattcaggcaaagatccacaagatcatatttacttacgcaatctttatattattaaacat

SEQ ID NO: 1842 - protein, 541 aa, Haemophilus influenzae
  Name: NTH1015
MQHKLLFSAIALALSYSVQAVIVPEGTQLDEKQHIVINNGAEPQSFDPHKTEGVPESNVAYQLLEGLVTSDSEGKLQPGAAESWENTPDFKTWTFHLRKDAKWSNGDPVTAHDFVFAWRRLVDPATAAPYASYLSYLQVENAQDIIDGKKKPAELGVEAKDDYTFVVHATNPVPYAVSLTTHQSLLPLPQKVVEKLGDAWVKKENYVGNGAYKLANHIINEKIEFERNPLYWNDKETVINSATFLAIENPSTDVARYRAGDLDMTSYGLPPEQFAKLKKELLGEVYVTRTLGTYSYELNNKKAPFDNVNIRKALNLSLDRNVITDKVLGQGQTPTYVFTPTYIEEGHLIQQPAYSKEPMAQRNEEAIKLLEEAGYSKANPLKFSILYNTNENHKKVAIAAASMWKANTKGLIDVKLENQEWKTYIDSRRAGRYDVARAGWHADYNQATTFGNYFLSNSSNNTAKYANPEYDKAMAESYAATDAEGRAKAYAKAEEILGKDYGIVPIFNYVNPRLVKPYVKGYSGKDPQDHIYLRNLYIIKH

SEQ ID NO: 1843 - DNA, 117 bp, Haemophilus influenzae
  Name: NTH1016
gtgcggttaaaaatcgtcgtattttttgaccgcacttttcgcccattttggttggagttgttatgctcaagtttatttttaaacggctgttggaagccttaccgacgctgtttattt

SEQ ID NO: 1844 - protein, 39 aa, Haemophilus influenzae
  Name: NTH1016
VRLKIVVFFDRTFRPFWLELLCSSLFLNGCWKPYRRCLF

SEQ ID NO: 1845 - DNA, 96 bp, Haemophilus influenzae
  Name: NTH1017
ttgagcataacaactccaaccaaaatgggcgaaaagtgcggtcaaaaaatacgacgatttttaaccgcacttaaatacgagcaacgaattaatgtt

SEQ ID NO: 1846 - protein, 32 aa, Haemophilus influenzae
  Name: NTH1017
LSITTPTKMGEKCGQKIRRFLTALKYEQRINV

SEQ ID NO: 1847 - DNA, 135 bp, Haemophilus influenzae
  Name: NTH1018
ttggaagccttaccgacgctgtttattttgattactttttctttctttttgatgcgtcttgcccctggcagccccttcacttctgaacgcgcttatccgccagaagtcatggctaatatcgaagcgaagttcttt

SEQ ID NO: 1848 - protein, 45 aa, Haemophilus influenzae
  Name: NTH1018
LEALPTLFILITFSFFLMRLAPGSPFTSERAYPPEVMANIEAKFF

SEQ ID NO: 1849 - DNA, 768 bp, Haemophilus influenzae
  Name: NTH1019
atggccgcaaaaatcatctctggtactgaactttcaaaacaaattaaagctaatttagcagataaaataacccattatattgaacaaggaaaacgcgctccaggacttgctgtaatcctcgttggtgctgatcctgcttcgcaaatttatgtgggcaataaacgtaaaagttgcgaggaagtcggtattctctctaaatcttatgacctccctgaaacaaccacgcaaaatgaattattagcgattattgaccaacttaacgcagataaaaatattgacggtattttggtgcaactccccttgccaaaacaaattaatgcggaagctattattgaacgtatcgatcctaaaaaagatgtagatggctttcatccttataatgttgggcggttatgccaacgtattccaactttacgtgcttgtacaccttatggtgtgatgaaactattagaaacaacgggtattgatttacacggcaagcacgcagtaattgtaggcgcatccaatattgttggccgcccaatgtctttagaattattattagcaggggcaaccgtcacagtaacacatagattcactaaaaatttggaaaatcacgttcgccaagcagatatacttgtcgttgcggtaggtaaaccaaatttaatttctggcgattggatcaaagaaagtgcggtcgtaattgatgttggaattaaccgagtagatggaaaattagtaggcgatgtagagtttgataaagcagccgaaaaagcggggtaccgaggc

SEQ ID NO: 1850 - protein, 256 aa, Haemophilus influenzae
  Name: NTH1019
MAAKIISGTELSKQIKANLADKITHYIEQGKRAPGLAVILVGADPASQIYVGNKRKSCEEVGILSKSYDLPETTTQNELLAIIDQLNADKNIDGILVQLPLPKQINAEAIIERIDPKKDVDGFHPYNVGRLCQRIPTLRACTPYGVMKLLETTGIDLHGKHAVIVGASNIVGRPMSLELLLAGATVTVTHRFTKNLENHVRQADILVVAVGKPNLISGDWIKESAVVIDVGINRVDGKLVGDVEFDKAAEKAGYRG

SEQ ID NO: 1851 - DNA, 114 bp, Haemophilus influenzae
  Name: NTH1020
atggcttcagagcttggaaaatacttaaatagccaaaatattgtttttatctgcatcattaagagtgtatttaagcttcttcactcaaatgatgcagattatgagcatgaaatc

SEQ ID NO: 1852 - protein, 38 aa, Haemophilus influenzae
  Name: NTH1020
MASELGKYLNSQNIVFICIIKSVFKLLHSNDADYEHEI

SEQ ID NO: 1853 - DNA, 1284 bp, Haemophilus influenzae
  Name: NTH1021
atgaacgccaaagttttagaaaagaaattcatcgtcccctttgtgcttattactagcttatttgctctttggggatttgccaacgacattaccaatccgatggttgcggtatttcaaacagtaatggaaattccagcctcagaagcggcattggtacaattagctttttatggaggatacggcacaatggctattcctgcggcattatttgccagtcgctatagctacaaagcggggattcttctggggcttgctctttatgcaataggtgcatttttattttggccagctgcgcaatatgaaatatttaatttctttttagtctccctttatattttaacctttgggctcgcttttttggaaaccactgccaatccttatattctcgcaatgggagatcctcaaacagctactcgacgtttaaatttcgcacaatcatttaatccacttggttcaattacaggtatgtttgttgcttcccagttagtcctaactaatcttgaatctgacaaacgtgatgctgcaggtaatttgattttccacaccctgtctgaagcagaaaaaatgagtattcgcacccatgatttagctgaaattcgcgatccttacatagcactcggttttgtcgtggttgcagtgtttattatcattggattgaaaaaaatgcctgctgtaaaagtagaagaaagtggacaaattagctttaaaagtgcaataagcaaactggctaaaaaagctaaatatcgtgagggtgtgatcgcacaagccttttacgtgggtgttcaaattatgtgttggacatttatcgtacaatatgctgaacgtttaggcttcactaaagctgaggggcaaaactttaacatcattgctatggctatttttattagcagtcgctttattagcacggcattaatgaaatatttaaaagcagaatttatgctgatgctctttgctattggtggttttttaagtattctcggagttatctttattgacggtgtatggggtctatactgcctaattttaacctcaggttttatgtctttaatgttccctaccatttatggtattgccctctatggcttaaaagaggaatcgacattaggagctgcaggtttagtaatggctattgtaggcggcgcattaatgccaccactacaaggaatgattattgaccaaggcgaagttatgggacttccagcagtaaatttctcctttatcctaccattaatctgttttgtagtaattgccatttatggcttcagagcttggaaaatacttaaa

SEQ ID NO: 1854 - protein, 428 aa, Haemophilus influenzae
  Name: NTH1021
MNAKVLEKKFIVPFVLITSLFALWGFANDITNPMVAVFQTVMEIPASEAALVQLAFYGGYGTMAIPAALFASRYSYKAGILLGLALYAIGAFLFWPAAQYEIFNFFLVSLYILTFGLAFLETTANPYILAMGDPQTATRRLNFAQSFNPLGSITGMFVASQLVLTNLESDKRDAAGNLIFHTLSEAEKMSIRTHDLAEIRDPYIALGFVVVAVFIIIGLKKMPAVKVEESGQISFKSAISKLAKKAKYREGVIAQAFYVGVQIMCWTFIVQYAERLGFTKAEGQNFNIIAMAIFISSRFISTALMKYLKAEFMLMLFAIGGFLSILGVIFIDGVWGLYCLILTSGFMSLMFPTIYGIALYGLKEESTLGAAGLVMAIVGGALMPPLQGMIIDQGEVMGLPAVNFSFILPLICFVVIAIYGFRAWKILK

SEQ ID NO: 1855 - DNA, 648 bp, Haemophilus influenzae
  Name: NTH1022
atgaacagagcagaattatcacaaaaaatcattgatacttgtcttgaaatgacaaaattaggtttaaatcaaggcacagcgggaaacgttagtgttcgttataaagatggaatgctgattaccccgacaggtatgccatatcacttaatgaagacagaaaatattgtttatgttgatggaaatggcaaacacgaagaaaataaattaccatcaagcgaatggcaatttcacttgagtgtttatcatactcgccctgaagcaaatgccgttgtccacaatcattccattcactgtgcaggcttatccattctcgaaaaacctattcctgcaattcattacatggtagccgtaagcggcacagatcatattccttgtgtaccttatgcaacatttggtagtcacgaattagctagttatgtcgcaacgggaatcaaagaaagcaaagccattttactagcacaccatggtttaatcacttgcggagaaaacctagataaagccttatggctcgcacaagaagtagaagtattagcgtcttggtatttgaaattactctctacaggcttagaaattccactgctcagcaaagagcaaatgcaggtagtgttaggtaaattccacacctatggattacgtattgaagaatcc

SEQ ID NO: 1856 - protein, 216 aa, Haemophilus influenzae
  Name: NTH1022
MNRAELSQKIIDTCLEMTKLGLNQGTAGNVSVRYKDGMLITPTGMPYHLMKTENIVYVDGNGKHEENKLPSSEWQFHLSVYHTRPEANAVVHNHSIHCAGLSILEKPIPAIHYMVAVSGTDHIPCVPYATFGSHELASYVATGIKESKAILLAHHGLITCGENLDKALWLAQEVEVLASWYLKLLSTGLEIPLLSKEQMQVVLGKFHTYGLRIEES

SEQ ID NO: 1857 - DNA, 432 bp, Haemophilus influenzae
  Name: NTH1023
atgctaaaaggtattcacccagctctttctcctgaattactaaaaaccctcgccgaaatggggcatggcgatgagatagttctagctgacgcccattttcccgcacattcactacataaaaatgtaatacgtgcagatggtatatctatagatattttacttgaagcaataactcccttattcgaatttgacgcttatgttgatgcccctctgttgatgatgaaagcagttgagggagattctttagatccgaatgttgaaactcgttacttaaatgcgattgaaagtgcggtcggtttcacaccaaatttaaccagtctagaacgcttcgatttttatacacgtgctaaacaggcttatgctgttgttgtcagtggtgagatcgcaaaatatggcaacattatcattaaaaaaggggttactcccatttta

SEQ ID NO: 1858 - protein, 144 aa, Haemophilus influenzae
  Name: NTH1023
MLKGIHPALSPELLKTLAEMGHGDEIVLADAHFPAHSLHKNVIRADGISIDILLEAITPLFEFDAYVDAPLLMMKAVEGDSLDPNVETRYLNAIESAVGFTPNLTSLERFDFYTRAKQAYAVVVSGEIAKYGNIIIKKGVTPIL

SEQ ID NO: 1859 - DNA, 90 bp, Haemophilus influenzae
  Name: NTH1024
atgtttacctttgcaggcgtaggcatttacgaaaatgtaaacgcggcacagcaagcgatgcaaccaacaagaaaacgaatttacccaaac

SEQ ID NO: 1860 - protein, 30 aa, Haemophilus influenzae
  Name: NTH1024
MFTFAGVGIYENVNAAQQAMQPTRKRIYPN

SEQ ID NO: 1861 - DNA, 366 bp, Haemophilus influenzae
  n 361, 362, 363, 364, 365: n is any nucleotide
  Name: NTH1025
atgagttgtccgatattcgatttaaggtacatttttatgcgactttttggttacgctcgggtctcaaccagtcagcagtctcttgatcttcaggtcagagcactcaaagacgcaggtgtgaaagcaaaccgtatatttaccgataaggcatccggcagttcaacagaccgggaagggctggatttgctgaggatgaaggtggaggaaggtgatgtcattctggttaagaagctcgaccgtcttggccgcgacactgccgatatgatccaactgataaaggaatttgacgctcagggcgtggcagtccggttcattgatgacgggatcagtaccgacggtgatatggggcaaatggtggtcnnnnnt

SEQ ID NO: 1862 - protein, 122 aa, Haemophilus influenzae
  Xaa 121, 122: Xaa is any amino acid
  Name: NTH1025
MSCPIFDLRYIFMRLFGYARVSTSQQSLDLQVRALKDAGVKANRIFTDKASGSSTDREGLDLLRMKVEEGDVILVKKLDRLGRDTADMIQLIKEFDAQGVAVRFIDDGISTDGDMGQMVVXX

SEQ ID NO: 1863 - DNA, 888 bp, Haemophilus influenzae
  Name: NTH1026
atgtaccttaaatcgaatatcggacaactcatgtctattattacaaatttacgatttaatagacatattaatgtaacagttttacgatgtccgataatttataacatttcgtacggttggaaaaatgttactaaatgcccgtcaggcagggaggccgatatgcccgttgactttctgaccactgagcagactgaaagctatggcagattcaccggtgaaccggatgagcttcagctggcacgatattttcaccttgatgaagcagacaaggaatttatcggaaaaagcagaggtgatcacaaccgtctgggcattgccctgcaaattggatgtgtccgttttctgggcaccttcctcaccgatatgaatcatattccttccggcgtccggcattttaccgccagacagctcgggattcgtgatatcaccgttcttgcagaatacggtcagagggaaaatacccgccgtgagcatgcagcgctgatacgtcagcactatcagtatcgtgaatttgcctggccctggacatttcgccttacccgtcttttatatacccggagctggataagcaacgaacgtcctggcctgcttttcgatctggcgacagggtggcttatgcaacatcgtattattctccccggagccactacgctgacccggttgatttcagaggtaagggaaaaggcgacgttgcgcctgtggaacaaactggcactgataccgtcagccgaacagcgttcacagctggagatgctgctggggccaactgattgcagccgcctgtctttactggaatcactgaaaaagggccctgtgaccatcagtggtccggcgtttaatgaagcaattgaacgctggaaaactctgaacgattttggccctgcatgc

SEQ ID NO: 1864 - protein, 296 aa, Haemophilus influenzae
  Name: NTH1026
MYLKSNIGQLMSIITNLRFNRHINVTVLRCPIIYNISYGWKNVTKCPSGREADMPVDFLTTEQTESYGRFTGEPDELQLARYFHLDEADKEFIGKSRGDHNRLGIALQIGCVRFLGTFLTDMNHIPSGVRHFTARQLGIRDITVLAEYGQRENTRREHAALIRQHYQYREFAWPWTFRLTRLLYTRSWISNERPGLLFDLATGWLMQHRIILPGATTLTRLISEVREKATLRLWNKLALIPSAEQRSQLEMLLGPTDCSRLSLLESLKKGPVTISGPAFNEAIERWKTLNDFGPAC

SEQ ID NO: 1865 - DNA, 114 bp, Haemophilus influenzae
  Name: NTH1027
gtgtttcttctttcagcaggtacgaacatgcgctggcgagcgccaatgcagatttatccagatccttcagcgagcggagccgttttttctgcccaatctttctggcgtcacgga

SEQ ID NO: 1866 - protein, 38 aa, Haemophilus influenzae
  Name: NTH1027
VFLLSAGTNMRWRAPMQIYPDPSASGAVFSAQSFWRHG

SEQ ID NO: 1867 - DNA, 528 bp, Haemophilus influenzae
  Name: NTH1028
atgtcaccgcagaaaaggatggcggttctggttgcctttgtccttgcatgggaaacgctggcgctggatgatgcattggacgttctggacgccatgctggccgttatcatccgtgacgccagaaagattgggcagaaaaaacggctccgctcgctgaaggatctggataaatctgcattggcgctcgccagcgcatgttcgtacctgctgaaagaagaaacaccggacgaatcgattcgtgctgaggtgttcagctacatcccaaggcaaaagctggctgaaatcatcacgcttgtccgtgaaattgcccggccctcagacgataattttcatgaagaaatggtggagcagtacgggcgcgttcgtcgtttcctgccccatctgctgaataccgttaaattttcatccgcacctgccggggttaccactctgaatgcctgtgactacctcagccgggagttcagctcacggcggcagtttttgacgacgcaccaacggaaattatcagtcggtcatggaaacggctgg

SEQ ID NO: 1868 - protein, 176 aa, Haemophilus influenzae
  Name: NTH1028
MSPQKRMAVLVAFVLAWETLALDDALDVLDAMLAVIIRDARKIGQKKRLRSLKDLDKSALALASACSYLLKEETPDESIRAEVFSYIPRQKLAEIITLVREIARPSDDNFHEEMVEQYGRVRRFLPHLLNTVKFSSAPAGVTTLNACDYLSREFSSRRQFLTTHQRKLSVGHGNGW

SEQ ID NO: 1869 - DNA, 1017 bp, Haemophilus influenzae
  n 1007: n is any nucleotide
  Name: NTH1029
gtgattaacaaggaaaaacatatcacccgcaggggatacacgctctgctttctcagtaaactgcaggatagtctgaggcggagggatgtctacgttaccggcagtaaccggtggggagatcctcgtgcaagattactacagggtgctgactggcaggcaaaccggattaaggtttatcgttctttggggcacccgacagacccgcaggaagcaataaaatctctgggtcatcagcttgatagtcgttacagacaggttgctgcacgtctttgcgaaaatgaggctgtcgaactcgatgtttctggcccgaagccccggttgacaatttctcccctcgccagtcttgatgagccggacagtctgaaacgactgagcaaaatgatcagtgatctactccctccggtggatttaacggagttgctgctcgaaattaacgcccataccggatttgctgatgagtttttccatgctagtgaagccagtgccagagttgatgatctgcccgtcagcatcagcgccgtgctgatggctgaagcctgcaatatcggtctggaaccactgatcagatcaaatgttcctgcactgacccgacaccggctgaactggacaaaagcgaactatctgcgggctgaaactatcaccagcgctaatgccagactggttgattttcaggcaacgctgccactggcacagatatggggtggaggagaagtggcatctgcagatggaatgcgctttgttacgccagtcagaacaatcaatgccggaccgaaccgcaaatactttggtaataacagagggatcacctggtacaactttgtgtccgatcagtattccggctttcatggcatcgttataccggggacgctgagggactctatctttgtgctggaaggtcttctggaacaggagaccgggctgaatccaaccgaaattatgaccgatacagcaggtgccagcgaacttgtctttggccttttctggctgctgggataccagttttctcncacgcctggc

SEQ ID NO: 1870 - protein, 339 aa, Haemophilus influenzae
  Xaa 336: Xaa is any amino acid
  Name: NTH1029
VINKEKHITRRGYTLCFLSKLQDSLRRRDVYVTGSNRWGDPRARLLQGADWQANRIKVYRSLGHPTDPQEAIKSLGHQLDSRYRQVAARLCENEAVELDVSGPKPRLTISPLASLDEPDSLKRLSKMISDLLPPVDLTELLLEINAHTGFADEFFHASEASARVDDLPVSISAVLMAEACNIGLEPLIRSNVPALTRHRLNWTKANYLRAETITSANARLVDFQATLPLAQIWGGGEVASADGMRFVTPVRTINAGPNRKYFGNNRGITWYNFVSDQYSGFHGIVIPGTLRDSIFVLEGLLEQETGLNPTEIMTDTAGASELVFGLFWLLGYQFSXTPG

SEQ ID NO: 1871 - DNA, 1476 bp, Haemophilus influenzae
  Name: NTH1030
gtgaacgaccaagaatctgctgaagaatgtattaaagaaaaccgcattttgcgcaaaattgcgcgtcattgcgtagatgaaacggaaggcttatttatcactttgcctgaagattcgctcgactatcaaaaaaccttccttgagagctgtgcaaaatctggaattgatgcacaagctattgatcctgatttagctaaaattatggagccttctgtaaaccctgatttagtgggcgctgttgttgtgccagatggttctattgacccattccgtttaaccgcctctaatatgatggacgccacagaaaacggcgcaaaaatgttcacttattgcgaagtaaaaaatttgattcgtgaaggtggaaaagtgattggcgtgaatgtgtacgatcacaaaaatcgcagagaacgccaattttttgcaccgcttgttgtaaatgctggtggtatttggggacaagggattgcggaatatgccgatctcaaaattaaaatgttccctgcaaaaggcgcattactcgtaatgggtcatcgcattaataaacttgtaattaaccgctgccgtaaacctgctgatgcggatattctcgtccctggcgatacaatttgtgtgatcggaacaacatctagccgcattccttatgatcaaattgataatatggaagtaacaccagaggaagtggatattcttttccgtgaaggtgaaaaactcgcacctagcttgcgtcatactcgcgtattacgtgcttatgctggggtgcgaccattagttgcaagcgatgatgatccatcaggtcgaaatgtgagtcgtggtatcgtgctacttgaccacgcagaacgtgatggcttagatggctttattactatcactggcggtaagttaatgacttatcgtttaatggctgaatgggcgactgaccttgtttgtaaaaaactcaataaaacggcacgttgtgtgactgcagagcaacctttgccaggctctactgaaagtcgtcaagagaccaatcaaaaagtcatttcattaccaagtactattcgttattctgccgtatatcgtcacggttcacgggctactcgtttgcttgaaaaagaacgtttagatcgttcaatggtttgcgaatgtgaagcggtaacagcgggggaagttcgttacgctattgatgaactggatgtaaataatctcgtcgatttacgtcgtcgctcccgagttggaatgggaacttgtcaagctgaactctgtgcgtgtcgtgccgcaggactaatgaatcgttttgaagtggcaacaccacgtcaatcaactactcaactttccgcctttatggaagaacgctggcgtggtattgaaccgattgcttggggggaagctattcgcgaagccgaatttacctcttggatgtatggtagtgtattaggtttaaatgatgtgaaaccgcttgatgaacaagcacaacaagggacggatagcaatgaattt

SEQ ID NO: 1872 - protein, 492 aa, Haemophilus influenzae
  Name: NTH1030
VNDQESAEECIKENRILRKIARHCVDETEGLFITLPEDSLDYQKTFLESCAKSGIDAQAIDPDLAKIMEPSVNPDLVGAVVVPDGSIDPFRLTASNMMDATENGAKMFTYCEVKNLIREGGKVIGVNVYDHKNRRERQFFAPLVVNAGGIWGQGIAEYADLKIKMFPAKGALLVMGHRINKLVINRCRKPADADILVPGDTICVIGTTSSRIPYDQIDNMEVTPEEVDILFREGEKLAPSLRHTRVLRAYAGVRPLVASDDDPSGRNVSRGIVLLDHAERDGLDGFITITGGKLMTYRLMAEWATDLVCKKLNKTARCVTAEQPLPGSTESRQETNQKVISLPSTIRYSAVYRHGSRATRLLEKERLDRSMVCECEAVTAGEVRYAIDELDVNNLVDLRRRSRVGMGTCQAELCACRAAGLMNRFEVATPRQSTTQLSAFMEERWRGIEPIAWGEAIREAEFTSWMYGSVLGLNDVKPLDEQAQQGTDSNEF

SEQ ID NO: 1873 - DNA, 960 bp, Haemophilus influenzae
  Name: NTH1031
ttgatgaacaagcacaacaagggacggatagcaatgaattttgatgtagccattattggcggtggtttggcgggtttaacctgtggcatcgcccttcaacaatgcggcaaacgttgcgtgattatcaacaacggtcaagcggccattgattttgcatctggctctttagatttattaagccgtatgccatcaacgacatatggggaaaatcgcgcagtagaaaatttaaaagaaaatattaccgcacttcgcaatgaattacctgcccacccttatagtttattgggtgcagagaaagtgcttgctaaagcacaagattttgaacgtttagccaatgaattaaatcttgatttaattggttctacggaaaaaaatcactggcgtgtaacaggcttaggcagtttacgcggtgcgtggctttcgccaaatagcgtgccaactgtgcaaggtaatgaaccttttccgcataaacgtattgcagtgcttggtattgaaggttatcacgattttcaacctcaacttttagcggcaaatttagtgttaaacccacaatttgaacattgtgaagtaacgagtggtttcttaaatattccacaattagatgaacttcgcaaaaatgctcgtgagttccgtagtgtaaatatctctcaacttctagagcacaaacttgcgttcaatgatcttgttaaagaaatcattgaatcagcacaaggtgcagaagcggtctttttacctgcttgctttggtttagaaaaccaagaatttatgaccgcacttcgtgatgcaactaaacttgcattatttgaattaccaacactgccaccatcattacttggtatgcgccaacgtattcaattacgtcataaatttgaatcccttggtggtttaatgattaatggcgacagtgcattgaatgcaacatttgaaggaataaagtacgttgtatcaacactcgtttgc

SEQ ID NO: 1874 - protein, 320 aa, Haemophilus influenzae
  Name: NTH1031
LMNKHNKGRIAMNFDVAIIGGGLAGLTCGIALQQCGKRCVIINNGQAAIDFASGSLDLLSRMPSTTYGENRAVENLKENITALRNELPAHPYSLLGAEKVLAKAQDFERLANELNLDLIGSTEKNHWRVTGLGSLRGAWLSPNSVPTVQGNEPFPHKRIAVLGIEGYHDFQPQLLAANLVLNPQFEHCEVTSGFLNIPQLDELRKNAREFRSVNISQLLEHKLAFNDLVKEIIESAQGAEAVFLPACFGLENQEFMTALRDATKLALFELPTLPPSLLGMRQRIQLRHKFESLGGLMINGDSALNATFEGIKYVVSTLVC

SEQ ID NO: 1875 - DNA, 726 bp, Haemophilus influenzae
  n 721, 722, 723, 724, 725: n is any nucleotide
  Name: NTH1032
atgctagaaatgttaaaaagctggtactctcgccgtttaagtgatcctcaagcgatgggactattagcaatattattatttggctttatctccatttatttttttggagatttaattgcgcctttgttgattgctctagtactatcctatttacttgaaatgccaatcaattttttaaatcaatatttaaaatgcccaagaatgttagcgacaattcttattttcggtagttttattggtctagcagcagttttctttttggtattggtgccaatgttgtggaatcaaactatttccttattaagtgatttgcccgctatgtttaataaatctaatgaatggctactcaatttacccaaaaattatcctgaacttattgattattcaatggttgattctattttcaattctgtgcgagaaaaaatccttggttttggcgaatctgctgtaaaactttctttagcctctattatgaacttggtttctttagggatttatgcctttttagtgccattaatgatgttttttatgttgaaagataaatcagaacttttacaaggggtaagtcgattcttaccaaaaaatagaaatctcgcatttaaagtatggaaagaaatgcaacagcaaatttctaattacattcacggaaaattattagaaatactgattgtcactttaatcacttatattatttttcttaattttacgggactaaattatnnnnnt

SEQ ID NO: 1876 - protein, 242 aa, Haemophilus influenzae
  Xaa 241, 242: Xaa is any amino acid
  Name: NTH1032
MLEMLKSWYSRRLSDPQAMGLLAILLFGFISIYFFGDLIAPLLIALVLSYLLEMPINFLNQYLKCPRMLATILIFGSFIGLAAVFFLVLVPMLWNQTISLLSDLPAMFNKSNEWLLNLPKNYPELIDYSMVDSIFNSVREKILGFGESAVKLSLASIMNLVSLGIYAFLVPLMMFFMLKDKSELLQGVSRFLPKNRNLAFKVWKEMQQQISNYIHGKLLEILIVTLITYIIFLNFTGLNYXX

SEQ ID NO: 1877 - DNA, 348 bp, Haemophilus influenzae
  Name: NTH1033
atgtctgttattatttatcacaacccacattgctcaaaaagccgtgaaacgctagcattattagaaaataaaggtattcagccgattattgaactgtatttgcaaaagcagtattccgttaatgaattacaaagcattgccaaaaaattaggaattgatgatgttcgccaaatgatgcgcacgaaagatgaactatataaaagcttaaatttagataatttagatctttctcaagcagaattatttaaagcgatgagtgaacattcagcacttattgaacgcccaattgttattaatggcgataaagctaaaatcgggcgtccgccagaaactgtacttgagattttg

SEQ ID NO: 1878 - protein, 116 aa, Haemophilus influenzae
  Name: NTH1033
MSVIIYHNPHCSKSRETLALLENKGIQPIIELYLQKQYSVNELQSIAKKLGIDDVRQMMRTKDELYKSLNLDNLDLSQAELFKAMSEHSALIERPIVINGDKAKIGRPPETVLEIL

SEQ ID NO: 1879 - DNA, 207 bp, Haemophilus influenzae
  Name: NTH1035
atgagaaagaaacaaaaaagtgcggttgaaaatgaaaccgtttatttgcacactcgaggcgtgataaaagataatgcagtgatggcattgctaggcgataaattatttcgtcagcgtgttgagaaaaaacgtaaagggaaaggcagttaccaacgtaaggcgaaacacccagggaaaatatttgaaaagcccgattataaatttttt

SEQ ID NO: 1880 - protein, 69 aa, Haemophilus influenzae
  Name: NTH1035
MRKKQKSAVENETVYLHTRGVIKDNAVMALLGDKLFRQRVEKKRKGKGSYQRKAKHPGKIFEKPDYKFF

SEQ ID NO: 1881 - DNA, 252 bp, Haemophilus influenzae
  Name: NTH1036
gtgcgtattagtgatcccggagaggagggggccaaaagccatttctttgaaacgatttatttaactctaacagcttattttgaagaaaataacatacgctatgaatttgtgcgtaaagtggaggatcaaataaaaattcagcgttcttttacagagttaaatgaattgttcaaatttttaggggattattttgatcccgtctcgattggtctagtcggtgtgaaaattggaaacttagggataaaattagaa

SEQ ID NO: 1882 - protein, 84 aa, Haemophilus influenzae
  Name: NTH1036
VRISDPGEEGAKSHFFETIYLTLTAYFEENNIRYEFVRKVEDQIKIQRSFTELNELFKFLGDYFDPVSIGLVGVKIGNLGIKLE

SEQ ID NO: 1883 - DNA, 159 bp, Haemophilus influenzae
  Name: NTH1037
gtgcggttattttttctttattttgataagaaaaatagattacttagcaacaaatttcttgtacgacaaattgtaatgaatgtctcgaaaattgttgttgtttgcggtgttttaaacgtcttaaacgtagattacgtgataaagaactttgttgtaaat

SEQ ID NO: 1884 - protein, 53 aa, Haemophilus influenzae
  Name: NTH1037
VRLFFLYFDKKNRLLSNKFLVRQIVMNVSKIVVVCGVLNVLNVDYVIKNFVVN

SEQ ID NO: 1885 - DNA, 150 bp, Haemophilus influenzae
  Name: NTH1038
atgttaaaacgtaaaacttttcttaaaaagaaagctaatttacaacaaagttctttatcacgtaatctacgtttaagacgtttaaaacaccgcaaacaacaacaattttcgagacattcattacaatttgtcgtacaagaaatttgttgc

SEQ ID NO: 1886 - protein, 50 aa, Haemophilus influenzae
  Name: NTH1038
MLKRKTFLKKKANLQQSSLSRNLRLRRLKHRKQQQFSRHSLQFVVQEICC

SEQ ID NO: 1887 - DNA, 1398 bp, Haemophilus influenzae
  n 34, 70, 107, 121, 122, 173, 184, 206: n is any nucleotide
  Name: NTH1039
ttggggctaatgatatgtgttcccatgcaatttntacgtcatactgaagaaatccattatactgcaatcnaagctaggggatcactttatgtaggaacaataaatanccagatttcttatnntattaataaagatagcgaacgaggctttgaatatgaattagccacagcatntgctgatactntaggcgtagaactcgaaatganaattttcgataatcaagagcagttatttgatgaacttgataaacacaatattgatttagctgccgccccccttttataccatcctaaaaatgcagaacgtttccaaataggtcctgcatatcattctgcttcatggcaattagcttatcgaaaaaatgaaaatcgtcctaaaaatttaggtaacgtaaagaaagatatttatatctcaaataatttagcattagaagaaacgctaaaagaattacaaaaacaatatccacaattaacttggaaaagaaatcaagcacttactcaagaagaactattactacaactggctgaaggcaaaattccttacgttattgcaaattctattgatattgctgcaattcaacaaatcaaaccagaattagccattgcctttgatattactgatgaagcaaacgttcactggtatttacccaatagcccctaccgcgatctacaaacggctttactcaattttatgaataatgccgaagaaacgggacttttagataatttaaaagaaaaatatttaggacatatttcacaatttgattacgtggatacgcgctcttatatgaacgcaattgaaaataccctgccacaattctcaccgctctttgaaaaatacaaaggtgaattagattggcgactactcgcagcagtggcttatcaagaatctcattggaatcctgacgcaacatcgccaactggagtacgtggcataatgatgctcaccaaaaataccgcacaacatatgaaaatcagtgatagaacagatcctgaacaaagtattaaagctggttcagaatatttacactggttgattagtcagcttcctgaaagcattgaaaaggaagaaagaatttggtttgccttagttgcctataacataggactcggtcacttaattgatgcacgccgtttaactcaaaatcttggaggaaatccagataattggctcaatgtgaaaaaaaatctgcctttattagcagaaaaacgctattattcccaactgaaatacggctatgcaagaggctatgaagcctatcaatatgtagaaaatattcgccgctatatgaatagcatcgtaaattatcatcgagtccaagaaaatcaaacaacgaatgataatgccaacaacgaaagtgcggttaaaaatttagaagaaataaaagaaaataaggat

SEQ ID NO: 1888 - protein, 466 aa, Haemophilus influenzae
  Xaa 12, 24, 36, 41, 58, 62, 69: Xaa is any amino acid
  Name: NTH1039
LGLMICVPMQFXRHTEEIHYTAIXARGSLYVGTINXQISYXINKDSERGFEYELATAXADTXGVELEMXIFDNQEQLFDELDKHNIDLAAAPLLYHPKNAERFQIGPAYHSASWQLAYRKNENRPKNLGNVKKDIYISNNLALEETLKELQKQYPQLTWKRNQALTQEELLLQLAEGKIPYVIANSIDIAAIQQIKPELAIAFDITDEANVHWYLPNSPYRDLQTALLNFMNNAEETGLLDNLKEKYLGHISQFDYVDTRSYMNAIENTLPQFSPLFEKYKGELDWRLLAAVAYQESHWNPDATSPTGVRGIMMLTKNTAQHMKISDRTDPEQSIKAGSEYLHWLISQLPESIEKEERIWFALVAYNIGLGHLIDARRLTQNLGGNPDNWLNVKKNLPLLAEKRYYSQLKYGYARGYEAYQYVENIRRYMNSIVNYHRVQENQTTNDNANNESAVKNLEEIKENKD

SEQ ID NO: 1889 - DNA, 111 bp, Haemophilus influenzae
  Name: NTH1040
atgtgcccaaactttacttatggcataaaagcccctggaggtcaggggctaggggttgaaaaaatcgacgattattttaaaaggaaactaacaatcgggggggttgtggca

SEQ ID NO: 1890 - protein, 37 aa, Haemophilus influenzae
  Name: NTH1040
MCPNFTYGIKAPGGQGLGVEKIDDYFKRKLTIGGVVA

SEQ ID NO: 1891 - DNA, 210 bp, Haemophilus influenzae
  Name: NTH1041
ttggaaaaagtgcgtgatattttgaatttacgtgagcctgcgagccttgcaatttgtacgttacttgataagccttctcgtcgggaagtggaagtgcttgttgaatgggttggttttgaaattcctgatgaatttgttgtggggtatggtatcgattacgcgcaacgccatcgtaatttaggctatatcggtaaagttgttttagaagaa

SEQ ID NO: 1892 - protein, 70 aa, Haemophilus influenzae
  Name: NTH1041
LEKVRDILNLREPASLAICTLLDKPSRREVEVLVEWVGFEIPDEFVVGYGIDYAQRHRNLGYIGKVVLEE

SEQ ID NO: 1893 - DNA, 207 bp, Haemophilus influenzae
  Name: NTH1042
ttgattttattgaaaagtgcggttgaaattttaaatgaatttttagccgcacttttttatattatttcattgctattttctcgatcacttgctaaatctttttacagcaaatacagccattatattgataatcttgctggggcaattttcttatttttcggcggctatttagtttattcaggcgtgctagccactgcagccgcattt

SEQ ID NO: 1894 - protein, 69 aa, Haemophilus influenzae
  Name: NTH1042
LILLKSAVEILNEFLAALFYIISLLFSRSLAKSFYSKYSHYIDNLAGAIFLFFGGYLVYSGVLATAAAF

SEQ ID NO: 1895 - DNA, 1380 bp, Haemophilus influenzae
  Name: NTH1043
ttgttatttttactgaagttgatagtctccaaacactttaatcagttttggagattttttatgttattagtcaatttggcgatatttattgcttttttattgctgttagcacagctatatcgcaaaaccgaaaaattagggcaaacggtatttatcggtttattgctcggtttgctttttggtgcggtattgcaatccgcttttgaaaaacctttgttagacgaaactttagattggatcaacgtggtcggtaacggttatgttcgtttattgcagatgatcgtgatgccgttggtgttcgtgtcgattttatctgctatcgctcgtatcaatcaaaccagatcattgggcaaagtcagcgttggcgtgttatccaccttgctgattaccaccgccatttccgctgcaattgggattgcgatggtgcatttatttgatgtgtcggcggcaggattaatcgtgggcgatcgtgaattagcggctcaaggcaaagtgttagataaagcagggcaagtgtccaatttaactgtgcctgcgatgttggtgtcctttattccgaaaaatccttttgctgatctcacgggtgccaacccaacgtccattattagtgtcgtaattttctcagcattacttggcgtggcggctttgagtttaggcaaagaagatcaagcacttggcgaacgaattgcacaaggtgtagaaactttaaacaaattagtgatgcgtttggtgcgttttgtgattcgcttaaccccttacggcgtgtttgcgttgatgattaaaatggctgccacctcaaaatgggcggatattgtcaatttgggcaattttattgtggcttcttacgctgctattgccttaatgtttgtggttcacggcattttattgttcttcgttaaagtcaatcctgtggattactacaaaaaagtgttgccaaccttaagttttgcgtttacatctcgctcaagtgcggcgacaattccgttaaatattgaaacgccaaccgcaaaattaggtaacaacaatgtcatcgccaactttgctgcctcattcggtgccactatcggacaaaacggctgtggcggcatttatccagcgatgcttgctgtaatggtcgccccaatggtcggcattgacccttttagcttcagctacattctaaccttaattttcgtggtcgccatttcttcattcggtatcgcaggcgtaggtggcggagccacattcgccgctatcgtcgtgctatctacgttaggtttaccactggaattagtcggtttactcatttccatcgaaccgatcatcgatatgggacgtaccgcacttaacgtaaacggtgccatggtggctggcacgattacggatcgcttgctaaataag

SEQ ID NO: 1896 - protein, 460 aa, Haemophilus influenzae
  Name: NTH1043
LLFLLKLIVSKHFNQFWRFFMLLVNLAIFIAFLLLLAQLYRKTEKLGQTVFIGLLLGLLFGAVLQSAFEKPLLDETLDWINVVGNGYVRLLQMIVMPLVFVSILSAIARINQTRSLGKVSVGVLSTLLITTAISAAIGIAMVHLFDVSAAGLIVGDRELAAQGKVLDKAGQVSNLTVPAMLVSFIPKNPFADLTGANPTSIISVVIFSALLGVAALSLGKEDQALGERIAQGVETLNKLVMRLVRFVIRLTPYGVFALMIKMAATSKWADIVNLGNFIVASYAAIALMFVVHGILLFFVKVNPVDYYKKVLPTLSFAFTSRSSAATIPLNIETPTAKLGNNNVIANFAASFGATIGQNGCGGIYPAMLAVMVAPMVGIDPFSFSYILTLIFVVAISSFGIAGVGGGATFAAIVVLSTLGLPLELVGLLISIEPIIDMGRTALNVNGAMVAGTITDRLLNK

SEQ ID NO: 1897 - DNA, 465 bp, Haemophilus influenzae
  Name: NTH1045
atgaactacctccaatactacccgaccgatgtgattaatggcgaaggcacaagatgcacacttttcgtcagtggctgtacgcacgcttgcaaaggttgctacaaccaaaaaagttggtcattttcagcgggtgtattatttgatgacgcaatggaacaacaaatcatcaatgatttaaaagacacacgcattaaacgccaaggtctcacgctttcaggtggcgatccacttcatccccgtaacatagaaacattattgccctttgtgcaacgtgtaaaacgagaatgccccgataaagacatctgggtttggacgggttataagctagatgaattagacgaacaacaacgtgctatgttgccttatattgatgtattaattgatgggaaatttattcaagaacaggctgacccaagtttagtttggcgaggttccgcaaatcaaattattcatcgatttaagtta

SEQ ID NO: 1898 - protein, 155 aa, Haemophilus influenzae
  Name: NTH1045
MNYLQYYPTDVINGEGTRCTLFVSGCTHACKGCYNQKSWSFSAGVLFDDAMEQQIINDLKDTRIKRQGLTLSGGDPLHPRNIETLLPFVQRVKRECPDKDIWVWTGYKLDELDEQQRAMLPYIDVLIDGKFIQEQADPSLVWRGSANQIIHRFKL

SEQ ID NO: 1899 - DNA, 726 bp, Haemophilus influenzae
  Name: NTH1046
gtgcggttaatttctgcgaagaatttaaatttttcctatcccgaacaagaaacactcgtattaaaaaatcttacattagatttagaacagggcaaaaaaattgctattttaggcaaaactggaagtggaaaatcttcacttcttcaacttttagtacgcaattatgatgcgaatcaaggtgaacttttattggcagaaaaacccatttccgcctattcagaagagacattacgccgccaaatttgttttttaactcaacgtgttcacgtattcagcgatacacttcgtcaaaatttacaatttgcaagtgcggataaaatttctgatgaacaaatgattgaagtactacatcaagttggcttaagtaaattacttgagcaagagggaaaaggtttaaatctttggcttggggatggcggtcgtccactttctggtggggaacaacgccgtttaggtttagcgcgtattttactcaataatgcgtcaattttattattggatgaaccgactgaaggcttagatcgcgaaactgaacgtcaaattttacgtttaattctgcaacatgccgaaaataaaaccctaattatggtcactcaccgtctcagttcaattgaacaattcgataaaatttgtgtaattgatagcggaagattaatcgaagaaggcgattacaatagtttaatcactaaagaaaatggtttctttaaaagattgattgagcgagta

SEQ ID NO: 1900 - protein, 242 aa, Haemophilus influenzae
  Name: NTH1046
VRLISAKNLNFSYPEQETLVLKNLTLDLEQGKKIAILGKTGSGKSSLLQLLVRNYDANQGELLLAEKPISAYSEETLRRQICFLTQRVHVFSDTLRQNLQFASADKISDEQMIEVLHQVGLSKLLEQEGKGLNLWLGDGGRPLSGGEQRRLGLARILLNNASILLLDEPTEGLDRETERQILRLILQHAENKTLIMVTHRLSSIEQFDKICVIDSGRLIEEGDYNSLITKENGFFKRLIERV

SEQ ID NO: 1901 - DNA, 636 bp, Haemophilus influenzae
  Name: NTH1048
gtggatacccttgatagcctctatttacgtttacttgcgccatttttcactgctgtatttgtaatcattgccataaccattggacttagctttatcaatattccactcgcacttggtttaggcttatttttattaattttattaatgattatcccaactgttttctatcgactaggacagcaatttggcgaacgcttaatccaagcacgcgcgacctatcgaacccagtttttagaatttatccaagcacaagccgagcttttattatttaatgcggaagatagattaaaagaaaaaatgtcagccacagaaaaaacatggcaggaagatcaagccaaagaagcaaaattaagcggattctctaccgcacttgttctctttcttaatggtttgttgatttctggaatgctatggtttgcaagtaacgccgattttggcacagatgaatatcgcacggcttatattgcacttttcacttttgctgcacttgccgcctttgagattatcatgccattgggggcagcatttttacatataggtcaagttattgcggcagcagaacgtgtgaccgaaatcattgagcaaaaaccgattgttgagtttaatggcaacgaggaatttgaaacaaagtgcggt

SEQ ID NO: 1902 - protein, 212 aa, Haemophilus influenzae
  Name: NTH1048
VDTLDSLYLRLLAPFFTAVFVIIAITIGLSFINIPLALGLGLFLLILLMIIPTVFYRLGQQFGERLIQARATYRTQFLEFIQAQAELLLFNAEDRLKEKMSATEKTWQEDQAKEAKLSGFSTALVLFLNGLLISGMLWFASNADFGTDEYRTAYIALFTFAALAAFEIIMPLGAAFLHIGQVIAAAERVTEIIEQKPIVEFNGNEEFETKCG

SEQ ID NO: 1903 - DNA, 99 bp, Haemophilus influenzae
  n 55, 85, 94, 95, 96, 97, 98: n is any nucleotide
  Name: NTH1049
atgatttttcaaatacttgcacgcgtaatttggacaaaatgcggaatgttgcatnatgcgttactatgggaaccgagtcgatatncgaaaacannnnnt

SEQ ID NO: 1904 - protein, 33 aa, Haemophilus influenzae
  Xaa 19, 29, 32, 33: Xaa is any amino acid
  Name: NTH1049
MIFQILARVIWTKCGMLHXALLWEPSRYXKTXX

SEQ ID NO: 1905 - DNA, 1077 bp, Haemophilus influenzae
  Name: NTH1050
atggctaaattattagatatcgtgaaacccggtgttgtaacaggcgaagatgtgcaaaaagtttttgcttatgctaaagagcataactttgctattcctgccgtaaactgtgtgggttcagactccgttaatgccgtgttagaaactgctgcacgtgtaaaagcaccagtgattatccaattttcaaatggtggcgcagcgttctatgcaggtaaaggtatcaaaccaacgagtggtactcgtccagatgttttaggggcgattgctggagcgaaacaggttcatactttagcgaaagaatacggtgtgcctgttattcttcatactgatcacgcagcgaaaaaattattaccttggatcgacggtttattagatgcaggcgaaaaacattttgccgaaacgggtcgtccacttttctcttcacatatgatcgatttatctgaagagtcaatggaagaaaatatggcaatctgccgtgaatatcttgctcgtatggataaaatggggatgacccttgaaatcgaaattggcattactggtggcgaagaagacggcgtagataactctgatgttgatgaatcacgtttatatacacaaccgtctgatgtgctttatgtttacgatcaattgcatccagtaagccctaactttaccgttgctgctgcattcggtaacgtacatggtgtttacaaaccaggtaatgtaaaattaaaaccatctattttaggtgcatcacaagagttcgtttctaaagaacgcaatcttcctgcaaaaccaattaacttcgtcttccacggtggttcaggttctagccgcgaagaaatccgcgaagcaattggctacggtgcaatcaaaatgaacattgatactgatacgcaatgggcgtcttggaatggtattttgaatttctataaagcaaatgaagcttatcttcaaggtcaattaggtaaccctgaaggcccagatgcaccaaacaaaaaatactacgacccacgtgtttggttacgtaaaatggaagaatcaatgtctaaacgcttagagcaatctttcgaagacttaaattgtgttgatgtttta

SEQ ID NO: 1906 - protein, 359 aa, Haemophilus influenzae
  Name: NTH1050
MAKLLDIVKPGVVTGEDVQKVFAYAKEHNFAIPAVNCVGSDSVNAVLETAARVKAPVIIQFSNGGAAFYAGKGIKPTSGTRPDVLGAIAGAKQVHTLAKEYGVPVILHTDHAAKKLLPWIDGLLDAGEKHFAETGRPLFSSHMIDLSEESMEENMAICREYLARMDKMGMTLEIEIGITGGEEDGVDNSDVDESRLYTQPSDVLYVYDQLHPVSPNFTVAAAFGNVHGVYKPGNVKLKPSILGASQEFVSKERNLPAKPINFVFHGGSGSSREEIREAIGYGAIKMNIDTDTQWASWNGILNFYKANEAYLQGQLGNPEGPDAPNKKYYDPRVWLRKMEESMSKRLEQSFEDLNCVDVL

SEQ ID NO: 1907 - DNA, 1038 bp, Haemophilus influenzae
  Name: NTH1051
atggaaaagatcttagttattcgtaacgataaattaggcgattttatgcaagcatggcctgcttttgcaatgttgaaagcctcaaatccagagctaaaattaaccgcacttgtgccgagttacactgcgcctttagcggaaatttgtccatttattgatgatgttattattgatagcaaaaaaaatgacaaaacggatttcaaacgtcttgtgcaggaaatcaaagcgcagcagtttgatggcatgattagtttcttttccaatacccataatggaaaactcgcttggaaaagtggaattaaatatcgccttgcacctgcgactaaatgggttcaaattctttataatcaccgtctaacacaacgtcgttctcgttcagaaaaatcagaagcggaatacaatcaagatttagtccgcacttttttgcaaaagcataatatgccagttgttgaacctaaaccgccttatttaatctttgagaaaagtgcggtggaaaaccagcgcgtttttttacaagagagtttagggctttccgcaaataaaaaatggatctttgtgcatagtggttctggtggttcagctacgaatctttctttagcgcaatatgcggatttaattaaaggcttattggctgagtttgattgcaatattgtgctgacagcagggcctggcgaaagagaaaaagcctatgaattagcaaatcttgtgaatgatttacgcgtagccatttacgataagaataaaggtttagtggattttgctcattctttagcttgtgcggatttatttattgcaggatctactgggccattgcatttgagcagtgcgtttaatattccgactatcggattttatccaaatagtcgttcttctcagccgagacgctggaaaccgattaatgatgtcgataagcatcttgcattttgcccacccgcgggaaaagagactcaaatgaatttagagttaatttcaatagacaatgcgttagctgaaatatcacttttcatacggaatatgtggcaaacgagcaataatatt

SEQ ID NO: 1908 - protein, 346 aa, Haemophilus influenzae
  Name: NTH1051
MEKILVIRNDKLGDFMQAWPAFAMLKASNPELKLTALVPSYTAPLAEICPFIDDVIIDSKKNDKTDFKRLVQEIKAQQFDGMISFFSNTHNGKLAWKSGIKYRLAPATKWVQILYNHRLTQRRSRSEKSEAEYNQDLVRTFLQKHNMPVVEPKPPYLIFEKSAVENQRVFLQESLGLSANKKWIFVHSGSGGSATNLSLAQYADLIKGLLAEFDCNIVLTAGPGEREKAYELANLVNDLRVAIYDKNKGLVDFAHSLACADLFIAGSTGPLHLSSAFNIPTIGFYPNSRSSQPRRWKPINDVDKHLAFCPPAGKETQMNLELISIDNALAEISLFIRNMWQTSNNI

SEQ ID NO: 1909 - DNA, 291 bp, Haemophilus influenzae
  Name: NTH1052
atgatcttctgtctgatcggtatattactctatggttttggaactgcgttatatctcacttgtcacttaggtgcaggccctcgagacggattaatggttggtatttgccaacgttttcatttaagcatcaacgtggtacgctcaagccttgaaatctcggtttgtttacttggttttttacttggtggtgtcgttggcttgggtactgtccttttcgccaccagcataggcagcgttgttcaattcttcttaaatattattgctcgtttgccacatattccgtatgaaaag

SEQ ID NO: 1910 - protein, 97 aa, Haemophilus influenzae
  Name: NTH1052
MIFCLIGILLYGFGTALYLTCHLGAGPRDGLMVGICQRFHLSINVVRSSLEISVCLLGFLLGGVVGLGTVLFATSIGSVVQFFLNIIARLPHIPYEK

SEQ ID NO: 1911 - DNA, 168 bp, Haemophilus influenzae
  Name: NTH1053
atggcaaaacaatcagtctctgatgatgaaatcaaaacgtattatgaagctaatcaaaagtcttttgttcagccagagcagggtaaaggtcagtttattgatctttctgcagaaacatcagtagaaatcttcaagtaccagaggagaaatggcccatttattcagata

SEQ ID NO: 1912 - protein, 56 aa, Haemophilus influenzae
  Name: NTH1053
MAKQSVSDDEIKTYYEANQKSFVQPEQGKGQFIDLSAETSVEIFKYQRRNGPFIQI

SEQ ID NO: 1913 - DNA, 603 bp, Haemophilus influenzae
  Name: NTH1054
atgttaattgaaaaaatgcacaatttaacaaactcaaaggtttctaaatttatcttaggtttgattactgtatcgtttttagttggtggaatgtctggctatctttttagctcaaatgatacttatgcggcaaaagtgaacggcgaagtgatttctcaacaagattttttaaatcgctataatcaagaatttgaaatacgcgcacaacgtgagggagaggcgtttgtggctcagtcagattctcctgaatttgttaccgcacttcgtcaaaacatcgtcaatctaatgattgatcaagaattacttcgccaatatgttaaagaattaaaattaggcgtgagtgatgaaatgattaaacgtgcaatcgtgaccgatcctaattttcaagtaaagggtaaatttgataatgctgtttatcaacgaatattacaacaaaatcatttaacttcagatggttacgcttcaattttacgtgcttcgttacctcttgaacaaatacaaaatggcgttgctaacagtgaatttattgttcctgctcaagtaaaaaatagggccagaagttttctttcaaaagcgtttagctcgtttagcaactttatctct

SEQ ID NO: 1914 - protein, 201 aa, Haemophilus influenzae
  Name: NTH1054
MLIEKMHNLTNSKVSKFILGLITVSFLVGGMSGYLFSSNDTYAAKVNGEVISQQDFLNRYNQEFEIRAQREGEAFVAQSDSPEFVTALRQNIVNLMIDQELLRQYVKELKLGVSDEMIKRAIVTDPNFQVKGKFDNAVYQRILQQNHLTSDGYASILRASLPLEQIQNGVANSEFIVPAQVKNRARSFLSKAFSSFSNFIS

SEQ ID NO: 1915 - DNA, 1356 bp, Haemophilus influenzae
  Name: NTH1057
atgaaagaaacaatcgttgctcaagctactgcaccaggtcgtggtggcattgggattttaagggtctcagggcctttagcaacaaaagttgctcaagctatattaggtaaatgccctaagccaagaatggcagattatcttccttttaaagatgctgatggcactattttagatcaagggattgcgctttatttcaaatcgccaaattcatttactggtgaagatgtgttggaattgcaaggtcacggtgggcaggttgtattagatttattactcaaacgtattttacaaattgacggaatccgtttggcgagaccaggcgagttttctgaacaagcttttttgaatgataaattggatcttgctcaagcagaggccattgcagatttaattgatgcaacatcagaacaagcggcacgctcagcattaaaatcattacaaggcgagttttctaaaaaagtaaatgaattggttgattctgtgatttatttacgtacttatgtagaagcaagcattgattttcctgatgaagaaattgatttcttggcagatggaaaaattgaagcaaatttacgcggtattattaatcagctagaaaatgttcgttctgaagctaaacaaggttctattttacgtgaggggatgaaagtcgtgattgctggtcgcccgaatgcaggcaaatcgagtttgcttaatgcacttgctggtcgcgaagcagctatcgtcacggatattgcaggtacaacccgtgatgtattgcgtgagcatattcatattgatggtatgccattgcatattattgataccgcaggtcttcgagatgcaaccgatgaagtagagcgaattgggatttctcgtgcttggacagagattgaacaagccgatcgtattattttgatgttagatagtagcgatcctgaaagtgcagatttaagcaaagtgcggtcagaatttttagcaaaattaccctcaaccttgccagttactattgttagaaacaaaattgatttaaatggcgaacaagcaagtgaaagcgaacagggcggttatcaaattattagtctttctgctcaaacgcatgatggtgtaaaacttttacgtgaccatttgaaacaagcaatgggttttcaaacaggtatcgaagggggatttttagctcgtcgtcgtcatttagatgcacttgagaaagccgcagagcatttacaaatcggtttggttcaacttacagaatttcatgcaggagaacttttagcggaagaattacgcttagttcaaagctatttaagtgaaattacgggtcaattcacatccgatgatttacttggtaatatttttagttctttctgcattggaaaa

SEQ ID NO: 1916 - protein, 452 aa, Haemophilus influenzae
  Name: NTH1057
MKETIVAQATAPGRGGIGILRVSGPLATKVAQAILGKCPKPRMADYLPFKDADGTILDQGIALYFKSPNSFTGEDVLELQGHGGQVVLDLLLKRILQIDGIRLARPGEFSEQAFLNDKLDLAQAEAIADLIDATSEQAARSALKSLQGEFSKKVNELVDSVIYLRTYVEASIDFPDEEIDFLADGKIEANLRGIINQLENVRSEAKQGSILREGMKVVIAGRPNAGKSSLLNALAGREAAIVTDIAGTTRDVLREHIHIDGMPLHIIDTAGLRDATDEVERIGISRAWTEIEQADRIILMLDSSDPESADLSKVRSEFLAKLPSTLPVTIVRNKIDLNGEQASESEQGGYQIISLSAQTHDGVKLLRDHLKQAMGFQTGIEGGFLARRRHLDALEKAAEHLQIGLVQLTEFHAGELLAEELRLVQSYLSEITGQFTSDDLLGNIFSSFCIGK

SEQ ID NO: 1917 - DNA, 672 bp, Haemophilus influenzae
  n 1: n is any nucleotide
  Name: NTH1058
ntgcgtattttgcaaccgaaaatgcaagaaatgcgtgaacgttttggagatgatcgccaacgtatgagccaagaaatgatgaagctttataaagaggaaaaagtaaatccacttggtggttgtttgccaattcttcttcaaatgccaattttcatcgcattatactggacgttcttagaagccgttgaattacgtcatgcaccattctttggttggatccaagacttatcggcacaagatccttattacattctccctattttaatgggtatctcaatgttcttgttgcaaaaaatgtctccaacaccagtaactgacccaacacaacaaaaagtaatgaattttatgccattagttttaatgttctttttcttgtggttcccatcaggcttggtattatactggttagtatctaacttgatcactatcgcccaacagcaattaatttatcgtggtttagagaaaaaagggttgcattctcgtaaaaatagtcacgaacaggcaaaaagaaaggcacggaatgtgccttttctttattttactgccgtgggtatacctaccataggtagtagtgtacctaccctaagcaatcaaccgtgggtaagtatacccacggttaattatagtaataatagttcccctttggggaacgtcaagctctaccccaaaggg

SEQ ID NO: 1918 - protein, 224 aa, Haemophilus influenzae
  Xaa 1: Xaa is any amino acid
  Name: NTH1058
XRILQPKMQEMRERFGDDRQRMSQEMMKLYKEEKVNPLGGCLPILLQMPIFIALYWTFLEAVELRHAPFFGWIQDLSAQDPYYILPILMGISMFLLQKMSPTPVTDPTQQKVMNFMPLVLMFFFLWFPSGLVLYWLVSNLITIAQQQLIYRGLEKKGLHSRKNSHEQAKRKARNVPFLYFTAVGIPTIGSSVPTLSNQPWVSIPTVNYSNNSSPLGNVKLYPKG

SEQ ID NO: 1919 - DNA, 174 bp, Haemophilus influenzae
  Name: NTH1059
atgttgttgaaatcgattacaaagatatcgctacataaagaactatattcagaaagcggcaaaattgtacctagccgtattaccggtactcgtgcgaagtaccaacgtcaattagctcgtgcaatcaaacgcgctcgctatttagcgttacttccatacactgacaatcatcag

SEQ ID NO: 1920 - protein, 58 aa, Haemophilus influenzae
  Name: NTH1059
MLLKSITKISLHKELYSESGKIVPSRITGTRAKYQRQLARAIKRARYLALLPYTDNHQ

SEQ ID NO: 1921 - DNA, 447 bp, Haemophilus influenzae
  Name: NTH1060
atgcaagtaattcttttagataaaattgctcacttaggtcaagtgggcgatcaagtaaatgttaaatcaggttttgcacgtaacttcttaatcccacaaggtaaagcagttatggcaactaaagctaacattgaacactttgaagcacgtcgtgcagaattagaagcgacagcggcagcaaatcttgcagcggctcaagctcgtgcagcagaagttactgcattaggttctgtgactatcgcatctaaagcaggtgatgaaggtcgtttattcggcgcaatcaccactcgtgatgtggcagaagcagtaactgcagcaggcgttaaaattgcgaaaagtgaagttcgtttaccaaacggtccaatccgtactcttggtgaccacgatgttcgtttccaacttcacggtgaagtatttgcaacattagatgtaatcgttgttgcagaa

SEQ ID NO: 1922 - protein, 149 aa, Haemophilus influenzae
  Name: NTH1060
MQVILLDKIAHLGQVGDQVNVKSGFARNFLIPQGKAVMATKANIEHFEARRAELEATAAANLAAAQARAAEVTALGSVTIASKAGDEGRLFGAITTRDVAEAVTAAGVKIAKSEVRLPNGPIRTLGDHDVRFQLHGEVFATLDVIVVAE

SEQ ID NO: 1923 - DNA, 1731 bp, Haemophilus influenzae
  Name: NTH1061
gtgaaagcagaaaaaattgatggtgaagaagtgttaatcattgataaatgcgaaattttggcgattgtggaatattttaaattaaggaaaaagaaaatggcagcaaaagacgtaaaatttggtaacgatgcacgcgtaaaaatgcttaaaggcgtgaatgtattagcggatgcagtaaaagtaacccttggcccgaaaggtcgtaatgtaattttagataaatcatttggcgcaccaactatcactaaagatggtgtgtctgttgctcgtgaaatcgaattagaagataaattcgaaaacatgggggcacaaatggtgaaagaagtggcatctaaagcaaatgatgctgcaggtgacggtacaactactgcaactgtacttgcgcaagctatcgtaaatgaaggcttgaaagcagtagctgcaggtatgaatccaatggatttaaaacgtggtattgataaagcagtaagtgcggttgtttctgaacttaaaaatttatctaaaccttgtgaaacagcaaaagaaattgaacaagtaggtaccatttctgcaaactctgacagcattgtgggtcaattaatctcacaagcgatggaaaaagtgggcaaggaaggggtaattactgttgaagatggtacgggtcttgaagatgaattagatgtggttgaaggcatgcaattcgaccgtggttacctttctccatatttcatcaacaaaccagaaactgcaacggttgaattagataatccatatcttcttcttgtagataaaaaaatctctaacattcgtgaattacttcctgtgttagaaggtgtagcgaaagcaggtaaaccgttattaatcatcgctgaagatgtggaaggcgaagcacttgcaaccttagtagtaaacactatgcgcggtatcgtgaaagttgcagcagtgaaagcaccaggttttggtgatcgtcgtaaagcgatgttacaagatattgcaattttaacagcgggtactgtgatttctgaagaaattggtatggagcttgaaaaagcaacattggaagatttaggtcaagcaaaacgcgttgttatcaataaagataacacaaccattattgatggtatcggcgatgaagcacaaatcaaaggtcgtgtggctcaaattcgtcagcaaatcgaagaatcaacttctgactacgacaaagaaaaactccaagaacgcgttgctaaattagctggcggcgtggctgtaatcaaagtgggcgcagcaactgaagttgaaatgaaagagaaaaaagaccgtgtagatgacgcattacatgcaactcgtgctgcggttgaagaaggtatcgttgccggtggtggcgttgcattagttcgcgcagcagcgaaagttgcagcaagcctaaaaggtgacaacgaagaacaaaatgtgggtatcaaacttgcattacgtgcgatggaagcacctttacgtcaaatcgtcactaactcaggcgaagaagcatctgttgtggcaagtgcggttaaaaatggagaaggaaactttggttataacgcaggtacagaacaatacggcgatatgatcgaaatgggtatcttagatccaactaaagtcactcgttctgcattgcaattcgcagcttctgtagcaggcttaatgattaccactgaatgtatggtaactgatcttccaaaagatgataaagccgatttaggtgctgctggaatgggcggtatgggtggaatgatg

SEQ ID NO: 1924 - protein, 577 aa, Haemophilus influenzae
  Name: NTH1061
VKAEKIDGEEVLIIDKCEILAIVEYFKLRKKKMAAKDVKFGNDARVKMLKGVNVLADAVKVTLGPKGRNVILDKSFGAPTITKDGVSVAREIELEDKFENMGAQMVKEVASKANDAAGDGTTTATVLAQAIVNEGLKAVAAGMNPMDLKRGIDKAVSAVVSELKNLSKPCETAKEIEQVGTISANSDSIVGQLISQAMEKVGKEGVITVEDGTGLEDELDVVEGMQFDRGYLSPYFINKPETATVELDNPYLLLVDKKISNIRELLPVLEGVAKAGKPLLIIAEDVEGEALATLVVNTMRGIVKVAAVKAPGFGDRRKAMLQDIAILTAGTVISEEIGMELEKATLEDLGQAKRVVINKDNTTIIDGIGDEAQIKGRVAQIRQQIEESTSDYDKEKLQERVAKLAGGVAVIKVGAATEVEMKEKKDRVDDALHATRAAVEEGIVAGGGVALVRAAAKVAASLKGDNEEQNVGIKLALRAMEAPLRQIVTNSGEEASVVASAVKNGEGNFGYNAGTEQYGDMIEMGILDPTKVTRSALQFAASVAGLMITTECMVTDLPKDDKADLGAAGMGGMGGMM

SEQ ID NO: 1925 - DNA, 306 bp, Haemophilus influenzae
  Name: NTH1062
ttgtcagaattttttgtaagagccttgaaagaaaaaaaatcctccttatatagaaaccgcacttacaaattcttaagaaggaaattaatcatgaatattcgtcctttacacgatcgtgtaattattaaacgtgaagaagaggaaacccgttcagctggcggtatcgtattaaccggttcagcagcgactaaatcaacccgcgcgaaagtattagctgtgggtaaaggtcgtattttagaaaatggcaccgttcaacctttagatgttaaagttggcgagaccgtattttcaacgacggttacggcg

SEQ ID NO: 1926 - protein, 102 aa, Haemophilus influenzae
  Name: NTH1062
LSEFFVRALKEKKSSLYRNRTYKFLRRKLIMNIRPLHDRVIIKREEEETRSAGGIVLTGSAATKSTRAKVLAVGKGRILENGTVQPLDVKVGETVFSTTVTA

SEQ ID NO: 1927 - DNA, 570 bp, Haemophilus influenzae
  n 184, 198, 225, 303, 316, 317, 318, 319, 320, 321, 322, 323, 324, 325, 326, 327, 328, 329, 330, 331, 332, 333,334, 335, 336, 337, 338, 339, 340, 341, 342, 343, 344, 345, 346, 347, 348, 349, 351, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 395, 396, 397, 398, 399, 400, 401, 402, 404, 415, 416, 417, 418, 419, 420, 421, 422, 423, 424, 425, 426, 429, 430, 431, 432, 433, 434, 435, 436, 441, 442, 444, 445, 446, 447, 448, 449, 450, 451, 452, 453, 454, 455, 456, 457, 458, 459, 460, 468, 479, 481, 482, 483, 484, 485, 486, 488, 491, 492, 493, 494, 495, 496, 497, 498, 499, 500, 501, 502, 503, 504, 505, 506, 507, 508, 509, 510, 511, 513, 514, 516, 517, 519, 520, 521, 522, 523, 524, 520, 542, 543, 544, 545, 546, 547, 549, 551, 553, 557, 558, 559, 560, 561: n is any nucleotide
  Name: NTH1063
atgcacttaacttccagagaacaagataaactgatgcttttcctcgcgggcgaacttgcggcaaaacgcatagcacgcggcgttaaattaaattatccagataccattgcttatattgcgagccatttacaagaggctgcaagagacggaatgagtgtagcggaagtgatgcaatatggcgcancacttttaactgtngatgatgtcatggaaggtgtggcaganatggttcatgaagtccagattgaagctactttccccgatggcacgaaacttgttaccgtgcataatccaatcaaaccncggaaaggggggnnnnnnnnnnnnnnnnnnnnnnnnnnnnnnnnnnnnnnnnnnnnnnnnnnnnnnnnnnnnnnnnnnnnnnnnnnnnnctnnnnnnnnnnnnnnnnnnnnnnnnnnnnnnnnatnnnnnnnnccttnncnnnnnnnnnnnnnnnnnnnnnnnnnccatttnnnnngnnnnnngnctnnnnnnnnnnnnnnnnnnnnngnngnngnnnnnnngnnnnnnngnnnctngnnnnnngngngngggnnnnnttaattaat

SEQ ID NO: 1928 - protein, 190 aa, Haemophilus influenzae
  Xaa 62, 75, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142,154, 155, 156, 159, 160, 161, 162, 163, 164, 165, 166, 167, 168, 169, 170, 171, 172, 173, 174, 175, 176, 177, 178, 179,181, 182, 183, 184, 185, 186, 187: Xaa is any amino acid
  Name: NTH1063
MHLTSREQDKLMLFLAGELAAKRIARGVKLNYPDTIAYIASHLQEAARDGMSVAEVMQYGAXLLTVDDVMEGVAXMVHEVQIEATFPDGTKLVTVHNPIKPRKGGXXXXXXXXXXXXXXXXXXXXXXXXXXXXXXXXXXXXXXXXXXXXXXXXXXXPFXXXXXXXXXXXXXXXXXXXXXLXXXXXXXLIN

SEQ ID NO: 1929 - DNA, 648 bp, Haemophilus influenzae
  n 639, 640, 641, 642, 643: n is any nucleotide
  Name: NTH1064
atggaagataaaatccctttttggttgcgtgtttggcaacgtttgcatattgatttttggctgtttatcggacttcttgcaataacggcttatggtatgctggtgttatatagtgcatcaggtgccagtgaaatgatgtttaataaccgaattattcaggttttacttggatttattgttatgttgttaatggctcaatttccaccaagattttaccaacgcatcgcaccttatctttatttaattggttttgtgttgttgatcttagtagatgctattggcacgacaagtaaaggtgcgcagcgttggcttgatctgggatttattcgttttcaaccctctgaaattgtaaaacttgctgtgccattaatggtggcggtgtatttaggtaatcgtccgcttccacctaaattaagtgaaacatttatagcgattgcaatgattctactgccaacattgcttgtggcgattcagcctgatttaggcacagcaattttggtcagtgcgtcaggtttatttgtcgtgtttttagcaggaatgagctggtggcttattttagctgcagtgattggcttagctggatttattccgatcatgtggttatatctaagccggggtacgagtccgattcgtatacannnnnttaat

SEQ ID NO: 1930 - protein, 216 aa, Haemophilus influenzae
  Xaa 213, 214, 215: Xaa is any amino acid
  Name: NTH1064
MEDKIPFWLRVWQRLHIDFWLFIGLLAITAYGMLVLYSASGASEMMFNNRIIQVLLGFIVMLLMAQFPPRFYQRIAPYLYLIGFVLLILVDAIGTTSKGAQRWLDLGFIRFQPSEIVKLAVPLMVAVYLGNRPLPPKLSETFIAIAMILLPTLLVAIQPDLGTAILVSASGLFVVFLAGMSWWLILAAVIGLAGFIPIMWLYLSRGTSPIRIXXXN

SEQ ID NO: 1931 - DNA, 198 bp, Haemophilus influenzae
  n 1: n is any nucleotide
  Name: NTH1066
ntgcgccttatgaaaaccctagattggtgtgacagtgatttagaaaatgcaggtggtggttcaagtaatgccgcaccgttagcgcgtaaagtgatggattactatttaaatcagcgtttaccacaagttgaaaaatataatgtacctattcagcaaaaaaaagatttgtcacaagagagcgaacaaataaatggaaga

SEQ ID NO: 1932 - protein, 66 aa, Haemophilus influenzae
  Xaa 1: Xaa is any amino acid
  Name: NTH1066
XRLMKTLDWCDSDLENAGGGSSNAAPLARKVMDYYLNQRLPQVEKYNVPIQQKKDLSQESEQINGR

SEQ ID NO: 1933 - DNA, 552 bp, Haemophilus influenzae
  Name: NTH1067
atgaaaaatgatttgaattatgcagtggaacttatccgcaaagcggatggcattttaattacagctggtgcgggtatgagcgtggattctgggcttcccgatttccgcagcgttggcggattttggaatgcttatcctatgtttaaagaacataatatatcttttgaagagatcgcaacgccactagcttataagcataatcaggaactagcctattggttttatgggcatcgattagttcaataccgaaatactcttcctcacgaagggtatcagattttaaaatgctgggcgggagataaacctcatggatattttgtttttaccagtaatgttgatgggcattttcaaaaggctggttttaatgatagccatgtttatgaagtacatggtactttggagcgtcttcaatgtgtcaataattgtcgaggattaagttggtctgcatcaagttttcaacctgtcgtggataatgaaaacttatgtttaaccagtgaaaaaccacattgtccttattgtgggggctttgccggtaaaatgcataattgttta

SEQ ID NO: 1934 - protein, 184 aa, Haemophilus influenzae
  Name: NTH1067
MKNDLNYAVELIRKADGILITAGAGMSVDSGLPDFRSVGGFWNAYPMFKEHNISFEEIATPLAYKHNQELAYWFYGHRLVQYRNTLPHEGYQILKCWAGDKPHGYFVFTSNVDGHFQKAGFNDSHVYEVHGTLERLQCVNNCRGLSWSASSFQPVVDNENLCLTSEKPHCPYCGGFAGKMHNCL

SEQ ID NO: 1935 - DNA, 198 bp, Haemophilus influenzae
  Name: NTH1068
atggcaatgaaagtaattatggcaagagatccactttttgaggatgtaaaaaaatatgtgcaacaacaaaaatttgcatcttgctcaatgattcaacgcagatttatgttgggttttaatcgagctgggcaaattttagaacagttggaacaagcgggtattatttcatcaatgaaaaatgggcagagaaaagtatta

SEQ ID NO: 1936 - protein, 66 aa, Haemophilus influenzae
  Name: NTH1068
MAMKVIMARDPLFEDVKKYVQQQKFASCSMIQRRFMLGFNRAGQILEQLEQAGIISSMKNGQRKVL

SEQ ID NO: 1937 - DNA, 669 bp, Haemophilus influenzae
  Name: NTH1069
ttgcaaataagatgctctgtattgcaatatgcatatttatctggttatatatacatgttagttattaaggaaaataatatgaataaccaaaacccgattgaaatttaccaaactcaagatggcacaacgcaagtggaagtgagatttgaaaatgacaccgtttggctttcccaagcgcagatggctatgttatttggtaaagatattcgcaccatcaatgagcacattaccaatatatttgatgacgaagaacttgagaaagaatcaactatccggaaattccggatagttcgccaagaaggtaaacgccaagtcaatcgtgaaattgagcattatgatttagatatgattatctctgttggctatagagtaaaatctaaacaaggcattagtttccgccgttgggcaactgcacgtttaaaagaatatctgactcaaggctataccattaaccaaaaacgtttacagcaaaatgctcacgaattagaacaagcacttgcgcttattcaaaaaacggcaaattcatcggaattaacgctagaaagcggtcgcggattagtggatattgtcagccgttatacgcatacgtttttatggctacaacaatatgatgaaggtttacttgccgaaccacaaacacagcaagggcggtacattaccgacttatgc

SEQ ID NO: 1938 - protein, 223 aa, Haemophilus influenzae
  Name: NTH1069
LQIRCSVLQYAYLSGYIYMLVIKENNMNNQNPIEIYQTQDGTTQVEVRFENDTVWLSQAQMAMLFGKDIRTINEHITNIFDDEELEKESTIRKFRIVRQEGKRQVNREIEHYDLDMIISVGYRVKSKQGISFRRWATARLKEYLTQGYTINQKRLQQNAHELEQALALIQKTANSSELTLESGRGLVDIVSRYTHTFLWLQQYDEGLLAEPQTQQGRYITDLC

SEQ ID NO: 1939 - DNA, 339 bp, Haemophilus influenzae
  n 148, 181: n is any nucleotide
  Name: NTH1070
atgacaaaaggtgaagcaagtgatctctttggacgtgaacgagataacggcttatctgcgattctaggtaatttagatcaaagtgaatttggtgaacctgcttatccaagcattgaagcaaagcggcgcatttactttattttgtcgncaagatcatcctttttcagatggaataaacgtnagcgggcatttttatttgggagattcttactagaaatgggcggttggtttgacattatgggtacccagttttcatggtactgggcttgccgggctcactttatagttgctgaatctgatccgaacaaaagaacgcttttaggcttatatgcctatgct

SEQ ID NO: 1940 - protein, 113 aa, Haemophilus influenzae
  Xaa 50, 61: Xaa is any amino acid
  Name: NTH1070
MTKGEASDLFGRERDNGLSAILGNLDQSEFGEPAYPSIEAKRRIYFILSXRSSFFRWNKRXRAFLFGRFLLEMGGWFDIMGTQFSWYWACRAHFIVAESDPNKRTLLGLYAYA

SEQ ID NO: 1941 - DNA, 1341 bp, Haemophilus influenzae
  Name: NTH1071
gtggatattcacggtttatcgcaagagaatttgtattttaaagagatgctagacaaattagccgttacaccacatattttccgcgtggggacttataaatcagcagttgaaccatttttacgcaacgatatgtcggctgaggcaaaagcaaatatgcaacgttggttaggcgaaatgtggaataattatgttttatccgtcagtgaaaatcgtaatattaagaaagatcgcattttgccgaatgcgaaacagtatcttgcagaacttaaagcgttaaaaggcaatagtacggcatatgcacaacaacgtggattagtaactgatgttgtaactcgtttagatttagataaaaaatttaccgcactttttggcaaaggaagtgatggaaaagcgaaccttatcgaatttgatgattatttgactcaactgcctgatcgtttagaacattacaacgtaccgaataaaattgcggttgtgaatgttgaaggaacgattattgatggagaaagtgatgaagaaaatgctggtggcgacaccattgcgcgaattcttcgtaaagcccacgatgacaattctgtgaaagccgtgattctacgcgttaattcacctggcggaagtgcttttgcttctgaaattatccgacaagaaactgaaaacttacagaaaattggaaagcctgtcatcgtatctatgggtgcaatggcagcatcaggtggttattggatttcatccactgcagattatattattgccgatgcaaatacaattacgggttctatcggtattttcacgatgttcccgactttcgaaaatagtattaagaaaataggcgtgcatgcagatggtgtttcaaccactgaattagctaatacatctgcgttttctccattagcaaaacccgtgcaagatatttatcaaacagaaattgagcacggttatgacagatttttagaaattgtcagcaaaggtcgtcagctttctaaaacacaagtagataaactggctcaaggtcaggtttggttgggcagtgatgcattccaaaatggtttagtggatgagatcggttcttttaatgaagcagttaataaagcagagcaattagtgaatcaacgccaagatactgccgtgcaggattttagtgtggaatggtttacagatgataatgttagtttaattagcaccttattacgcgatactaaaaaaggtacgcaagagcagttagttaaatggcttggtctgccggctccaattcaaaaattacaaaaagaattgaatgtattaactaaatttaatgatcctaaaggtcaatatttgtattgcttgaattgtggaaaggttcag

SEQ ID NO: 1942 - protein, 447 aa, Haemophilus influenzae
  Name: NTH1071
VDIHGLSQENLYFKEMLDKLAVTPHIFRVGTYKSAVEPFLRNDMSAEAKANMQRWLGEMWNNYVLSVSENRNIKKDRILPNAKQYLAELKALKGNSTAYAQQRGLVTDVVTRLDLDKKFTALFGKGSDGKANLIEFDDYLTQLPDRLEHYNVPNKIAVVNVEGTIIDGESDEENAGGDTIARILRKAHDDNSVKAVILRVNSPGGSAFASEIIRQETENLQKIGKPVIVSMGAMAASGGYWISSTADYIIADANTITGSIGIFTMFPTFENSIKKIGVHADGVSTTELANTSAFSPLAKPVQDIYQTEIEHGYDRFLEIVSKGRQLSKTQVDKLAQGQVWLGSDAFQNGLVDEIGSFNEAVNKAEQLVNQRQDTAVQDFSVEWFTDDNVSLISTLLRDTKKGTQEQLVKWLGLPAPIQKLQKELNVLTKFNDPKGQYLYCLNCGKVQ

SEQ ID NO: 1943 - DNA, 129 bp, Haemophilus influenzae
  Name: NTH1073
ttggaaaataaaaagtggcttaatttaccaagtatcgttctttgcaaagtattttcttttgatcttaaccatcttttcttacaagaagaaaatcgaagtttaattcttcggtgctttttcatcagtggg

SEQ ID NO: 1944 - protein, 43 aa, Haemophilus influenzae
  Name: NTH1073
LENKKWLNLPSIVLCKVFSFDLNHLFLQEENRSLILRCFFISG

SEQ ID NO: 1945 - DNA, 858 bp, Haemophilus influenzae
  Name: NTH1074
atggataaccttgatgactatcaccacattttacaaaaattgacaccaaacaagggaaaaataatgaaaaaattaacgctcagagaacaacaactcgtttgtctcaatatattagattatttccacgcattatgtgagcgacaccaaattcactattctcttggtggtggaacattaatcggtgcaatacgccacaaaggctttatcccttgggatgatgatattgatgtttatatgcaccgtgatgaatatcaaaggttcgttgatgtttggtttcaagaaactcacgaatactacaatatggaaacggcagaagatatacttgctcaatataccggtgaaatggcaaaaattttcgattgtcgcactcaaataacagatgctaagggaagaaaaagcccgatgtttatggatatatttatctacgatggtgtaccgaatgaaccaaagatcatttacccactgatgaaaaagcaccgaagaattaaacttcgattttcttcttgtaagaaaagatggttaagatcaaaagaaaatactttgcaaagaacgatacttggtaaattaagccactttttattttccaaaatgcaaaaaaatttagcacaattccaaataaaatatccgataaaacaatgcgattatattggtcttgtattatctgactacggtggttggcaaaaatcttatatgccgaaagaatattttaatcacattgtttataaagaatttgaaggacgacaatttcaagtaatgaatggatatcacgaacacttaacgcaatattatggagattatatgaagcttccaccagaagaagaccaaaagccacatcatattcaagaagcgtatattttg

SEQ ID NO: 1946 - protein, 286 aa, Haemophilus influenzae
  Name: NTH1074
MDNLDDYHHILQKLTPNKGKIMKKLTLREQQLVCLNILDYFHALCERHQIHYSLGGGTLIGAIRHKGFIPWDDDIDVYMHRDEYQRFVDVWFQETHEYYNMETAEDILAQYTGEMAKIFDCRTQITDAKGRKSPMFMDIFIYDGVPNEPKIIYPLMKKHRRIKLRFSSCKKRWLRSKENTLQRTILGKLSHFLFSKMQKNLAQFQIKYPIKQCDYIGLVLSDYGGWQKSYMPKEYFNHIVYKEFEGRQFQVMNGYHEHLTQYYGDYMKLPPEEDQKPHHIQEAYIL

SEQ ID NO: 1947 - DNA, 639 bp, Haemophilus influenzae
  Name: NTH1075
atgggcggggctgcattattaacgggggctttaggtttcgctatcgctcgtggattaaatcaacgcgttaaactgtatttatgttgcgcagagaatttgataagcaataatgcctttaaactaggcgatattattacttataaaaatggcgtgacagcagaagtgctgaatacggatgctgaagggcgtttggtgttggctgatggattgattgaagcggacagccaaaatccagattttattattgattgtgcaactttaactggcgcagcaaaaatggcagtaggaaatgactatcattcggtattatctatggatgatgatctcgtgaagaatcttttccaatcagcacaagaagaaaatgaacctttctggcgtttaccatttgaagattttcatcgctcacaaattaattcatcttttgcagatattgctaatattggttctgttccagttggggcgggggcaagtacagcaacagcatttttatcgtattttataaaaaattatcaacaaaattggttgcatattgattgttccgcaacttatcgtaaatctagtagtgatttatgggctgttggggcgacagggattggtgtgcaaactttagcaaatttaatgttatcaaaatcattgaag

SEQ ID NO: 1948 - protein, 213 aa, Haemophilus influenzae
  Name: NTH1075
MGGAALLTGALGFAIARGLNQRVKLYLCCAENLISNNAFKLGDIITYKNGVTAEVLNTDAEGRLVLADGLIEADSQNPDFIIDCATLTGAAKMAVGNDYHSVLSMDDDLVKNLFQSAQEENEPFWRLPFEDFHRSQINSSFADIANIGSVPVGAGASTATAFLSYFIKNYQQNWLHIDCSATYRKSSSDLWAVGATGIGVQTLANLMLSKSLK

SEQ ID NO: 1949 - DNA, 423 bp, Haemophilus influenzae
  Name: NTH1077
atgatgacagaaagaactttttcgattattaaatctgatgcggtaaagcgtaatcttattggagcaatcttaactcgttttgagcaaaatggctttaaaatcatagcctctaaaatggtacgcttaactcgtgagcaggctgaaggcttttatgcagagcatcaaggcaaagaattttttgctcctttagttgaatatatgatgtcttcgccgatagtggtttctgttcttgaaaaagaaaatgcagtgaaagattaccgcactttgattggtacaacgaatccagaaactgcagaagaagggacaattcgtaaagattttgcattaagtcagcgtgagaattcggttcacggatcagatagtatagaaaatgcaaatcgtgaaattgcttatttctttactgattgtgaaatttttgagcgt

SEQ ID NO: 1950 - protein, 141 aa, Haemophilus influenzae
  Name: NTH1077
MMTERTFSIIKSDAVKRNLIGAILTRFEQNGFKIIASKMVRLTREQAEGFYAEHQGKEFFAPLVEYMMSSPIVVSVLEKENAVKDYRTLIGTTNPETAEEGTIRKDFALSQRENSVHGSDSIENANREIAYFFTDCEIFER

SEQ ID NO: 1951 - DNA, 681 bp, Haemophilus influenzae
  n 91: n is any nucleotide
  Name: NTH1078
atgctcggtttacctaatgctggtaaattcacttttattcgtgccgtttcagcagccaaaccaaaaggtgcagattatccatttactactntagtaccaagtctcggtgttgtgaaagtagacgattcacacagtttcgtagtcgctgatattccaggattaattgaaggggctgcagatggtgctgggctaggaattcgctttttaaaacatttagaacgttgtagagtgcttattcatttagtcgatattgctccaattgatggatctaatccagcagataatgtcgctattattgaatctgaacttttccaatacagtgaaaaattatcagaaaagccacgttggttagtgttcaataaaattgatacgatgagcgatgaagaagctgaagagcgggttcgagaaatcactgaacaattaggttgggaagaagactattacctgatttcagctgcaacaaggaaaaatgttccaccactttgtcgtgatattatggactttatcatagcaaatccacgcgaagctgaaacacaacaagttgcacctgaagaagtaaaattcaaatgggaagattatcatcaggaacaactagcggggtatcaatttgatgatgacgaagattgggatgacgattggactgaagaagatgatgaaggaattgagttcatctataaacct

SEQ ID NO: 1952 - protein, 227 aa, Haemophilus influenzae
  Xaa 31: Xaa is any amino acid
  Name: NTH1078
MLGLPNAGKFTFIRAVSAAKPKGADYPFTTXVPSLGVVKVDDSHSFVVADIPGLIEGAADGAGLGIRFLKHLERCRVLIHLVDIAPIDGSNPADNVAIIESELFQYSEKLSEKPRWLVFNKIDTMSDEEAEERVREITEQLGWEEDYYLISAATRKNVPPLCRDIMDFIIANPREAETQQVAPEEVKFKWEDYHQEQLAGYQFDDDEDWDDDWTEEDDEGIEFIYKP

SEQ ID NO: 1953 - DNA, 951 bp, Haemophilus influenzae
  Name: NTH1080
ttgcaggtaaaaaatagccgtactttttttaaattaggcatacgcaaggactacaacatgaacatcctcatcatcggaaacggcggtcgtgaacacgccttggcttggaaagttgcacaatctccattagcagataaagtttttgtcgcaccgggtaacgctggtactgcattggaacacaaagtagaaaacgtgaatatttctgcgacagatattccagcattagtgaaatttgctcaagataaacaaattggattaaccattgttggtcctgaagcccccttagtgattggggtagttgatgcatttcgtgaagctggattgaagatttttgggccagctaaagcggctgcgcaattggaaggttcaaaggcattcactaaagattttctcgctcgtcataaaattccaacagcggaatatcaaaacttcaccgaagtcgaacctgcattgacttacttgcgtgaaaaaggcacaccaattgtcgttaaagcggatggcttggcggcgggtaaaggcgtaatcgttgcgatgacattgcaagaagccgaagatgcagtacgcgatatgctttctggtaatgcctttggcgaagcgggcagccgagtagtgattgaagaatttctagatggcgaagaagcaagttttatcgtcatggtagatggtaaaaacgtagaacctatggctactagccaagatcataaacgcgtgggcgaaaatgatacggggttaaatacaggcggtatgggcgcgtattcgcctgcaccagtaataacacccgaaattcatagtcgcattatgaaggaagtgatttacccaaccgttaatggcatggcagcggaaggcagtgtttacacgggtttcctatatgcaggattaatgattatgccaaatgggcagccgaaagtgatcgaatttaattgtcgttttggtgatccagaaacgcagcca

SEQ ID NO: 1954 - protein, 317 aa, Haemophilus influenzae
  Name: NTH1080
LQVKNSRTFFKLGIRKDYNMNILIIGNGGREHALAWKVAQSPLADKVFVAPGNAGTALEHKVENVNISATDIPALVKFAQDKQIGLTIVGPEAPLVIGVVDAFREAGLKIFGPAKAAAQLEGSKAFTKDFLARHKIPTAEYQNFTEVEPALTYLREKGTPIVVKADGLAAGKGVIVAMTLQEAEDAVRDMLSGNAFGEAGSRVVIEEFLDGEEASFIVMVDGKNVEPMATSQDHKRVGENDTGLNTGGMGAYSPAPVITPEIHSRIMKEVIYPTVNGMAAEGSVYTGFLYAGLMIMPNGQPKVIEFNCRFGDPETQP

SEQ ID NO: 1955 - DNA, 594 bp, Haemophilus influenzae
  Name: NTH1081
atgaaattgtggaacgcccaattcgttgaagtgattatcgcaccgaaaagttctgctgaagcgcaagaagtaatgaagcgtaagaaaaatgtgcgtttgcttgaatgtggtgaatggacttctcgttccgaacgtttggatttcaaacgtgtaaacggcggtttattagtacaagatgcggatttaggtatggttggcgtggatgatttaaaagtcgtgagtaaacgtcagccaactgaacaagaattaaaagacttattattctgctggaaagtggcaaaatttgtgaaatcgaatgccattgtttacgccaaagacaatcaaactatcggcattggtgcaggtcaaatgagccgtgtgtattcggccaaaattgcaggtatcaaagcacaggatgaaggcttgaccgtggcaggttgtgtgatggcatctgatgcgttcttcccattccgtgatggcattgatgctgcagcgaaagtgggaattcaatgtgtgatccatccaggtggttcaatgcgcgatcaagaagtcatcgatgcggcggatgaacataatatggtaatggtattgactggaatgcgacattttagacat

SEQ ID NO: 1956 - protein, 198 aa, Haemophilus influenzae
  Name: NTH1081
MKLWNAQFVEVIIAPKSSAEAQEVMKRKKNVRLLECGEWTSRSERLDFKRVNGGLLVQDADLGMVGVDDLKVVSKRQPTEQELKDLLFCWKVAKFVKSNAIVYAKDNQTIGIGAGQMSRVYSAKIAGIKAQDEGLTVAGCVMASDAFFPFRDGIDAAAKVGIQCVIHPGGSMRDQEVIDAADEHNMVMVLTGMRHFRH

SEQ ID NO: 1957 - DNA, 93 bp, Haemophilus influenzae
  n 41: n is any nucleotide
  Name: NTH1082
atgcttataatcgcgcttaccaaacccgatccaacgtctgnctttggcggcattattgcttttaaccgtgaattagacgaaaaaaccggcgaa

SEQ ID NO: 1958 - protein, 31 aa, Haemophilus influenzae
  Xaa 14: Xaa is any amino acid
  Name: NTH1082
MLIIALTKPDPTSXFGGIIAFNRELDEKTGE

SEQ ID NO: 1959 - DNA, 135 bp, Haemophilus influenzae
  n 114: n is any nucleotide
  Name: NTH1083
ttgatgagccagcttgtgttatcgttaaacacgcttaatccgtgtggtgtggctttaggtaaggatattttagatgcttataatcgcgcttaccaaacccgatccaacgtctgnctttggcggcattattgcttt

SEQ ID NO: 1960 - protein, 45 aa, Haemophilus influenzae
  Xaa 38: Xaa is any amino acid
  Name: NTH1083
LMSQLVLSLNTLNPCGVALGKDILDAYNRAYQTRSNVXLWRHYCF

SEQ ID NO: 1961 - DNA, 597 bp, Haemophilus influenzae
  n 588, 589, 590, 591, 592: n is any nucleotide
  Name: NTH1084
atgccacgcctttcccgccgtcaattattaaaaacagctgcgatttctaccgcactttccaccgtgccagcaccattgttagcggcaagccgtgaaaaactagttgtgccgccactaattgaagttcgtcgcggtcgcccgattgtattaaccatgcaggaaacgaattatccgttagatggctcacacaatgtgacggtatggggattcaacggtaattatcttggcccaaccattaaaatcaaatcaggtagctttgccaaacttaattatcataacaatttgccacaatccgttgccttgtctattcaaggtttacaagcatcaggcgaactgtttggcggggcagctcgagttctcaaaaaaggcgaatcttgggcacccatcgtgcctattgaacaacctgcagcaagctgctggtatcgttccgcgacattagccaactcagcctatcaaacctatcgtggcttagctggaatgtggttaattgaagatgagcaaagcctaaaagctaatcttcccaataaatacggcgtagatgatattccattgattttacaagatatggaatttaacaatgatggttcnnnnnttaat

SEQ ID NO: 1962 - protein, 199 aa, Haemophilus influenzae
  Xaa 197, 198: Xaa is any amino acid
  Name: NTH1084
MPRLSRRQLLKTAAISTALSTVPAPLLAASREKLVVPPLIEVRRGRPIVLTMQETNYPLDGSHNVTVWGFNGNYLGPTIKIKSGSFAKLNYHNNLPQSVALSIQGLQASGELFGGAARVLKKGESWAPIVPIEQPAASCWYRSATLANSAYQTYRGLAGMWLIEDEQSLKANLPNKYGVDDIPLILQDMEFNNDGSXXN

SEQ ID NO: 1963 - DNA, 375 bp, Haemophilus influenzae
  Name: NTH1085
ttggatagagaaaaccgcacaaaagcgcataatacgatgtcacagcttgcacgacgaattaatgaagataatttatcaatttggatgttcccagaaggcactcgcaatcgcggtcgcggtttattaccctttaaaacgggtgcattccatgcggcgatttcagcaggtgtaccaattattccagtggtgtgttcaagcacgcataacaaaattaatttaaatcgttgggataatggcaaagtgatttgcgaaataatggatccaatcgatgtttcaggctataccaaagacaatgttcgcgatcttgcggcttattgtcatgatctaatggaaaaacgcattgccgaacttgatgaagagatagcaaaaggaaac

SEQ ID NO: 1964 - protein, 125 aa, Haemophilus influenzae
  Name: NTH1085
LDRENRTKAHNTMSQLARRINEDNLSIWMFPEGTRNRGRGLLPFKTGAFHAAISAGVPIIPVVCSSTHNKINLNRWDNGKVICEIMDPIDVSGYTKDNVRDLAAYCHDLMEKRIAELDEEIAKGN

SEQ ID NO: 1965 - DNA, 363 bp, Haemophilus influenzae
  Name: NTH1086
ttgccattatcccaacgatttaaattaattttgttatgcgtgcttgaacacaccactggaataattggtacacctgctgaaatcgccgcatggaatgcacccgttttaaagggtaataaaccgcgaccgcgattgcgagtgccttctgggaacatccaaattgataaattatcttcattaattcgtcgtgcaagctgtgacatcgtattatgcgcttttgtgcggttttctctatccaagaaaatattacccgttacccaatataaaatgccgaagaagggtatccaaattaagcttttttacccacacttactgtgcgaggttgcaccatataagagattgttaccatatcataattatttt

SEQ ID NO: 1966 - protein, 121 aa, Haemophilus influenzae
  Name: NTH1086
LPLSQRFKLILLCVLEHTTGIIGTPAEIAAWNAPVLKGNKPRPRLRVPSGNIQIDKLSSLIRRASCDIVLCAFVRFSLSKKILPVTQYKMPKKGIQIKLFYPHLLCEVAPYKRLLPYHNYF

SEQ ID NO: 1967 - DNA, 225 bp, Haemophilus influenzae
  Name: NTH1087
atgttaaaactacttcgaattttcctcgtattaatctgctgtattctaatttgtgtactgggtacgatttattcttttatccgctttaaaaatccaagcaacgtaggcattgttgctcgttggtttggacgcttatatccactttttggcttaaaggtagaacatcgtattcctcaagatcagaagcaaattagccgcgccatttatatcggtaatcatcaaaaa

SEQ ID NO: 1968 - protein, 75 aa, Haemophilus influenzae
  Name: NTH1087
MLKLLRIFLVLICCILICVLGTIYSFIRFKNPSNVGIVARWFGRLYPLFGLKVEHRIPQDQKQISRAIYIGNHQK

SEQ ID NO: 1969 - DNA, 711 bp, Haemophilus influenzae
  Name: NTH1088
atgaaacatagctattttatttctgatttgcatttaagcgaaactcagccagaattgaccgcactttttgtcgattttatgcagaatcttgccccacaggctgaacggctttacattttaggtgatctttttgatttttggattggtgatgatgagcaatctgcattgattcaacaagttaaagatttaattaagtctgtaagtaatcaaggtgtgcaatgttattttcagcacggtaaccgtgatttcttaattggtgaacgttttgcgaaagatacaggtgttcagcttttacctgattatcaattaatcacactttatgataaaaaaatcttactttgtcatggcgatacgctttgtattgatgatgaggcttaccaacaatttcgccgtagagtgcatcaaaaatggctgcaacgtttgtttttgtgcttgccattaaaagtgcgggtgataattgcggagaaaattcgagcaaagagcaatcaagataaacaagcgaaatcacaggaaattatggatgtaaaccaagccttcacggcagaaaaagtacaagagtttgatgtaaatttattaattcacggacacacacaccgtgaggcgattcatcaacaagaagaatttacccgaattgtattaggggattggcgaaaaaattacgcatcaattttaaaaatggatgaaagcggagaatttggttttattaaagat

SEQ ID NO: 1970 - protein, 237 aa, Haemophilus influenzae
  Name: NTH1088
MKHSYFISDLHLSETQPELTALFVDFMQNLAPQAERLYILGDLFDFWIGDDEQSALIQQVKDLIKSVSNQGVQCYFQHGNRDFLIGERFAKDTGVQLLPDYQLITLYDKKILLCHGDTLCIDDEAYQQFRRRVHQKWLQRLFLCLPLKVRVIIAEKIRAKSNQDKQAKSQEIMDVNQAFTAEKVQEFDVNLLIHGHTHREAIHQQEEFTRIVLGDWRKNYASILKMDESGEFGFIKD

SEQ ID NO: 1971 - DNA, 150 bp, Haemophilus influenzae
  Name: NTH1089
gtggggaggattaatttacgcgtcgcttcgcttaccgaaagaaaactaatcctaaaattaaccgcacttttatctgtatctaaaagttgggcttatccaccagcttttaggtacgattttatggataagtattattctagtatcattaag

SEQ ID NO: 1972 - protein, 50 aa, Haemophilus influenzae
  Name: NTH1089
VGRINLRVASLTERKLILKLTALLSVSKSWAYPPAFRYDFMDKYYSSIIK

SEQ ID NO: 1973 - DNA, 117 bp, Haemophilus influenzae
  Name: NTH1090
ttgatgaaactaaaggagaataaaatgactactggcgcaattattatgatgatcatagcccttactttattgtggggaggattaatttacgcgtcgcttcgcttaccgaaagaaaac

SEQ ID NO: 1974 - protein, 39 aa, Haemophilus influenzae
  Name: NTH1090
LMKLKENKMTTGAIIMMIIALTLLWGGLIYASLRLPKEN

SEQ ID NO: 1975 - DNA, 597 bp, Haemophilus influenzae
  n 3: n is any nucleotide
  Name: NTH1091
ttngctttcccacccatctcaccaaaggcccccttgggcgaagtgctaggcatgttattcttgggtgcattaacctttgcgccatggacttcattcatctcagttatcgaagtaattattccggcatttcaagataaatttcgtattagccgtggaaaagtgacattcatcgtgggtgtaccaatgatgctagtttctgtcatcttattcggtacaacaactggcttaccgatgttagatgtgttcgataaatttgtgaactatttcggtattgttgccgtagcatttgcgtctttaattgcgattgtagcaaatgaaaaactcggtttattgggtaatcacttaaatgaaacgtcatctttcaaagtgggtttcttctggcgtttatgcattgtattaacgagtggtgttttagcatttatgcttttcagcgaaggggcaaaagtcttctctgaaggttacgaaggctatccaaactggtttgtaaatacctttggttggggaatgtcgattagcttacttgtcgtggcatttttcctttctcgcttaaaatggaaaagcgaaaccaaattaacgattgatgaaactaaaggagaa

SEQ ID NO: 1976 - protein, 199 aa, Haemophilus influenzae
  Xaa 1: Xaa is any amino acid
  Name: NTH1091
XAFPPISPKAPLGEVLGMLFLGALTFAPWTSFISVIEVIIPAFQDKFRISRGKVTFIVGVPMMLVSVILFGTTTGLPMLDVFDKFVNYFGIVAVAFASLIAIVANEKLGLLGNHLNETSSFKVGFFWRLCIVLTSGVLAFMLFSEGAKVFSEGYEGYPNWFVNTFGWGMSISLLVVAFFLSRLKWKSETKLTIDETKGE

SEQ ID NO: 1977 - DNA, 651 bp, Haemophilus influenzae
  n 638, 639, 640, 641, 642: n is any nucleotide
  Name: NTH1092
ttgaagatgctggatttgacgccacagagtaaaaaaatttcaattcagattggtgggatgacctgccaatcttgtgccaatcgcattgaaaaagttttaaataaaaaaccatttgtgcaacaagcgggagtgaattttgccgtcgaagaagcacaagttgtatttgacgctacgcaagcaagcgaaactcaaattatcgagattatccataaaacaggtttttctgctcatatcaaacaagccaatgaattaccaatagaagaaaatacatcaatcccttggcgattaatcatactttggataatcaatattccatttctgattggaatgcttggtatgataggtggctcccatcacttaatgttaccgccgatttggcaatttgcattagcaagcattgtgcaactttggttagccattccattttattgcggagcaatcggtagtattcgtggtggacttgccaatatggatgtccttgtcagcacaggaacgctcactatttatctttattctgctttcatgttgttttaccacgccgatcatgcaatggggcatgtgtattttgaagcttctgtaatggtaattggttttgtcagtcttggaaaattttctgaagatcgcactaaaaagcatannnnnttaattaat

SEQ ID NO: 1978 - protein, 217 aa, Haemophilus influenzae
  Xaa 213, 214: Xaa is any amino acid
  Name: NTH1092
LKMLDLTPQSKKISIQIGGMTCQSCANRIEKVLNKKPFVQQAGVNFAVEEAQVVFDATQASETQIIEIIHKTGFSAHIKQANELPIEENTSIPWRLIILWIINIPFLIGMLGMIGGSHHLMLPPIWQFALASIVQLWLAIPFYCGAIGSIRGGLANMDVLVSTGTLTIYLYSAFMLFYHADHAMGHVYFEASVMVIGFVSLGKFSEDRTKKHXXLIN

SEQ ID NO: 1979 - DNA, 204 bp, Haemophilus influenzae
  Name: NTH1093
atgaaaactatcacattaaacataaaaggcatacattgcggctgttgcgtaaaaagtcttactcaagttttaactgaattagatggcgtacaatctgctgatgtgcaattagagggtaaagcaaatattacttttgatgaaaatcgagtcaatgttgcacagttgattgaggtcattgaagatgctggatttgacgccacagag

SEQ ID NO: 1980 - protein, 68 aa, Haemophilus influenzae; identical to SEQ ID NO: 370
  Name: NTH1093

SEQ ID NO: 1981 - DNA, 204 bp, Haemophilus influenzae; identical to SEQ ID NO: 369
  Name: NTH1094

SEQ ID NO: 1982 - protein, 68 aa, Haemophilus influenzae; identical to SEQ ID NO: 370
  Name: NTH1094

SEQ ID NO: 1983 - DNA, 204 bp, Haemophilus influenzae; identical to SEQ ID NO: 369
  Name: NTH1095

SEQ ID NO: 1984 - protein, 68 aa, Haemophilus influenzae; identical to SEQ ID NO: 370
  Name: NTH1095

SEQ ID NO: 1985 - DNA, 432 bp, Haemophilus influenzae
  Name: NTH1096
ttgttaaactataaacctttacataaggttaaggtcaagaagttttttatgaatattagtgaagccgcaaaattagtaggtttatctacaaaacaaatccgtgattatgaaaaaatggggttaattaaacccgctgttcgcagtttgtcaggctatcgaaattatggagaaagtgatttagaaaggttgcattttattcgacactcacgcaatgttggattttcgttacatcaaatcgcacaattattagcactacaagataatcctaagcgtagctgccgagaagtgaaagtgctaactgctcaacatattgcgacattaaatcaacaaatagaacagttacaaaaaatggtacaaaaattgcagcactggcacgacagttgtcaaggcaatggcaaccctgaatgttcaattttgaatggcttgaacgga

SEQ ID NO: 1986 - protein, 144 aa, Haemophilus influenzae
  Name: NTH1096
LLNYKPLHKVKVKKFFMNISEAAKLVGLSTKQIRDYEKMGLIKPAVRSLSGYRNYGESDLERLHFIRHSRNVGFSLHQIAQLLALQDNPKRSCREVKVLTAQHIATLNQQIEQLQKMVQKLQHWHDSCQGNGNPECSILNGLNG

SEQ ID NO: 1987 - DNA, 315 bp, Haemophilus influenzae
  Name: NTH1097
atggcggattgggacggaaaatatatcagcccttatgcagaacatggcaaaaaaagtgagcaagtcaaaaaaattacagtatccattcccattaaagtactggaaattttgacgaatgaacgcactcgccgccaattgaaaagtttacgtcacgcaactaacagtgaattgctttgtgaagcgttcttacacgcattcacagggcagcctttgcccactgatgcagatttaatgaaagagcgtaatgatgaaattcccgaagatgccaaagtgcttatgcgtgaattaggcgtcgatccagaaagttgggaatat

SEQ ID NO: 1988 - protein, 105 aa, Haemophilus influenzae
  Name: NTH1097
MADWDGKYISPYAEHGKKSEQVKKITVSIPIKVLEILTNERTRRQLKSLRHATNSELLCEAFLHAFTGQPLPTDADLMKERNDEIPEDAKVLMRELGVDPESWEY

SEQ ID NO: 1989 - DNA, 327 bp, Haemophilus influenzae
  n 318, 319, 320, 321, 322: n is any nucleotide
  Name: NTH1098
atgcatttaacagaacttaaaaatacgcctgtttctgatcttgtgaaactcggcgaggagcagatgggcttagaaaatttagcgcgtttgcgtaaacaagatattgtctttgcaatcttaaaacagcacgccaaaagtggcgaagatattttcggcggtggcgtgctagaaattttaccagatggttttggtttcttcgttctgccgacagttcctaccttgcaggccctgatgatatttatgtttccccaagtcaatgccgtcgttttatcttcaaatggggtaaaggggtaccgagtccgatattcgtataccatnnnnnttaat

SEQ ID NO: 1990 - protein, 109 aa, Haemophilus influenzae
  Xaa 106, 107, 108: Xaa is any amino acid
  Name: NTH1098
MHLTELKNTPVSDLVKLGEEQMGLENLARLRKQDIVFAILKQHAKSGEDIFGGGVLEILPDGFGFFVLPTVPTLQALMIFMFPQVNAVVLSSNGVKGYRVRYSYTXXXN

SEQ ID NO: 1991 - DNA, 951 bp, Haemophilus influenzae
  Name: NTH1100
atggaacttggccctcgtgataaggtttctcaagcattctggcaagaatggaaaaaaggtaataccttaaaaactgcgaaaggcgtagatgtggtgcatttagatttacgtcatcttggtgaaaaatatttacatgagcgtctgccattcatttgtgaattagcaagtgcttatgaaggtgtaaatccagtaaatgaaccaattccagttcgtccagttgttcactacaccatgggcggtattgaagtcgatttcaatagcgaaacacgtatcaaaggtttatttgctgtaggagaatgcgcatcttcaggtttacatggtgcaaatcgtttaggatctaactctttagctgaacttgttgtgttaggtcgcgttgcaggggaatatgcggcacaacgtgcagttgaagctcaatcggtaaatcaaagtgcggttgatgctcaagcaaaagatgttgttgctcgcctagaagctcttcacaaacaagaaggtaatgaatcttggtctgaaatccgtgatgaaatgggtaccgtgatggaagaaggctgtggtatttaccgtgaccaagcaagtatgcaaaaagcagtagataaaattgcagagttaaaagaacgttacaaacgtattcgcgtatcagataattcaagcgtgttcaatacagatgtactttacaccgttgagttgggttacattctagatgttgcacaatctattgcaaattcagcgattgaacgtaaagaatctcgtggtgctcaccaacgcttagattacacagaacgtgacgatgtcaattatttaaaacacacacttgctttctacaatgagaatggtgcgccgcgcattgaatacagtccggtgaaaattactaaatctcaacctgcaaaacgtgtttacggtgcggaagcagaagctcaagaagcagctgcgaaagctaaggagcaagcaaatggc

SEQ ID NO: 1992 - protein, 317 aa, Haemophilus influenzae
  Name: NTH1100
MELGPRDKVSQAFWQEWKKGNTLKTAKGVDVVHLDLRHLGEKYLHERLPFICELASAYEGVNPVNEPIPVRPVVHYTMGGIEVDFNSETRIKGLFAVGECASSGLHGANRLGSNSLAELVVLGRVAGEYAAQRAVEAQSVNQSAVDAQAKDVVARLEALHKQEGNESWSEIRDEMGTVMEEGCGIYRDQASMQKAVDKIAELKERYKRIRVSDNSSVFNTDVLYTVELGYILDVAQSIANSAIERKESRGAHQRLDYTERDDVNYLKHTLAFYNENGAPRIEYSPVKITKSQPAKRVYGAEAEAQEAAAKAKEQANG

SEQ ID NO: 1993 - DNA, 828 bp, Haemophilus influenzae
  Name: NTH1101
gtgtttacggtgcggaagcagaagctcaagaagcagctgcgaaagctaaggagcaagcaaatggctaattcaccagtaatgaatgttgaagtattacgctacaatcctgaaatcgatcaagagccacatttaagcacctatcaagtaccttatgataatcaaacttcattgcttgatgcgttaggctatattaaggataaacttgaaccatctctttcttatcgttggtcttgccgtatggcgatctgcggttcttgcgggatgatggtaaataacaaaccaaaattggcttgtaaaacgttcttacgtgattacagcggccatatgcgtattgagccgttagcaaacttcccaattgaacgtgacttagtggttgatttaagccactttatcgaaagtttagaggcaattaagccttatattattggtaacgaagcaccagcattagatggtaaaccacatccatcgaaagaattgcaagttagccgtactaaacaaacgccagcacagcttgagaaatatcgtcaattctcaatgtgtatcaactgtggtttatgctatgccgcttgccctcaatttggtttaaatcctgaattcttaggccctgcagctattacgatggctcaccgttataatcttgataaccgtgaccatggtaaagcaaaacgtatgtcattattaaatggtaaaaacggggtttggagttgtactttcgttggctattgctcagaagtttgtccaaaacatgtggatcctgcttctgcaattaaccaaggcaaagtggaaagtgccaaagattatgttatctctatgctaaaaccaaaaggc

SEQ ID NO: 1994 - protein, 276 aa, Haemophilus influenzae
  Name: NTH1101
VFTVRKQKLKKQLRKLRSKQMANSPVMNVEVLRYNPEIDQEPHLSTYQVPYDNQTSLLDALGYIKDKLEPSLSYRWSCRMAICGSCGMMVNNKPKLACKTFLRDYSGHMRIEPLANFPIERDLVVDLSHFIESLEAIKPYIIGNEAPALDGKPHPSKELQVSRTKQTPAQLEKYRQFSMCINCGLCYAACPQFGLNPEFLGPAAITMAHRYNLDNRDHGKAKRMSLLNGKNGVWSCTFVGYCSEVCPKHVDPASAINQGKVESAKDYVISMLKPKG

SEQ ID NO: 1995 - DNA, 396 bp, Haemophilus influenzae
  Name: NTH1102
gtgagtaaacgtaaaaaatatgttcgtccaatgacagcgacttggtggcaaaaattggacttctacaaagcttatatgctacgtgaagcgacttcagtctttgctgtatggttttgtattgtattgctttatggtgttctttgtcttgcaagcaatccaatgccaggcttaggcatattgagctttattgagtttttaagaaaccctattgtggtgttcttaaatattattacgcttatcgcaacgctttatcatacggtgacatatttcttaatgacaccaaaagtgatgaatatcattgtgaaaaatgaacgcttaccacacactgttgtaagaaatgcactttgggcggtaaccacattagttagcgtgattgcgttagttttagtttatatt

SEQ ID NO: 1996 - protein, 132 aa, Haemophilus influenzae
  Name: NTH1102
VSKRKKYVRPMTATWWQKLDFYKAYMLREATSVFAVWFCIVLLYGVLCLASNPMPGLGILSFIEFLRNPIVVFLNIITLIATLYHTVTYFLMTPKVMNIIVKNERLPHTVVRNALWAVTTLVSVIALVLVYI

SEQ ID NO: 1997 - DNA, 342 bp, Haemophilus influenzae
  Name: NTH1103
atggttgatcaaaatccaaaacgctccggcgaaccgccagtatggttaatgttcggtgcaggtggcacagtgagtgcaatttttcttcctgtcgttattctaatcatcggtttgttattaccatttggtttagtcgatgcgcataatttaattacttttgcttattcttggattggtaaattagttattttagtgcttactattttcccaatgtggtgtggtttacaccgtattcatcacggtatgcacgatcttaaagtacatgtgccagctggtggatttatcttttacggtttagccacaatttatacccgttgggtattatttgcggtaataaacctg

SEQ ID NO: 1998 - protein, 114 aa, Haemophilus influenzae
  Name: NTH1103
MVDQNPKRSGEPPVWLMFGAGGTVSAIFLPVVILIIGLLLPFGLVDAHNLITFAYSWIGKLVILVLTIFPMWCGLHRIHHGMHDLKVHVPAGGFIFYGLATIYTRWVLFAVINL

SEQ ID NO: 1999 - DNA, 354 bp, Haemophilus influenzae
  Name: NTH1104
atgccaattaaagagcctgatgtgtgggcgttaatatggtcttggttgcaaacaaatcttagttctagctcagcacagagtgctttttgggcgttatttatttctcttttaagatttgggtttatgcgtaaaaagccagctattcgttatgttttaattgatgcggctatgtgtgcatccattgcgggtgttgcagtgccaatttgtacgcatttatttgggcatacagaatattcttcatttcttggcacgatgattggttttgttggtactgaaaaaattcgcgagtttttatttaaattcattaatcggagaattgaaaaagatgacaatgatgatttccgaagtgacatt

SEQ ID NO: 2000 - protein, 118 aa, Haemophilus influenzae
  Name: NTH1104
MPIKEPDVWALIWSWLQTNLSSSSAQSAFWALFISLLRFGFMRKKPAIRYVLIDAAMCASIAGVAVPICTHLFGHTEYSSFLGTMIGFVGTEKIREFLFKFINRRIEKDDNDDFRSDI

SEQ ID NO: 2001 - DNA, 600 bp, Haemophilus influenzae
  Name: NTH1105
atgacaatgatgatttccgaagtgacatttaataaaatttttccacacgcagttaaaggtgtttatcaagctatttcggcgcagatagaaaaagcaggttgtgtgaataagatgcagcaagcgatgtttttggctcaatgtggacatgaaagtggcggatttacaagatttaaagaaaatttaaattattcttggcttgggctttctaaaactttccgtaaatatttcccagaccctcttatagcgaagaaatatgagcgcaaacctgaacttattgccaatcgtgtttatgctaatcgtctaggtaatggcgatgagaaaagtggagatggttggaagtatcgtggtcgtggactgattcagatcacaggtaaggataattatgccgcgtttagaaaatggttaggtagagatattgagccagatgatgtggcagggaatttagatttatctgttaaaactgcagtgtggtattggaaatgctatgagttggctgagcttaattctgtggaaaaagttacgcgaagaattaatggtggactaaatggcattgatgagcgttgcaagctctatcgagcattaatggtaacggataatgac

SEQ ID NO: 2002 - protein, 200 aa, Haemophilus influenzae
  Name: NTH1105
MTMMISEVTFNKIFPHAVKGVYQAISAQIEKAGCVNKMQQAMFLAQCGHESGGFTRFKENLNYSWLGLSKTFRKYFPDPLIAKKYERKPELIANRVYANRLGNGDEKSGDGWKYRGRGLIQITGKDNYAAFRKWLGRDIEPDDVAGNLDLSVKTAVWYWKCYELAELNSVEKVTRRINGGLNGIDERCKLYRALMVTDND

SEQ ID NO: 2003 - DNA, 321 bp, Haemophilus influenzae
  Name: NTH1106
atgactaagtacatttacatggcgttagcgggtgttgtcgtggttttgattggtgcattgcgttaccaatctagcgttatagatgagttggaaataacgacaaaacaacaagaaaatactatccagcaacaagaagatgctaacaaatcattaagtcttgcgttacaacaagagcgttatgccattattgagcaacaagagcgtaataatgaaatagaaaggatagcaacagaaaatgctgaatcagttaaaacaatcattaagactcaaccttgtgctcacactcgtttgcctcagtctgttcttgaccgcttgcacgaa

SEQ ID NO: 2004 - protein, 107 aa, Haemophilus influenzae
  Name: NTH1106
MTKYIYMALAGVVVVLIGALRYQSSVIDELEITTKQQENTIQQQEDANKSLSLALQQERYAIIEQQERNNEIERIATENAESVKTIIKTQPCAHTRLPQSVLDRLHE

SEQ ID NO: 2005 - DNA, 210 bp, Haemophilus influenzae
  Name: NTH1107
ttgaccgcttgcacgaataaaatcacgactaaaccagaatatatttatccgcctcaagcctatactgcaccttgtgtcaaaacagcatttactggggaaacatacggcgatgtagtcatacagttagttaaggtaaccgcagagcgagataagtgcgcaagccaagtagatcatcttaataagtggattaatcaagcaaaaggtggtaaa

SEQ ID NO: 2006 - protein, 70 aa, Haemophilus influenzae
  Name: NTH1107
LTACTNKITTKPEYIYPPQAYTAPCVKTAFTGETYGDVVIQLVKVTAERDKCASQVDHLNKWINQAKGGK

SEQ ID NO: 2007 - DNA, 276 bp, Haemophilus influenzae
  Name: NTH1108
atgaaccatttattaacattttatgaaaaaatcatctttaccaatccacttgagacaggtattccagaagcggttgccaaattagctttattgaacgattattctgcattgcgtgcttggcgtgaacacttaggtttaacacaagcggaagtggcaagccgtttaggcatttctcaagctgcttattcacaacacgaaaattcacagaccttgcgtaaaagcactcgcattaaaatagcgacagcacttggcattaattccgctcaattagatttt

SEQ ID NO: 2008 - protein, 92 aa, Haemophilus influenzae
  Name: NTH1108
MNHLLTFYEKIIFTNPLETGIPEAVAKLALLNDYSALRAWREHLGLTQAEVASRLGISQAAYSQHENSQTLRKSTRIKIATALGINSAQLDF

SEQ ID NO: 2009 - DNA, 510 bp, Haemophilus influenzae
  Name: NTH1109
atgtcagacgtgaaaggaaaatctacgtctggtcgtggattaacacctaaacaagaaaaattttgccagctttatattgagctggggaatgccagtgaagcatatcggcagagttatgattgccaagatatgaagtccgaaagtataaaccgattggctaaaaaagaattagataagatcaagattagatcaagggttgatgtgcttcaacaagagcaccgacaacgccataatcttaccctagataatatcattgcggacttgcaagagtatcgtgatatttgtatgggaagaaagccacttactattaccactgtggtaaaaaatgctcaagaaggaacggcacaaagcgttaataccgaatgtttcgtttttgaaccgacaggtgcaaataaagcccttgaattgcttgggaagcatttagggatgtttaccaataaagttgatgtaacaactgatggcaagcccttacctactgtgattaatgtgacatttagcgatgagccagct

SEQ ID NO: 2010 - protein, 170 aa, Haemophilus influenzae
  Name: NTH1109
MSDVKGKSTSGRGLTPKQEKFCQLYIELGNASEAYRQSYDCQDMKSESINRLAKKELDKIKIRSRVDVLQQEHRQRHNLTLDNIIADLQEYRDICMGRKPLTITTVVKNAQEGTAQSVNTECFVFEPTGANKALELLGKHLGMFTNKVDVTTDGKPLPTVINVTFSDEPA

SEQ ID NO: 2011 - DNA, 426 bp, Haemophilus influenzae
  n 417, 418, 419, 420, 421: n is any nucleotide
  Name: NTH1110
atgagccagcttaatattcaatttcctacgaaattccgaccgctctttgaatctatttggccgtttattattttctacggtgggcgaggttcaggtaaaagttttagtatcgctagagcattagtattgcgagcctatcaatcgcctgttcgagttttgtgttgccgtgagatccaaaaatccatttctgattcggttattcagatgttggcagatcagattgaaatgttaggtctacaaaatttcttcgatgttcagaaaacgcaaattatcgggcaaaacggttcacgcttcacgtttgctgggctgaaaaccaacatcacatcaatcaagtcaatgacgggcattgatgtagtttgggtagaagaaggcgagaatgttcaaaagaaaggggtaccgagtcgatatcgtaaacannnnnttaat

SEQ ID NO: 2012 - protein, 142 aa, Haemophilus influenzae
  Xaa 139, 140, 141: Xaa is any amino acid
  Name: NTH1110
MSQLNIQFPTKFRPLFESIWPFIIFYGGRGSGKSFSIARALVLRAYQSPVRVLCCREIQKSISDSVIQMLADQIEMLGLQNFFDVQKTQIIGQNGSRFTFAGLKTNITSIKSMTGIDVVWVEEGENVQKKGVPSRYRKXXXN

SEQ ID NO: 2013 - DNA, 714 bp, Haemophilus influenzae
  n 709, 710, 711, 712, 713: n is any nucleotide
  Name: NTH1111
atgtcaattctaggttctatgacggatgcggtgaataaaactaaaacaccgcaagccccaacaatttccactcaatctccgacaaaagatacatcacagacaatggcaggtaatgtctctaatttattaaatagcaattcacttttaatgaatagcgcggctgctaaaggagaacgtatggcagctaatcgcggcttgcaaaattcaaccattggtgtggaatctgctcaacgtgcaatgcttgatgcggcaataccaattgcaagccaagatacgcaaaatgcgtttgcggaaaaacaaactcgcttacaagctgatttaaatttccaaaaccaaagtaagctcaatcagcaacaaaatcaattcaccgcatcgcaggcagaattagaacgcggtcatcagcgtggaatggcgcaattacaatctgatttagcttatagcaatcaaagtcgattaaatcaggcacaaaatcaattcactgcgtctcaagccgcacttgaacggcaacaacaaaaagatatggcgaatttgaatcatcaaaatgagatgaagaacttaaatgcacaagtggcggcgaacactattggtaaatccattgatttcaccatgcaaatcaccaataactttgatgcgcaaatagccacgatcttgaataactcgaatatgaaagctgaggataaaagggtaccgagtcgatatcgtataccannnnnt

SEQ ID NO: 2014 - protein, 238 aa, Haemophilus influenzae
  Xaa 237, 238: Xaa is any amino acid
  Name: NTH1111
MSILGSMTDAVNKTKTPQAPTISTQSPTKDTSQTMAGNVSNLLNSNSLLMNSAAAKGERMAANRGLQNSTIGVESAQRAMLDAAIPIASQDTQNAFAEKQTRLQADLNFQNQSKLNQQQNQFTASQAELERGHQRGMAQLQSDLAYSNQSRLNQAQNQFTASQAALERQQQKDMANLNHQNEMKNLNAQVAANTIGKSIDFTMQITNNFDAQIATILNNSNMKAEDKRVPSRYRIPXX

SEQ ID NO: 2015 - DNA, 432 bp, Haemophilus influenzae
  Name: NTH1112
ttggcacgtttgagtgactggctcactcgtaaattgacaaaaggcgtgtattcgcattgtgaaattgcagtaatgaaagaagtatttgtcagtgggcatcactatgaaacagaagtgatgtacgagtgttattcgtcttcaattcgagacggtggcgtacgttgcaagcaaattgatgtttatgatagagaaaaatgggatttaattccgctcgacggtgtaaccgaagcacaaatcaaagcctattttgaccgcactttgggctgtaaatacgactggtggggtgctgtcgggattgtgctcggcatcaaacaaaaacgatcaaaatatttttgcagtgaatggtgttttaattgcattaaaaatagcaatgaaggctggcggtttagtccgaatcagcttgctgttgcttttaccaccgtaagtaataat

SEQ ID NO: 2016 - protein, 144 aa, Haemophilus influenzae
  Name: NTH1112
LARLSDWLTRKLTKGVYSHCEIAVMKEVFVSGHHYETEVMYECYSSSIRDGGVRCKQIDVYDREKWDLIPLDGVTEAQIKAYFDRTLGCKYDWWGAVGIVLGIKQKRSKYFCSEWCFNCIKNSNEGWRFSPNQLAVAFTTVSNN

SEQ ID NO: 2017 - DNA, 600 bp, Haemophilus influenzae
  Name: NTH1114
atgaaagtctattttttaaaagaaaatttgaatagttatcaaattttccctattccgcaaaacttaaatgattttgtggaaatggaagtagaaaacgaatcagagcttgagactaaacaacttatttattttaaaagtcaatacattctagttgatagacaaccaacagaattacacaaatggaacggaaacagctggattgtcgatgaaaaaaagaaaactgaaattaagcgtgaactcattaaaaatctagttgatagcattgatgatacagcggcgaacatcagttctagatggataaggtttgccgaagagtataaggagcgagaagctgccgctattgcctttaaagaagcaaattttgctggagaagtaagcgtttatatcagcagttttgcaacggttgcaggtcttgataatcagtctgcgtcacttttgattcttcagcaagcagaaagattacgtgcattgcaacaacaattagcagtgcaaagaatgcgtaagtatgagttaaagcatgaggcgttgagtgatgaagaactgaaaaacattcatgacgatattgtttcaaaaatgcgacaactagcggaggcacaacaa

SEQ ID NO: 2018 - protein, 200 aa, Haemophilus influenzae
  Name: NTH1114
MKVYFLKENLNSYQIFPIPQNLNDFVEMEVENESELETKQLIYFKSQYILVDRQPTELHKWNGNSWIVDEKKKTEIKRELIKNLVDSIDDTAANISSRWIRFAEEYKEREAAAIAFKEANFAGEVSVYISSFATVAGLDNQSASLLILQQAERLRALQQQLAVQRMRKYELKHEALSDEELKNIHDDIVSKMRQLAEAQQ

SEQ ID NO: 2019 - DNA, 558 bp, Haemophilus influenzae
  Name: NTH1115
gtgcaattttgggttaaagcattcggcgttgttgagaacgcaggaattttagatgcgggtacacttgtgcaaaatatgcaagcgttatctgcgagggttgaccaagaaataaaagaaaataaacaatctactttacaagaaataaacaatgcaaaagttgatataaatcagcaatttttgcaggcacaaaagaatttatctcaaattggcacattaaaaacagtgtggcaaggtaatgtaagttctgggagtattaatatttcagaaaagtgttttggtaaaacacttattttgtatcttcagtcatcatcaggccacaggcttgatgataataacaatattgaaattgtcagttttgaagtaggggcagagattgaaggtaaaaggggcggtggagtttattttagtagtattcgtcaagtaattccacacagttctggtggaactagtgtgtatcatgtagaagtcgaggaattcgctgtgactgttgatagaaacggtacaacaatacacattgaagaacttgctggtcgttttgtaaaacgtattgatattcga

SEQ ID NO: 2020 - protein, 186 aa, Haemophilus influenzae
  Name: NTH1115
VQFWVKAFGVVENAGILDAGTLVQNMQALSARVDQEIKENKQSTLQEINNAKVDINQQFLQAQKNLSQIGTLKTVWQGNVSSGSINISEKCFGKTLILYLQSSSGHRLDDNNNIEIVSFEVGAEIEGKRGGGVYFSSIRQVIPHSSGGTSVYHVEVEEFAVTVDRNGTTIHIEELAGRFVKRIDIR

SEQ ID NO: 2021 - DNA, 153 bp, Haemophilus influenzae
  Name: NTH1116
atggccctttgcccgaacttttctgccgggggattaaaaaggaaaaaaggtcctatttgtggaaaatctcaccaggtgtcccccgttaaaactgatggcaatccaaaaatggcaggtaaaaacaccaaagaggacttgaaaattacccgcaat

SEQ ID NO: 2022 - protein, 51 aa, Haemophilus influenzae
  Name: NTH1116
MALCPNFSAGGLKRKKGPICGKSHQVSPVKTDGNPKMAGKNTKEDLKITRN

SEQ ID NO: 2023 - DNA, 495 bp, Haemophilus influenzae
  Name: NTH1117
ttgggttcagctgataatgatgctaatatcgccaatatggcatttactattggtgattcagcgaataccaaaacaaccattgaaaatgccgacatcactgccttagcaccaaacggtgggacagcttatttaagctccaaagatgtagaaattgaggtaaaaccaaattcagatttcacattctttgaacttcctcgtgagaaaaaccttaatcaaacaaaaattaacggcgcttctaccaaactcagtgaacgtggttttgctagactttatgacaaaattaacggtgtgcgagccagcaacttgtctgctgagcaattgaatgttacggactcaagcgaaaaaatcattaatacaaatttagtgagtagcttagatgttgaaaaacttgtttctgttgcagtttgtgatgcaggtaaaggttgcgaagaacaacaattcggcgataaaggtaataatactaaagtgagtgttggagagttagaagctgaacaa

SEQ ID NO: 2024 - protein, 165 aa, Haemophilus influenzae
  Name: NTH1117
LGSADNDANIANMAFTIGDSANTKTTIENADITALAPNGGTAYLSSKDVEIEVKPNSDFTFFELPREKNLNQTKINGASTKLSERGFARLYDKINGVRASNLSAEQLNVTDSSEKIINTNLVSSLDVEKLVSVAVCDAGKGCEEQQFGDKGNNTKVSVGELEAEQ

SEQ ID NO: 2025 - DNA, 354 bp, Haemophilus influenzae
  Name: NTH1120
atggatcgtgtttttattgaggaattgactgtttttgcacaaatcggtgtatatgattgggaacagcaaataaaacaaaaacttgtgtttgatttggaaatggcgtgggattgtaaacaagcggcagaaacggatgatgttgtatattgtttgaattatgctgaagtgagccaagcgattattgattatgtggaaagtaaatctttcttgttgattgagcgagtggcttatgaagtggcggatttgcttgagtcacgttatcaacttcaaggattaaaaattaaactgagtaaaccaaaagccgtcgcgcaagctcgaaatgttggcgtattggttatacgtggatgtttaaaa

SEQ ID NO: 2026 - protein, 118 aa, Haemophilus influenzae
  Name: NTH1120
MDRVFIEELTVFAQIGVYDWEQQIKQKLVFDLEMAWDCKQAAETDDVVYCLNYAEVSQAIIDYVESKSFLLIERVAYEVADLLESRYQLQGLKIKLSKPKAVAQARNVGVLVIRGCLK

SEQ ID NO: 2027 - DNA, 171 bp, Haemophilus influenzae
  Name: NTH1121
ttgctggagtgcaaaatgagccttttcgcccttttttatatgctttttgcctatcttttaggctcaatttccagtgcgattttaatttgtcgcattgcaggcttgcctgatcctcgtcaaaatggctcacacaacccctggggcgacaaatgtgttgcgcattggaaatcg

SEQ ID NO: 2028 - protein, 57 aa, Haemophilus influenzae
  Name: NTH1121
LLECKMSLFALFYMLFAYLLGSISSAILICRIAGLPDPRQNGSHNPWGDKCVAHWKS

SEQ ID NO: 2029 - DNA, 159 bp, Haemophilus influenzae
  Name: NTH1122
gtgagccattttgacgaggatcaggcaagcctgcaatgcgacaaattaaaatcgcactggaaattgagcctaaaagataggcaaaaagcatataaaaaagggcgaaaaggctcattttgcactccagcaagaaaaactgttcgttattctacccaaaat

SEQ ID NO: 2030 - protein, 53 aa, Haemophilus influenzae
  Name: NTH1122
VSHFDEDQASLQCDKLKSHWKLSLKDRQKAYKKGRKGSFCTPARKTVRYSTQN

SEQ ID NO: 2031 - DNA, 462 bp, Haemophilus influenzae
  Name: NTH1123
gtgttgcgcattggaaatcgtaagtctgccttggcggtgcttatttttgatatgttaaaagggatgattcctgtatgggcagggtattatttaggtttaacccaatttgaattgggaatggtcgcacttggtgcttgtttagggcatattttcccaattttctttcaatttaaaggtggcaaaggtgttgcaactgcctttggggcaatcgcaccgatttcttgggctgttgcaggttcaatgtttggtacgtggatctttgtttttcttgttagtggctattcttcattaagtgcagttatttctgcattacttgtgcctttttatgtgtggtggtttaaacctgaatttacttttcctgttgcactggtatgttgcctattaatttatcgtcatcacgataacattcaacgcttatggcgtggtcaagaagataaagtttgggctaaatttaaaaagaaa

SEQ ID NO: 2032 - protein, 154 aa, Haemophilus influenzae
  Name: NTH1123
VLRIGNRKSALAVLIFDMLKGMIPVWAGYYLGLTQFELGMVALGACLGHIFPIFFQFKGGKGVATAFGAIAPISWAVAGSMFGTWIFVFLVSGYSSLSAVISALLVPFYVWWFKPEFTFPVALVCCLLIYRHHDNIQRLWRGQEDKVWAKFKKK

SEQ ID NO: 2033 - DNA, 1014 bp, Haemophilus influenzae
  Name: NTH1124
gtgtatactaaaggttccgtttccacccgtattgcgaaatatttatttatcattcttatcgttgctggtgtgattagttctctaagtttggcaattatgagcagtaataaatatgatgccgaagccattaatatttcaggttctttgcgtatgcaaagttatcgcttactttatgaaatgcaagaacaaccagaaagcgtggaaacgaacttacgccgttatcatataagccttcattcatctgctttactagaagttcaaaatcaatttttcacaccgaatgtattaaaacattcctatcaaaacattttgcaacgttggacgaacatggaaaaatatgcacgccaacaggatgtaaaaaactatagtaagcagcttactaactatgttgcagatgttgattattttgtgtttgaattacaacgttttagtgagcagaaatggattttaggcgtttcagtattaggttttgcgatgttgttaattttgctgatggtgtcttatgtgatttggtacacaaaccgagaagttgtgaaacctttgcatttaatgacaaaagccagtatgcaagtgcaaatgcgtcaattcaatcatattccacttgacacaaggaaacaaaatgaacttggcacactggctcgcgtatttacacaaatgtccacagaactgggacagctttattcgcgtttagaagaagcggtaaacgaaaaaacgcaaaagttgcgtcaaactaaccgcactttaagcactctttatcaaagtgctcaacttctgaatacaaacacaattaacgataaaattttaaatcaagttttgcattacatttttattagcgaccatttgaacttcgttaaagtggaagtgatgggggctgaacattgggatattacattgggtaagcaagatgctaataatgaactacaaatcgaaaccctttctgtggataacgaagaattaggtgtactgtcttggcaagcaggattaccttggccagatccccgaattatgcaaaat

SEQ ID NO: 2034 - protein, 338 aa, Haemophilus influenzae
  Name: NTH1124
VYTKGSVSTRIAKYLFIILIVAGVISSLSLAIMSSNKYDAEAINISGSLRMQSYRLLYEMQEQPESVETNLRRYHISLHSSALLEVQNQFFTPNVLKHSYQNILQRWTNMEKYARQQDVKNYSKQLTNYVADVDYFVFELQRFSEQKWILGVSVLGFAMLLILLMVSYVIWYTNREVVKPLHLMTKASMQVQMRQFNHIPLDTRKQNELGTLARVFTQMSTELGQLYSRLEEAVNEKTQKLRQTNRTLSTLYQSAQLLNTNTINDKILNQVLHYIFISDHLNFVKVEVMGAEHWDITLGKQDANNELQIETLSVDNEELGVLSWQAGLPWPDPRIMQN

SEQ ID NO: 2035 - DNA, 675 bp, Haemophilus influenzae
  Name: NTH1125
atgggtcgtgaagcaataaggggcaaagctgggaaaaggtatggagatcggggggtggaaaaagtaagcaaccatgggatcgaagatagcacggggcggagttatgcactcgatccgctttccttgccttccgctcgctcccaaggcgaaccacttacaggtaaactcaatttacccactggtgcgaccattgaatatgttgtaatggccagcgaacagcaagaattattgatggcttctgatgcaggatatggttttatttgtaaatttgaagatttaattgcacgtaacaaggctggaaaagccttgatttctttaccagaaaatgccaaagtgttgaagcctaaaacattgataaattctaccgcacttgttgtcgcaatcacatcagcaggcagaatgttgatttttccagcacaagatttaccggtattatcaaaaggtaaaggcaataaaatgatcactattcccgcagcgaatgcaaaagatcgtagcgaactattgacaaaattattgcttatttcagatcaagcaagtcttgaattttattctggaaaacgaaaaattgtattaaaaccagaagatctgcaaaagttccgcgcagaacgaggcagaaaaggttcgacattaccacgtggattacataccaatcttgaaattatggtagtcgagccg

SEQ ID NO: 2036 - protein, 225 aa, Haemophilus influenzae
  Name: NTH1125
MGREAIRGKAGKRYGDRGVEKVSNHGIEDSTGRSYALDPLSLPSARSQGEPLTGKLNLPTGATIEYVVMASEQQELLMASDAGYGFICKFEDLIARNKAGKALISLPENAKVLKPKTLINSTALVVAITSAGRMLIFPAQDLPVLSKGKGNKMITIPAANAKDRSELLTKLLLISDQASLEFYSGKRKIVLKPEDLQKFRAERGRKGSTLPRGLHTNLEIMVVEP

SEQ ID NO: 2037 - DNA, 492 bp, Haemophilus influenzae
  Name: NTH1126
gtgaatgttccgattatcggaattgtaaaacgtgatttgcctgatagtcccgtgcgtattacgccgtttttacaagatattgaagatctagccaatgcaggtgcggatattattgcagtagatggcacgagccgcccacgtcctgtggatattgaaagtgcggtgaaaaaaatccacgaaatgggctgtttggcaatggcagattgttctaatttagaagaaggcttgtattgtaaagcgcttggttttgatattgtcggcagtacgatgtcgggttatacaggtggcgcagtgccagaagaaccagattatcaattagtgaaagatttaaaatcagcgggttgttttgtgatggctgaggggcgttataacacaccagaattggcaaaagtggcaattgaaattggtgcagattgcgtgactgtaggttcagccttaactcgtcttgaacatattgtgagttggtttgctaattcagtgaaatctgcaaga

SEQ ID NO: 2038 - protein, 164 aa, Haemophilus influenzae
  Name: NTH1126
VNVPIIGIVKRDLPDSPVRITPFLQDIEDLANAGADIIAVDGTSRPRPVDIESAVKKIHEMGCLAMADCSNLEEGLYCKALGFDIVGSTMSGYTGGAVPEEPDYQLVKDLKSAGCFVMAEGRYNTPELAKVAIEIGADCVTVGSALTRLEHIVSWFANSVKSAR

SEQ ID NO: 2039 - DNA, 417 bp, Haemophilus influenzae
  Name: NTH1127
atgcgttgtttagcactagatattggtgggacaaaaattgcagcggcgattgtaaaaaatggcgaaattgagcaacgtcagcaaattcatacaccacgtgaaaatgtcgtggagggaatgcaccaagcgttaggcaaattgcttgctgattatgaagggcagtttgattatgtagcggtagcatctacggggattatcaataatggtattttaagtgcattaaatccgaaaaacttaggtggcttggcggaatttccacttaaagcgagtattgcaaaacatacggataaaccgattggtttattaaatgatgcacaagctgcgacttatgcggaatatcaattgcaaaattttgaacaggtatcaaatttttgtttttattaccgtttcaacaggagttggcggaggggattgtgc

SEQ ID NO: 2040 - protein, 139 aa, Haemophilus influenzae
  Name: NTH1127
MRCLALDIGGTKIAAAIVKNGEIEQRQQIHTPRENVVEGMHQALGKLLADYEGQFDYVAVASTGIINNGILSALNPKNLGGLAEFPLKASIAKHTDKPIGLLNDAQAATYAEYQLQNFEQVSNFCFYYRFNRSWRRGLC

SEQ ID NO: 2041 - DNA, 165 bp, Haemophilus influenzae
  n 5, 18, 27, 28, 30, 152, 153, 154, 155, 156: n is any nucleotide
  Name: NTH1129
atggntgcgatctgtggntggtggcgnncnaaggttggtgtcaaagcgattgcttcagggcgagcattggaaacagtttcttccatggggaagacccggcgatcccaaagaatgtttgagcggttaaaaaaaatgatgaaaaacgaccgccnnnnnttaattaat

SEQ ID NO: 2042 - protein, 55 aa, Haemophilus influenzae
  Xaa 2, 10, 51, 52: Xaa is any amino acid
  Name: NTH1129
MXAICGWWRXKVGVKAIASGRALETVSSMGKTRRSQRMFERLKKMMKNDRXXLIN

SEQ ID NO: 2043 - DNA, 1296 bp, Haemophilus influenzae
  Name: NTH1130
ttgaaaaaaaaccccctcaattttgcgatgaaaaatgcgaatgttgtcacggcatttaatattgtgcgtaccgcacttttttaccgtattagagggcaacatcgccatcctcgtacccagagaatgttacgttattattttgctgcgcaagatattcacgaacgcgccaattctacgcattttgattatcaacaaataacggaaaaactaaaaaatacagatttgattttccgtattcaacgtttgttagaactacaagcacaatcctgtaaagaaatcacggcgagtttgcgtgaaaataaaccttatcattttaatgaacgtgtcgaacgtgcgcttttaggcaccttgcattcctttgaactgtatcgaacacaacatctcaatgatcaagatgaactgattgatattcaaaccttgttagataatttacaaagcattaactggcaacttcgccagttagcacaagaaacgacggatacagaacaattagctcaaattcatacggaacaaatcactgggttaaaaaatataagtgcggtgatttttagccattttacgtttgagtcaccgttgttccgacatgcggtacgcttatctattgtggtatttctgtgctgtgcaattgttgagtttttccaatttaatcttggttattggattttattgaccactgtatttgtgtgccagccaaactattctgcaactaaagtacgtttacgtcagcgtattattggcacgatattaggcgtagtggtagggtctctattaccttatttaaatccaaccttagaattaaaacagggtcttgtggtgctcacaagtactttgttctttttcttccgtagtaataattatagtttctcgacctttttcatcacactacaagtattgctcagttttgatgtcatgggatttgatacggcagctgcgttgatgcctcgtttacttgatactttacttggtgccgcgatttcatggtttgccgtatcttacttatggccagattggaaatatttgcaacttgataaagtgagccatcaagcattgcgtagtgatgcggtgtatttattgcatattattagtcaattgcaatttggtaaaagcgacgatcttaaatatcgcatagcacgtcgcaatgcacatcaatatgcagccgcactgagtacaacactttccaatatgaataatgaaccagtgaaatacaaggcatatttacaaaaaggttttgatttactcaaactgaattattctctattaagctatattcagcactgggagcttatcgagacagaa

SEQ ID NO: 2044 - protein, 432 aa, Haemophilus influenzae
  Name: NTH1130
LKKNPLNFAMKNANVVTAFNIVRTALFYRIRGQHRHPRTQRMLRYYFAAQDIHERANSTHFDYQQITEKLKNTDLIFRIQRLLELQAQSCKEITASLRENKPYHFNERVERALLGTLHSFELYRTQHLNDQDELIDIQTLLDNLQSINWQLRQLAQETTDTEQLAQIHTEQITGLKNISAVIFSHFTFESPLFRHAVRLSIVVFLCCAIVEFFQFNLGYWILLTTVFVCQPNYSATKVRLRQRIIGTILGVVVGSLLPYLNPTLELKQGLVVLTSTLFFFFRSNNYSFSTFFITLQVLLSFDVMGFDTAAALMPRLLDTLLGAAISWFAVSYLWPDWKYLQLDKVSHQALRSDAVYLLHIISQLQFGKSDDLKYRIARRNAHQYAAALSTTLSNMNNEPVKYKAYLQKGFDLLKLNYSLLSYIQHWELIETE

SEQ ID NO: 2045 - DNA, 153 bp, Haemophilus influenzae
  Name: NTH1131
atgaaaatttgcacagaccgcacaggtttttatctggttttttatcctggggcaaagaaaatttattataccttaaaaaccattgaagaatacccgagctattttaaccaacgccagaaagatcgaaaccatttaaagaatgggaaaacagac

SEQ ID NO: 2046 - protein, 51 aa, Haemophilus influenzae
  Name: NTH1131
MKICTDRTGFYLVFYPGAKKIYYTLKTIEEYPSYFNQRQKDRNHLKNGKTD

SEQ ID NO: 2047 - DNA, 606 bp, Haemophilus influenzae
  n 411, 436: n is any nucleotide
  Name: NTH1132
atgcaagcgagacgagacaccaagattgtcgatgaaaatcacacattacaacaagcatttttaaacgatttagacgaaaaactttggtcatctgcggataaactccgccaacaacttgatgccgccaactataaacatatcgttcttggtctcatcttcttaaaatacatttctgataatttcactcatcaacaggaaaaaattcaggcagaactttctgatgctgaaaatcccctctatcttgaccgcactttttttgatactgaagaagaatatcaagaagctttaaccgcagaactagaaaaccgtgattattacaccgcggataacgtattttgggtgcccgcttctgcacgttggcaagccttacaagaagtctctattctcaacactggtgcagaattaccttgnggtggtaaattctcaggcgtggcanaactgattgatgatgcctttgatgccattgaaaaagacaacgaaaaactcaaaggcgtcctccaacgcatcagcggctatgccgtaaacgaagacaccctgcgcgggctgattatcctcttctccgatactaactttacccgcccgattacaacggcgagcccgtacatt

SEQ ID NO: 2048 - protein, 202 aa, Haemophilus influenzae
  Xaa 137, 146: Xaa is any amino acid
  Name: NTH1132
MQARRDTKIVDENHTLQQAFLNDLDEKLWSSADKLRQQLDAANYKHIVLGLIFLKYISDNFTHQQEKIQAELSDAENPLYLDRTFFDTEEEYQEALTAELENRDYYTADNVFWVPASARWQALQEVSILNTGAELPXGGKFSGVAXLIDDAFDAIEKDNEKLKGVLQRISGYAVNEDTLRGLIILFSDTNFTRPITTASPYI

SEQ ID NO: 2049 - DNA, 780 bp, Haemophilus influenzae
  Name: NTH1135
atgaatatggcgattcgcggcattgattacgacttcggcaaacacaacgccgacagtttcacccagccgcaacacatcgacaaaaagatggatttcattatggcaaacccgccattcaatatcagcgattggtggagcgaatcccttgccgatgatccacgttgggcatacggcacaccacccaaaggcaacgccaacttcgcttggctgcaacacatgatttaccacctctcacccaacggcaaaatggcattattgcttgccaacggctccatgagcagccaaaccaacaacgaaggcgaaatccgcaaagccatcatcaatgccgacttggtcgaatgtatggttgccctgcccggtcagctcttcaccaacacccaaatccctgcctgtatttggtttttaaaccgcaacaaaaaacgcaaaggcgaagtgttgtttatcgatgcccgccaaatcggctatatgaaagaccgcgtattgcgtgatttcaccgctgacgacatcgccaaaattgccgacaccctccacacttggcaaaaatcagacggctatgaagaccaagccgctttctgtaaatccgctacgttagaagagattaaagacaacgacttcgtcctcacaccagggcgctatgtcggcaccgcagaacaagaagatgacggcgtgccatttgcagaaaaaatgcaaaatctgaccgctcttttgaaggagcaatttgcgaaaagtgcggaattggaagcagaaattaagaagaatttagggggattggggtatgag

SEQ ID NO: 2050 - protein, 260 aa, Haemophilus influenzae
  Name: NTH1135
MNMAIRGIDYDFGKHNADSFTQPQHIDKKMDFIMANPPFNISDWWSESLADDPRWAYGTPPKGNANFAWLQHMIYHLSPNGKMALLLANGSMSSQTNNEGEIRKAIINADLVECMVALPGQLFTNTQIPACIWFLNRNKKRKGEVLFIDARQIGYMKDRVLRDFTADDIAKIADTLHTWQKSDGYEDQAAFCKSATLEEIKDNDFVLTPGRYVGTAEQEDDGVPFAEKMQNLTALLKEQFAKSAELEAEIKKNLGGLGYE

SEQ ID NO: 2051 - DNA, 1086 bp, Haemophilus influenzae
  Name: NTH1137
atgagtaaaattccattaaatgaatttataactttacagcgtggatttgatttaccaagtaacaaaagaatttcaggaagtgttcccgttgttgcttcaacagggattgctggttatcacaatgaaattaaagttaaagcacctggagttgtaattggaagaagcggaagtattggtggtggacaatatattgaaaaagattttttccctttaaatacaacattatatgtaaaagatttcaaaggacattatcccagatttatttattacttattaaaaagtattgatttcacaagttttaatgtaggaacaggtgttcctacattaaatcgaaaccatttatcaagcattttaatttcagatttgggaattgagaaagaaaaagaaattgccaacatcttaggaagtcttgaccaaaaaatccaactcaacacccaaatcaaccaaaccttggaacaaatcgcccaagccctgtttaaaagctggtttgtcgatttcgacccagtgcgtgccaaagttcaagccctttcagacggcctgagccttgaacaagcagaacttgccgccatccaggcaatcagcggaaaaacacccgaagaactgaccgcactttcacaaacacagcctgaacgctacgccgaactagccgaaaccgccaaagcgtttccgtgtgagatggtggaggttgatggggttgaagtgccgaaggggtgggaggttaaagccttagatgaaattgcaaattatcagaatggtttagcattgcaaaaattccgccctgaagatgacgaaccatttttacctgttgtaaaaattgcccaattgagacaaggttatgcagatggcgatgaaaaagcaaaagcaaatattaagcctgaatgcattattgataatggtgatgtcattttttcttggtctggtagtttattagtagatatttggtgtggaggtaaagctgctttaaaccaacatttattcaaagtctcatccaaagaatatcctaaatggttctattatttttataccaaacatcatttaaccgaatttcagcgtattgcttatgacaaagcagtgacaaggggcata

SEQ ID NO: 2052 - protein, 362 aa, Haemophilus influenzae
  Name: NTH1137
MSKIPLNEFITLQRGFDLPSNKRISGSVPVVASTGIAGYHNEIKVKAPGVVIGRSGSIGGGQYIEKDFFPLNTTLYVKDFKGHYPRFIYYLLKSIDFTSFNVGTGVPTLNRNHLSSILISDLGIEKEKEIANILGSLDQKIQLNTQINQTLEQIAQALFKSWFVDFDPVRAKVQALSDGLSLEQAELAAIQAISGKTPEELTALSQTQPERYAELAETAKAFPCEMVEVDGVEVPKGWEVKALDEIANYQNGLALQKFRPEDDEPFLPVVKIAQLRQGYADGDEKAKANIKPECIIDNGDVIFSWSGSLLVDIWCGGKAALNQHLFKVSSKEYPKWFYYFYTKHHLTEFQRIAYDKAVTRGI

SEQ ID NO: 2053 - DNA, 678 bp, Haemophilus influenzae
  Name: NTH1138
atgaaaaatattcaaaaaatcttaccgctttactttgtggcaggcacgcaagattgccgtcatttgggcgagaacttgtcggaaaatttattattcgtgctaaaacaagcgttagaaggcggaattacctgctttcaatttcgggataaaggcaaattttcgttagaacatacgccctcagcacagaaggcactggcgatgagttgtcgtgatttgtgccgtgaatatggcgtaccgtttattgtagacgacaacgttgatttggcgttggaaattgaggcagatggcattcacgttgggcaaagcgatatgcctgtgcaagagattcgagctaaaacagataaaccgctaattattggttggtcggtgaatcgtttagacgaggcaaaaattggggaaaatttagcggaaattgattattttggaattggcccgatttttccaacgcaatcgaaagagaatccgaaaccaacactaggaatggcgtttattcaaactttgcgaaatgtgggcataactaaaccgcttgtggcaattggtggggtgaaattagctcacgttaaaaccttacgagaatttggggcggatggtgtggcagtgattactgcaattacgcacgccgataatgtgcaagccgcaacaaaagcattacgggaggcaagtgatgaatacgcaaaa

SEQ ID NO: 2054 - protein, 226 aa, Haemophilus influenzae
  Name: NTH1138
MKNIQKILPLYFVAGTQDCRHLGENLSENLLFVLKQALEGGITCFQFRDKGKFSLEHTPSAQKALAMSCRDLCREYGVPFIVDDNVDLALEIEADGIHVGQSDMPVQEIRAKTDKPLIIGWSVNRLDEAKIGENLAEIDYFGIGPIFPTQSKENPKPTLGMAFIQTLRNVGITKPLVAIGGVKLAHVKTLREFGADGVAVITAITHADNVQAATKALREASDEYAK

SEQ ID NO: 2055 - DNA, 762 bp, Haemophilus influenzae
  Name: NTH1139
gtggtgcaggcattcaagcgggatcttaaaaccttcccaaatgcgcggcgtgtttggtacatcggtaattacagctgttactgcacaaaacacacttgggcgtatttgatattcacccctattccactgaaaacaattcaagcgcaactggaagcggtcaaaaatgatttccagattgcaagttgcaaaattggtatgttgggcaatgcagaaattattgaatgcgtggcagattttcttgctgataaacctttcggcacgctggtgctagatcctgtaatgattgccaaaggtggtgcacccttattgcaacagcaagcggtaagtgcattaagccaaaaattgctgccgttggcggacgtgattacaccgaacattcccgaagcggaagcattaacggggattgcgattgtggacgacatcagtattcaacaagccgcaaaagcgttgcaaaaacaaggagcgaagaatgttattattaagggcggacattcgctcaattcgcaaagtgagctgtgccaagattgggttttacttgcagatggtcgtcattttactttgcaaagcccccgtttcaacacgccgcatacacacggtacgggctgtaccttttctgcctgtttaaccgcagagttggcgaaaggcgaaccgttgcaaagtgcggtaaaaacagcgaaagattttattaccgctgcgatttctcacccattgaatattgggcaaggacacgggccgacaaatcattgggcttacagtcgcctt

SEQ ID NO: 2056 - protein, 254 aa, Haemophilus influenzae
  Name: NTH1139
VVQAFKRDLKTFPNARRVWYIGNYSCYCTKHTWAYLIFTPIPLKTIQAQLEAVKNDFQIASCKIGMLGNAEIIECVADFLADKPFGTLVLDPVMIAKGGAPLLQQQAVSALSQKLLPLADVITPNIPEAEALTGIAIVDDISIQQAAKALQKQGAKNVIIKGGHSLNSQSELCQDWVLLADGRHFTLQSPRFNTPHTHGTGCTFSACLTAELAKGEPLQSAVKTAKDFITAAISHPLNIGQGHGPTNHWAYSRL

SEQ ID NO: 2057 - DNA, 96 bp, Haemophilus influenzae
  Name: NTH1140
ttggacaaagagggcgcatcaatgagtaatgtgaaacaagttttaaccatcgcagggtcagacagtggcggtggtgcaggcattcaagcgggatct

SEQ ID NO: 2058 - protein, 32 aa, Haemophilus influenzae
  Name: NTH1140
LDKEGASMSNVKQVLTIAGSDSGGGAGIQAGS

SEQ ID NO: 2059 - DNA, 789 bp, Haemophilus influenzae
  Name: NTH1141
ttgtttattttatattcaatacaaggaatgcttatgcaatcaatttatctctccaaaatccgtgagcagaatccgctcattcataacatcaccaacattgtggcagcaaattttagtgccaatggcttgttggcattaggagcttcgcctttgatgtcggcgaatatcgaagaaatgcaggaagtaccgaaaatcagtcaagtattggtcattaatattggtacgctgattggtaaagatcgggaggcaatgttgcaggcaggaaaaacggcaaatgaggttggaattcctgtagtgttagatcctgttggtgtgggggcaacgagctatcgccgtgagaccattcgccaattgctggcagaagtaaaattcgcacttattcgtggtaatgcaggtgaactggctgccattgcaggcgagacgtggcaggcaaaaggtgtagatgcagggcaaggcgaagtggatttaaaagccgttgccgagaaagtggctcaacgctatggctgtacggtgttgattagcggggcggtggatattgtcagcgatggcacacaaactgcgaccgttcacaacggcacgtcattgttcccgaaagttacggcttcgggctgtttattgagtgccgtgtgtgcggcttttttagcggtaagtgaaggaaattatttttctgcgacattagaagcctgtgtagcatacaccattgcaggcgagtgtgcggcgcaaggcttaaccacacaagtgggacagttccaaatccgtttgttggacgagcttgctgcccttttcccc

SEQ ID NO: 2060 - protein, 263 aa, Haemophilus influenzae
  Name: NTH1141
LFILYSIQGMLMQSIYLSKIREQNPLIHNITNIVAANFSANGLLALGASPLMSANIEEMQEVPKISQVLVINIGTLIGKDREAMLQAGKTANEVGIPVVLDPVGVGATSYRRETIRQLLAEVKFALIRGNAGELAAIAGETWQAKGVDAGQGEVDLKAVAEKVAQRYGCTVLISGAVDIVSDGTQTATVHNGTSLFPKVTASGCLLSAVCAAFLAVSEGNYFSATLEACVAYTIAGECAAQGLTTQVGQFQIRLLDELAALFP

SEQ ID NO: 2061 - DNA, 147 bp, Haemophilus influenzae
  Name: NTH1142
gtgctaactgtttcaggttcacgggtatcatctcagcctttcggcaccccgactaaaaattgcatgaagtttacgcttcttttcaagaaaaaacaagcggtcaaatttttccctcattttgcaaataatgagaagaatttgaccgct

SEQ ID NO: 2062 - protein, 49 aa, Haemophilus influenzae
  Name: NTH1142
VLTVSGSRVSSQPFGTPTKNCMKFTLLFKKKQAVKFFPHFANNEKNLTA

SEQ ID NO: 2063 - DNA, 210 bp, Haemophilus influenzae
  Name: NTH1143
atgccaataggcggagatgtgaaggcggatcaggaaacatcaggttctagaagcataaaacgcattggctttggttttattggtggtattggctatgacattacaccgaatattaccttagacttagattatcgttataacgattggggacgcttagaaaacgtgcgttttaaaactcacgaagcctctttcggtgtacgttaccgtttt

SEQ ID NO: 2064 - protein, 70 aa, Haemophilus influenzae
  Name: NTH1143
MPIGGDVKADQETSGSRSIKRIGFGFIGGIGYDITPNITLDLDYRYNDWGRLENVRFKTHEASFGVRYRF

SEQ ID NO: 2065 - DNA, 153 bp, Haemophilus influenzae
  Name: NTH1144
atgactttagcgaaagcaaatgatgaaatgccagaggctttcccaattagggcttggcaggattctcgttattatttctatggaaaaggtgcggcaggacatcattgtgcaattagccacgtttattctgaaccaacccgcgcaaaatcagaa

SEQ ID NO: 2066 - protein, 51 aa, Haemophilus influenzae
  Name: NTH1144
MTLAKANDEMPEAFPIRAWQDSRYYFYGKGAAGHHCAISHVYSEPTRAKSE

SEQ ID NO: 2067 - DNA, 225 bp, Haemophilus influenzae
  n 188: n is any nucleotide
  Name: NTH1145
atgccattatttgctgcggtggtttcgcctgaattggcaagtggcaaggcttggattgattattcaacggtaaatctgccaaaagaaaatcatttcttatctgtggatgaattgcttgagcaagagaaaactaaaaaagggtttatcacgccagcaatgggaattgtcgttgaagaaaaatcccctgnatgtaaaacctgcattagattttattactcaaccagc

SEQ ID NO: 2068 - protein, 75 aa, Haemophilus influenzae
  Xaa 63: Xaa is any amino acid
  Name: NTH1145
MPLFAAVVSPELASGKAWIDYSTVNLPKENHFLSVDELLEQEKTKKGFITPAMGIVVEEKSPXCKTCIRFYYSTS

SEQ ID NO: 2069 - DNA, 126 bp, Haemophilus influenzae
  n 78: n is any nucleotide
  Name: NTH1148
gtgcgcgttgaagattatgaaacagttgttgaaaataacttcagcccgactgaaaaaatgccagaagtggatgtaatnacggttcaaaataatgatgaaaaacccgggtcatcagaaccaaccgtt

SEQ ID NO: 2070 - protein, 42 aa, Haemophilus influenzae
  Xaa 26: Xaa is any amino acid
  Name: NTH1148
VRVEDYETVVENNFSPTEKMPEVDVXTVQNNDEKPGSSEPTV

SEQ ID NO: 2071 - DNA, 105 bp, Haemophilus influenzae
  Name: NTH1149
atgctcaaaagtgcggtaaaaaaaagaaacgtttttagattggcattctatcataaaaaaatagaaagagaggaaaataaaaatccccaattggggatttttatt

SEQ ID NO: 2072 - protein, 35 aa, Haemophilus influenzae
  Name: NTH1149
MLKSAVKKRNVFRLAFYHKKIEREENKNPQLGIFI

SEQ ID NO: 2073 - DNA, 96 bp, Haemophilus influenzae
  Name: NTH1150
ttggggatttttattttcctctctttctatttttttatgatagaatgccaatctaaaaacgtttcttttttttaccgcacttttgagcattattta

SEQ ID NO: 2074 - protein, 32 aa, Haemophilus influenzae
  Name: NTH1150
LGIFIFLSFYFFMIECQSKNVSFFYRTFEHYL

SEQ ID NO: 2075 - DNA, 540 bp, Haemophilus influenzae
  Name: NTH1151
atgactacacaacttgatttaatcaaatcttctatcaaatcaattcctaattatccaaaagaaggcattatcttccgcgacattacgacccttttagaagttccagcagcttttaaagcaacaatagatcttattgtggaacaatatcgcgataaaggaattaccaaagtgcttggaactgaatctcgtggttttatttttggtgcccccgttgccttagcactaggtttacctttcgaattagtacgtaaacctaaaaaattaccacgtgagactatttctcaatcttatcaattagaatatggtcaagatactttggaaatgcacgttgatgcaatttcagaaggtgacaatgttttaattattgatgatttattagcaactggtggcacagttgaagcgacagtaaaattagtgcaacgtttaggtggagcggtaaaacacgctgcatttgtgattaatttacctgaattaggtggcgaaaaacgcttaaataatttgggcgttgattgctatacactcgtcaattttgaaggtcat

SEQ ID NO: 2076 - protein, 180 aa, Haemophilus influenzae
  Name: NTH1151
MTTQLDLIKSSIKSIPNYPKEGIIFRDITTLLEVPAAFKATIDLIVEQYRDKGITKVLGTESRGFIFGAPVALALGLPFELVRKPKKLPRETISQSYQLEYGQDTLEMHVDAISEGDNVLIIDDLLATGGTVEATVKLVQRLGGAVKHAAFVINLPELGGEKRLNNLGVDCYTLVNFEGH

SEQ ID NO: 2077 - DNA, 933 bp, Haemophilus influenzae
  Name: NTH1152
atgagctatcaagtcttagccagaaagtggcgaccaaaaacatttgctgatgtcgttgggcaagaacatattatcacggcattagcaaatggattaaaagataatcgactacatcacgcttacctcttttcaggcacgcgtggtgtaggaaaaacctctattgctagattattcgcgaaaggattaaattgtgttcacggtgtaacggcaacgccttgtggcgaatgtgaaaattgtaaaactattgagcaaggcaattttattgatttaattgaaattgatgcggcgtctcgcacaaaagttgaagacacgcgtgaattattggataacgtgcaatataaaccagttgtgggcagatttaaggtttacttaatcgatgaagtccatatgctatctcgtcattcatttaatgcgttgctcaaaactttagaagaaccgcccgaatatgtaaaatttttactcgcaacaacagatccacaaaaactacctgtaactattctttctcgctgtttacaatttcatcttaaagcattagatgaaactcaaatctcccagcatcttgcccatattttgacgcaagaaaatattccttttgaagagcctgcattagttaaacttgcaaaagcggcgcaaggaagtattcgtgatagtttaagtttaacggatcaagccattgcaatgggcgaccgacaagttacgaataatgttgtaagcaatatgttagggttgcttgatgataactattctgttgatattttatacgccttacaccaaggcaatggcgaactcttaatgcgaacactgcaaagagttgcagatgcggcaggcgattgggacaaattacttggcgaatgtgcagaaaaatacatcaaattgcactcatgcaacttcttccacaaaaatcttcagatgacaatgaacatttttcatttt

SEQ ID NO: 2078 - protein, 311 aa, Haemophilus influenzae
  Name: NTH1152
MSYQVLARKWRPKTFADVVGQEHIITALANGLKDNRLHHAYLFSGTRGVGKTSIARLFAKGLNCVHGVTATPCGECENCKTIEQGNFIDLIEIDAASRTKVEDTRELLDNVQYKPVVGRFKVYLIDEVHMLSRHSFNALLKTLEEPPEYVKFLLATTDPQKLPVTILSRCLQFHLKALDETQISQHLAHILTQENIPFEEPALVKLAKAAQGSIRDSLSLTDQAIAMGDRQVTNNVVSNMLGLLDDNYSVDILYALHQGNGELLMRTLQRVADAAGDWDKLLGECAEKYIKLHSCNFFHKNLQMTMNIFHF

SEQ ID NO: 2079 - DNA, 99 bp, Haemophilus influenzae
  Name: NTH1153
gtgggagcttgtgcggcatttggtggtgatgttggtttttctatgtgcttgggctttggttcagtcatttctcgcacgggaagtgcggtcattttttta

SEQ ID NO: 2080 - protein, 33 aa, Haemophilus influenzae
  Name: NTH1153
VGACAAFGGDVGFSMCLGFGSVISRTGSAVIFL

SEQ ID NO: 2081 - DNA, 663 bp, Haemophilus influenzae
  Name: NTH1154
atgcaacttcttccacaaaaatcttcagatgacaatgaacatttttcatttttagccaaacatatctctccagaagatgttcagtttttttatcaagtgattgtttctggtagaaaagatttatcaaatgcgccaaatcgtcgtattggagcagaaatgacattattgagggcattggcattccacccaaagttccttacggcagtaccaaagactaacactacaattactccaccgccatcaacgccaagtgcggttgaaaatactggtaattatgtagatgtgccagtactgtcgcaaagtataaaatcagcttattctcaagcaaaaccaaataaaacgagcattccaaatttggcaagcctttccgctttagatgcgctggaacatttaacacaactcgaaaaccaagaacgtcaagaacacaaagctgaatcattagctgtagtaagtgaaactttacatcacatccaagaactggatgaagaaaaatctcataaaaaaatgaccgcacttcccgtgcgagaaatgactgaaccaaagcccaagcacatagaaaaaccaacatcaccaccaaatgccgcacaagctcccacagaaatagcccagaagaaaattcaagtgatgataatgcagaagttgctcaagatgaacaagaaatct

SEQ ID NO: 2082 - protein, 221 aa, Haemophilus influenzae
  Name: NTH1154
MQLLPQKSSDDNEHFSFLAKHISPEDVQFFYQVIVSGRKDLSNAPNRRIGAEMTLLRALAFHPKFLTAVPKTNTTITPPPSTPSAVENTGNYVDVPVLSQSIKSAYSQAKPNKTSIPNLASLSALDALEHLTQLENQERQEHKAESLAVVSETLHHIQELDEEKSHKKMTALPVREMTEPKPKHIEKPTSPPNAAQAPTEIAQKKIQVMIMQKLLKMNKKS

SEQ ID NO: 2083 - DNA, 519 bp, Haemophilus influenzae
  Name: NTH1155
ttgagtgctgacacctatcgttgggaatggagcaatccagaacttgctaaagccgatacaggcgttcgtccttctgatataaaacaggcgattttaaaagatattacgcctgaattacgtttaaaaatcatcacccaaactcaacaacaagatgagtgggcagatatagttgaacgttctggcgtaacaggatttagcaaagaattagcgttaaattgtttcttacaaagcaaaaccgatgatgaaatcaatcttggactacattcagaaaaatctcatttacgccaagacagaagtataaaaaatttggttgaagctttaagtaaattgcaaggtaaagatattcgattaacaatcaatcttgatgatagcaatgtcgcgacgccaattgaatatcgccgtaatatttatcaagcattgcgggaaaaagctcaaaatgaattgcaaaaagatagcaaactacaaatgttgcttaatgaattcgatgcaaaattagatgtagagagtattcgaccagtt

SEQ ID NO: 2084 - protein, 173 aa, Haemophilus influenzae
  Name: NTH1155
LSADTYRWEWSNPELAKADTGVRPSDIKQAILKDITPELRLKIITQTQQQDEWADIVERSGVTGFSKELALNCFLQSKTDDEINLGLHSEKSHLRQDRSIKNLVEALSKLQGKDIRLTINLDDSNVATPIEYRRNIYQALREKAQNELQKDSKLQMLLNEFDAKLDVESIRPV

SEQ ID NO: 2085 - DNA, 180 bp, Haemophilus influenzae
  n 167, 168, 169, 170, 171: n is any nucleotide
  Name: NTH1156
gtgaaaatgaaactagttgaagtaaaacacccacttgtaaaacacaaactaggtgtgatgcgtgaagctgagattgatacaaaaaaattccgtgaactggcaacagaaattggtagcctattaacctatgaagcaacctctgatttagaaactgaaaaagtaacgtnnnnnttaattaat

SEQ ID NO: 2086 - protein, 60 aa, Haemophilus influenzae
  Xaa 56, 57: Xaa is any amino acid
  Name: NTH1156
VKMKLVEVKHPLVKHKLGVMREAEIDTKKFRELATEIGSLLTYEATSDLETEKVTXXLIN

SEQ ID NO: 2087 - DNA, 405 bp, Haemophilus influenzae
  Name: NTH1157
gtgttccgtcaattcaaattagttaagaggagaaaggttatggcgttttgggatggtgcatgggatgcaattagtggcgctggtaaatggctgggggaaacagctggaagtgcaatggattggatggacaaccataaagcagcaagtaatattatcggtaatgttattgctggtgctggtggttactttgcgcaaaaacaagctggtaaagatttgatcaatcagcaacgtgagttattaaatctgcaagatcagatgaaatcaaaatattcagccgtaccagatgcggattggtcgtataaaagtttgacagtggatgattctcctggattggcaaatggcggtattttgactgaaatgaagaaacgttctgaaactaaaggggctaacaatggcagagttgca

SEQ ID NO: 2088 - protein, 135 aa, Haemophilus influenzae
  Name: NTH1157
VFRQFKLVKRRKVMAFWDGAWDAISGAGKWLGETAGSAMDWMDNHKAASNIIGNVIAGAGGYFAQKQAGKDLINQQRELLNLQDQMKSKYSAVPDADWSYKSLTVDDSPGLANGGILTEMKKRSETKGANNGRVA

SEQ ID NO: 2089 - DNA, 1170 bp, Haemophilus influenzae
  Name: NTH1159
atggcagagttgcatgatagttttggtgagtcaatggaaaaagctggctatgagcgagctagtgattctgattcatccttttccggtggaggtggttggcgagaagataacagtagtgatagttatcgtagtacgtcagatagatggaatgaccacaaatctagatacggaaaagacaaagtctatactgatgcatttaatgagcgaagaaataactctagttggagcggtggtcatagcgcaattagccgaacaattagtgaaaaatatcattcactttctaatgggcaaatgagcgccgccgttcctgaaaaagatcagaaaacactcactggcggtttgtttggaaaaagttactccaatgcgccttattctgaacgcactccttctatatttgatagaaacatacgtggttcaatgacattaaataacggcgatgtatggtcaagcgatccccaatattcatccgttcgagaacgggcggacatcaatagttacgaccgtattaaacggggcgaagaattgaacttaattggtcgtgctgtaggaggcgtttttagtggggtgggcggggcagcaacaacgccagttggcaaaattgctgaaagtgcggcaaattttgggctttcccacgttggggatttatctcgacaattcaaaagcaaccaagagcaagcgtattatgatagcctcactccagaggggaaagcgtattacgatacaagagtagatttcatcaataagtcctataagaatgctcgggaaaaatatgaaacgaacgataaatggattgatagaggtattacagctgcacaagtcggtttatctgctttagggcctcctggtgcaatgctagggtctgggattggtttattaggtaaagcgatcaacaaaaaagacacgatgacaaaatcattacgtgatttaacagagacgcttaactctaacgcattaaataaccacatcgcacaacaaaatgaattagctgaaaaagaacgtcaagcctataaggaatttatggctgggcgtgatttacgcagtgacaatacacaaccaaaaggcatactgaacactatgtataatcgtatgcaaaatatagatcctgataaacaggtcaaaacgagtgacgttcctaacctaagaaattattgggcaaatatcatcgtatca

SEQ ID NO: 2090 - protein, 390 aa, Haemophilus influenzae
  Name: NTH1159
MAELHDSFGESMEKAGYERASDSDSSFSGGGGWREDNSSDSYRSTSDRWNDHKSRYGKDKVYTDAFNERRNNSSWSGGHSAISRTISEKYHSLSNGQMSAAVPEKDQKTLTGGLFGKSYSNAPYSERTPSIFDRNIRGSMTLNNGDVWSSDPQYSSVRERADINSYDRIKRGEELNLIGRAVGGVFSGVGGAATTPVGKIAESAANFGLSHVGDLSRQFKSNQEQAYYDSLTPEGKAYYDTRVDFINKSYKNAREKYETNDKWIDRGITAAQVGLSALGPPGAMLGSGIGLLGKAINKKDTMTKSLRDLTETLNSNALNNHIAQQNELAEKERQAYKEFMAGRDLRSDNTQPKGILNTMYNRMQNIDPDKQVKTSDVPNLRNYWANIIVS

SEQ ID NO: 2091 - DNA, 525 bp, Haemophilus influenzae
  Name: NTH1161
atgggcattttagattcaatgacacaacaatcacaaccgcagacaacagaacaaagtgcggtcgaaaatccacagggttcacaacaacagggaagtatggcgcagatgtatcaaatgttgatgcaaaattccattaatgctatcgcaaatgttgcgcaacaacgtattcaagaaaaaggtcccgaagaaggtattgccgatttagtcgcaaaagcaatgatttcaaatcttcaggccgcgcaacaaaatggaaaaactattccgccgcaagtgatgatgcaagtcgctaaagatttagctatgcaattattacagcaagttggtgtgccagaagagcaaattgatgatgtattgattgatattttaatgaatgcgcttgagcaatttggcgaagcaacgcacggtgcgttacctcaggaagaagaacagcaatacgttgatatgatcaacaaagtatctgaaatggaaagccaacgtcgtgcgcaagtgcaaaacggtcaatcaaaaccaatgcaacaaggggca

SEQ ID NO: 2092 - protein, 175 aa, Haemophilus influenzae
  Name: NTH1161
MGILDSMTQQSQPQTTEQSAVENPQGSQQQGSMAQMYQMLMQNSINAIANVAQQRIQEKGPEEGIADLVAKAMISNLQAAQQNGKTIPPQVMMQVAKDLAMQLLQQVGVPEEQIDDVLIDILMNALEQFGEATHGALPQEEEQQYVDMINKVSEMESQRRAQVQNGQSKPMQQGA

SEQ ID NO: 2093 - DNA, 762 bp, Haemophilus influenzae
  Name: NTH1162
atgggatggggtggaattttaggtgcgatgacacaaggattgggaactggtattgtcaaaaatgttgagcaagggtggaaagatgaagaaactcaaaagttgttagattggaaaacggcagaagccgacaaacaacgtgcttttgatagtgaattgcttgataaaaaatacaagcacgagtttgagcttgaagatcatagaacccgtaatgaaatttcagcggcggctgcaaaagctcgaatttcagcacgttattctcatggtggtgaatcagaagcgcaaaaaaatcttcttggcgcaactcaaacgcttggtatttatgatagccaattacattccttgcaagaaaaattgtccgcaacagaagataaagagcaacaaaatgcgattgcagcaagaatcaatgctgtttctgctgaacgcgagaattatcttaaacgccctgatacaatcgctgcatttaagggggctggccagatgggacaagcgctttatatgactggtggtggtaatatggatttgtacaatccgaaaccagtggagcgcgaaacggtagctgaggatgttaaatcttctgtcgctcctcctgtgcgcaatatgattgatgtaaataatctcactccacaacaggcggcagatattgcaagacagaaaagtgaagatgccgctcgtttgcagttttccaaagcgtcagcggatgctaaagactgggcgcaaaaacgtacacagtatcaatcatcaactttcattccgcgaacattc

SEQ ID NO: 2094 - protein, 254 aa, Haemophilus influenzae
  Name: NTH1162
MGWGGILGAMTQGLGTGIVKNVEQGWKDEETQKLLDWKTAEADKQRAFDSELLDKKYKHEFELEDHRTRNEISAAAAKARISARYSHGGESEAQKNLLGATQTLGIYDSQLHSLQEKLSATEDKEQQNAIAARINAVSAERENYLKRPDTIAAFKGAGQMGQALYMTGGGNMDLYNPKPVERETVAEDVKSSVAPPVRNMIDVNNLTPQQAADIARQKSEDAARLQFSKASADAKDWAQKRTQYQSSTFIPRTF

SEQ ID NO: 2095 - DNA, 294 bp, Haemophilus influenzae
  Name: NTH1163
atggctgtgcaactggtaagttatgaattgcgtatggctttcttagttcaaaataataagaaaaattcactttctttaatagagaaaaactatccaacaacagatcagttagcttatttttttgactacacagaacgtatatatcagtctcttggatttattcaaaatcaaggagttatgcgtaaattaaagcgtttatactatcgtgcaaaattagagaaaaacgaattaaatattttaaatggtatgctaagtgcggttgaaaaacgaattgatttaacaaaagagaataat

SEQ ID NO: 2096 - protein, 98 aa, Haemophilus influenzae
  Name: NTH1163
MAVQLVSYELRMAFLVQNNKKNSLSLIEKNYPTTDQLAYFFDYTERIYQSLGFIQNQGVMRKLKRLYYRAKLEKNELNILNGMLSAVEKRIDLTKENN

SEQ ID NO: 2097 - DNA, 450 bp, Haemophilus influenzae
  Name: NTH1164
atgaaacttacatcgaaaggtcgttatgcagttacagccgttttagatattgctttaaatgcagatggcgggcctgtaagccttgcggatatttctgaacgccaacatatttccttatcttatttagagcaactttttgctaaattacgtaaagacggtttagtcaaaagtgttcgcgggccaggaggtggttatcagttagggctaccaagtgaacaaatttctgtaggaatgattattgcggcagtaaatgaaaatattcacgtaacgaaatgtctggggcgtgaaaattgtaaaaatggtgtggaatgtttaactcacgaactttgggaagatttaagtttacgtattgaaagttttttaaatgagattacgttagcagagctggtaaataagcgtaatgtaaaacgtcaatctcatcgtgattttagtaatttattagttaatcaa

SEQ ID NO: 2098 - protein, 150 aa, Haemophilus influenzae
  Name: NTH1164
MKLTSKGRYAVTAVLDIALNADGGPVSLADISERQHISLSYLEQLFAKLRKDGLVKSVRGPGGGYQLGLPSEQISVGMIIAAVNENIHVTKCLGRENCKNGVECLTHELWEDLSLRIESFLNEITLAELVNKRNVKRQSHRDFSNLLVNQ

SEQ ID NO: 2099 - DNA, 1218 bp, Haemophilus influenzae
  Name: NTH1165
gtgaaaatgaaattacctatttatttagactacgcagcgacctgtccagtcgatgaacgtgttgcgaaaaaaatgatggcgtttctaaccatcgatggcacatttggcaatccagcctctcgctcacataaatttggttggcaagcagaagaagctgttgatattgcgcgtaatcaaatcgctgatctcattggctcagattctcgtgaaattgtctttacttctggtgcgacagaatctgacaacctcgcaattaaaggtgcggcgcatttctatcaaactaaaggtaaacacattattacctgtaaaactgaacataaagcagtgttagatacttgccgtcaattagaaagagaaggttttgaagtcacttatttgtctccagaagctgatggtttaattgatttagaaaaattcaaagctgcgcttcgtccagatacaattctagcttcaattatgcacgctaataatgaaattggtgtgttacaagatattaaagctattggcgaactttgtcgtgcaaataaaacaattttccatgtggatgcaactcaaagtgttggtaaagttgaaattaatttggaagaattagctgttgatttaatgtcgatgtctagccataaactttacgggccaaaaggtgttggcgcattgtatgttcgtcgtaaacctcgcatacgtttagaggcgattattcatggtggtggtcacgaacgtggcatgcgttcaggtacattacctgttcatcaaatcgtaggaatgggagaggcatatcgaattgcaaaagaagaaatggcatcagaaatgccgcgtttaaaagcacttcgtgatcgtttatataatggcttaaaagatattgaagaaacttatgtaaatggttcaatggaacatcgtttagatagcaatttaaatattagttttaactatgttgagggagagtccttaatgatggcgttgcgcgatattgctgtctcttctggttctgcttgtacatctgctagcttagagccatcttatgtattgcgcgcacttggcttaaatgatgaattggcgcacagttcaattcgtttcacattaggtcgttatactactgaagaagaaattgattacacaattaatttaatgaagggtgcggtagaaaaacttcgtgcattatcgccattatgggatatgtttaaagaaggtattgatttaaataccattgagtggtcagctcac

SEQ ID NO: 2100 - protein, 406 aa, Haemophilus influenzae
  Name: NTH1165
VKMKLPIYLDYAATCPVDERVAKKMMAFLTIDGTFGNPASRSHKFGWQAEEAVDIARNQIADLIGSDSREIVFTSGATESDNLAIKGAAHFYQTKGKHIITCKTEHKAVLDTCRQLEREGFEVTYLSPEADGLIDLEKFKAALRPDTILASIMHANNEIGVLQDIKAIGELCRANKTIFHVDATQSVGKVEINLEELAVDLMSMSSHKLYGPKGVGALYVRRKPRIRLEAIIHGGGHERGMRSGTLPVHQIVGMGEAYRIAKEEMASEMPRLKALRDRLYNGLKDIEETYVNGSMEHRLDSNLNISFNYVEGESLMMALRDIAVSSGSACTSASLEPSYVLRALGLNDELAHSSIRFTLGRYTTEEEIDYTINLMKGAVEKLRALSPLWDMFKEGIDLNTIEWSAH

SEQ ID NO: 2101 - DNA, 453 bp, Haemophilus influenzae
  Name: NTH1166
gtggtcagctcactaatatttagttgccattatctgacaatggcatttactagaattgaaaaaaggaaagttaaaatggcttatagcgaaaaagtaattgatcattatgaaaatccacgtaatgtgggatcattggataaaaaagatagcaatgttggtactggaatggtcggtgcgccagcttgtggtgatgttatgcaactacaaatcaaggtagatgataatggcattattgaagatgcaaaattcaaaacttacggctgtggttctgcgattgcatctagttcattaattactgagtgggtaaaaggtaaatctttagaagaagctggggcaattaaaaatagccaaattgctgaagaattagaattgccgccagtgaaagtgcattgctctattttagcagaagatgcaattaaagcagcaattgctgattataaagcaaaacaaggc

SEQ ID NO: 2102 - protein, 151 aa, Haemophilus influenzae
  Name: NTH1166
VVSSLIFSCHYLTMAFTRIEKRKVKMAYSEKVIDHYENPRNVGSLDKKDSNVGTGMVGAPACGDVMQLQIKVDDNGIIEDAKFKTYGCGSAIASSSLITEWVKGKSLEEAGAIKNSQIAEELELPPVKVHCSILAEDAIKAAIADYKAKQG

SEQ ID NO: 2103 - DNA, 321 bp, Haemophilus influenzae
  Name: NTH1167
atgggtattacattaacagaaaaagcagctcagcgagtgaaagcctttttggataatcgtggtaaaggtattggattacgtttaggtgtgaaaacatcaggttgttcaggcttagcttatgtacttgagtttgtagatgttttaaattccgaagatcaagtttttgagcagcacggtgttaatattattgtcgatccaaaaagtctcgtttatctcaatggcattgagctggattatgtaaaagaaggcctaaatgaaggctttaaatataataatccaaatgtaaaagaatcttgtggttgtggcgaaagtttccacgtt

SEQ ID NO: 2104 - protein, 107 aa, Haemophilus influenzae
  Name: NTH1167
MGITLTEKAAQRVKAFLDNRGKGIGLRLGVKTSGCSGLAYVLEFVDVLNSEDQVFEQHGVNIIVDPKSLVYLNGIELDYVKEGLNEGFKYNNPNVKESCGCGESFHV

SEQ ID NO: 2105 - DNA, 522 bp, Haemophilus influenzae
  Name: NTH1168
atgttcaatccttttcaaatttttgatttgccagttgattttcagctggatgaaaaagtactaaatgcacgttatttaaaattacaaaaggccctacatccagataattttgtctcaagtagtgctttagagcaacgtgttgcgatgcaaaaatctaccgaagtgaatgatgccttaaaaacgttaaaagacccaattttgcgagctgaagcgatcattgctcttaatactggtgagcagttagatcttgaacaaaaaagcacgcaagatgtggcgtttttaatgcaacaattacaatggcgcgaacaattagaagatgttgaaagccagcaagatgaaagagcattaaatgtttttgcgaaagaaattaaacaagaaactcaatcattattgaccgcactttttgagagtttgaaatctcaacaatgggcgagagcatctcaatactgtgataaattacgttttacccataaactttctgaagaaattgaacgtgtggaagaacgaatttttgaattagat

SEQ ID NO: 2106 - protein, 174 aa, Haemophilus influenzae
  Name: NTH1168
MFNPFQIFDLPVDFQLDEKVLNARYLKLQKALHPDNFVSSSALEQRVAMQKSTEVNDALKTLKDPILRAEAIIALNTGEQLDLEQKSTQDVAFLMQQLQWREQLEDVESQQDERALNVFAKEIKQETQSLLTALFESLKSQQWARASQYCDKLRFTHKLSEEIERVEERIFELD

SEQ ID NO: 2107 - DNA, 582 bp, Haemophilus influenzae
  Name: NTH1169
atgcaaactcttgaacagctcactagtccagaacattctgcttggataaccctttcccaatggattgataacgctcgcaatcattgtgaagtaattaaaaaagatcaatccagtgcggagcgtgagctttttactatgcaaatgccaacatcctcgccaatgggtgcagtaatctatgaaacaggtggaattttaattcattatggttggttacgtattttaggttctggaagttttaaattaccgcgtggcttgatggattggaatttcagtaaatcttttagtgagtcaggcgaaaaaccaaaatatttattagttgcagatgatgtgattggtggttattttgcgttaaatggtggttcgttaggcaataatattggaaaaatttattactattcatcaaaagatcttacttggcataatttaaattttacttacacagaatttttagcttgggcattgaatggcgatgtagaggccttttatcaagggctattttggaaaaattggcaagatgatgtaaaacaattagatggtaaccaagtttttgtatttacgcctgatttaaaccaagacagaaaa

SEQ ID NO: 2108 - protein, 194 aa, Haemophilus influenzae
  Name: NTH1169
MQTLEQLTSPEHSAWITLSQWIDNARNHCEVIKKDQSSAERELFTMQMPTSSPMGAVIYETGGILIHYGWLRILGSGSFKLPRGLMDWNFSKSFSESGEKPKYLLVADDVIGGYFALNGGSLGNNIGKIYYYSSKDLTWHNLNFTYTEFLAWALNGDVEAFYQGLFWKNWQDDVKQLDGNQVFVFTPDLNQDRK

SEQ ID NO: 2109 - DNA, 453 bp, Haemophilus influenzae
  Name: NTH1171
atggcattattacaaattgcagaaccaggacaagctgcggcaccgcatcaacatcgtttagccgttgggattgatttgggaacaaccaattctttggttgcatccgtgcgtagtgggcaatccgtgattcttaatgatgaacaagaacgcagtcttgtgccgtcagttgttcattatggcgttgaagagaagaaagttggtttagaagcctttgagcaagcctcacttgatccaaaaaatacggtgatttcagtaaaacgcttaattggtcgcagccttcctgatgttcagtctcgttattctagtttgccttatgaatttgtggcgagtgaaaatggattacctttaattattacggcacaggggcctaaaagtccaattgaagtgtcttcagatattttatcgcgcttaaatcacattgcagaacaacgcctggaggtgagcttcggggtg

SEQ ID NO: 2110 - protein, 151 aa, Haemophilus influenzae
  Name: NTH1171
MALLQIAEPGQAAAPHQHRLAVGIDLGTTNSLVASVRSGQSVILNDEQERSLVPSVVHYGVEEKKVGLEAFEQASLDPKNTVISVKRLIGRSLPDVQSRYSSLPYEFVASENGLPLIITAQGPKSPIEVSSDILSRLNHIAEQRLEVSFGV

SEQ ID NO: 2111 - DNA, 159 bp, Haemophilus influenzae
  n 154, 155, 156, 157, 158: n is any nucleotide
  Name: NTH1172
atgtctgttcaacaactcatttcacgactgaccgatattgttggatctcgttatattattactgatccaactaaaacagaagcttatcgaagtggttatcgatttggaaacagaaacgccctaactgttgttcccctgcatctttacttgagtnnnnnt

SEQ ID NO: 2112 - protein, 53 aa, Haemophilus influenzae
  Xaa 52, 53: Xaa is any amino acid
  Name: NTH1172
MSVQQLISRLTDIVGSRYIITDPTKTEAYRSGYRFGNRNALTVVPLHLYLSXX

SEQ ID NO: 2113 - DNA, 108 bp, Haemophilus influenzae
  Name: NTH1173
atgccaaacgaacgtaatattcaaaattatcactcgacttacaacaacattcgggattggcttggttatcaaaaagctggcgaggaaaaagcaaagtcgaccatcaat

SEQ ID NO: 2114 - protein, 36 aa, Haemophilus influenzae
  Name: NTH1173
MPNERNIQNYHSTYNNIRDWLGYQKAGEEKAKSTIN

SEQ ID NO: 2115 - DNA, 549 bp, Haemophilus influenzae
  Name: NTH1174
atgttgaaaagaattttagttattattggtttagctgtattagcaaccgcttgttctaatgcaccacgaacggtaagtcatcaggttatttcagaaaatgatgatattcaattaactggtttaattaataatttagaaaaagataatcgaacaggcatttttcacaaagtgagaacaaaccgttcctctgctttgatgggcgataaggctctagccagtgtttataatgaatgggttggcactcgctatcgtatgggcggtacgactaaacgtggtattgattgttcagcatttatgcaaactactttttctgaagtttttggtattgaattgcctcgttctacggctgaacagcgtcatttaggtagaaaaattaataaatcagaacttaaaaaaggcgatttagttttcttccgtaaaaataatcacgttggtgtttatattggtaataaccaatttatgcacgcaagtacagggcaaggcgtgacaataagttcccttgatgaaaaatattgggctagaacctacactcaatcgcgtcgtattatg

SEQ ID NO: 2116 - protein, 183 aa, Haemophilus influenzae
  Name: NTH1174
MLKRILVIIGLAVLATACSNAPRTVSHQVISENDDIQLTGLINNLEKDNRTGIFHKVRTNRSSALMGDKALASVYNEWVGTRYRMGGTTKRGIDCSAFMQTTFSEVFGIELPRSTAEQRHLGRKINKSELKKGDLVFFRKNNHVGVYIGNNQFMHASTGQGVTISSLDEKYWARTYTQSRRIM

SEQ ID NO: 2117 - DNA, 582 bp, Haemophilus influenzae
  n 10, 11: n is any nucleotide
  Name: NTH1175
gtgactttcnncccgttatgtacgattgtggatgatggcacgattgaaaatcgtcgaggttcactaactattgatgatgaaggtgtgccaagccagtgcaatgtactcatcaaagacgggattttgcaaggttacatgcaagataaaatgaatgcccgtttgatgggcgttgctccaacgggaaatggacgacgtgagtcttatgcccatttaccaatgcctagaatgaccaacacctatatgcttgctggacaaagtcagtttgatgatttgattgcttctgtaaaacaggggatttatgcaccgcactttggtggagggcaagtggatattacctctggtaaatttgtattttctacttcagaagcctatttaattgaaaaaggaaaaatcacgaaaccagttaagggcgcaactttaattggcagtggcattgaagtgatgcaaaagatttctatggttgcagataaatcagaacttgatttaggtatcggggtttgtggtaaagaggggcaaagtgtacctgttggcgtaggacagccagcactaaaaattgatgaaattactgttggtggaacaaat

SEQ ID NO: 2118 - protein, 194 aa, Haemophilus influenzae
  Xaa 4: Xaa is any amino acid
  Name: NTH1175
VTFXPLCTIVDDGTIENRRGSLTIDDEGVPSQCNVLIKDGILQGYMQDKMNARLMGVAPTGNGRRESYAHLPMPRMTNTYMLAGQSQFDDLIASVKQGIYAPHFGGGQVDITSGKFVFSTSEAYLIEKGKITKPVKGATLIGSGIEVMQKISMVADKSELDLGIGVCGKEGQSVPVGVGQPALKIDEITVGGTN

SEQ ID NO: 2119 - DNA, 102 bp, Haemophilus influenzae
  Name: NTH1176
gtgcgggttggccgggcgtattgctacacgaaagcggtaggtcacggtttagaaggcgattttaaccgtaaaagaaagttcactttttacaggcaagattgg

SEQ ID NO: 2120 - protein, 34 aa, Haemophilus influenzae
  Name: NTH1176
VRVGRAYCYTKAVGHGLEGDFNRKRKFTFYRQDW

SEQ ID NO: 2121 - DNA, 132 bp, Haemophilus influenzae
  Name: NTH1177
atgacttgggattctgctcgttcaattcgtatgtttggtacaagtaatttgattaatcaagaaacaggtgcaggtattaatcgtttctatgctccaggcaaaaactatagaatgtcagttcagtttgaattc

SEQ ID NO: 2122 - protein, 44 aa, Haemophilus influenzae
  Name: NTH1177
MTWDSARSIRMFGTSNLINQETGAGINRFYAPGKNYRMSVQFEF

SEQ ID NO: 2123 - DNA, 363 bp, Haemophilus influenzae
  Name: NTH1178
atgcgactgatggaaaaatcatatctagtttacattttcacttttgggaattttttgaagaagtttttcttgtggaattctcgtgagcttcacagaatgcctcttttgtatgcttatagaataatttcttttgaaaactcaaataaagataaggatatattatttattataaaagtcacaaagaatttaagagtgaacataagaaacagaatttgtcatcacgatcccatcttcaataaagatttaaagaaaattctgaaacaagttatgtgggtatttagtaaaattgattatgatttatacttagttattaacaatctatattccaataaaattatcaatcttttaaataagaagccaatc

SEQ ID NO: 2124 - protein, 121 aa, Haemophilus influenzae
  Name: NTH1178
MRLMEKSYLVYIFTFGNFLKKFFLWNSRELHRMPLLYAYRIISFENSNKDKDILFIIKVTKNLRVNIRNRICHHDPIFNKDLKKILKQVMWVFSKIDYDLYLVINNLYSNKIINLLNKKPI

SEQ ID NO: 2125 - DNA, 384 bp, Haemophilus influenzae
  Name: NTH1179
atgttatcagcaacgcaatttcttgttttagaaaaagcacttagtaaggaaagattatctacatacaaaaactatgtgaaaaataaaacttcagaaagtattaatgataacatggttgctttatatgaatggaattctgaaatagcgggctattttcttgaattatgtaatatatatgagatttcattaagaaatgctatttatagatcaatagattcgtatgatcattatggtatcagacagagacaaatacttagacaaagtcctaaattaagagaaaaagttgaagaattaggtagaaatgcgactgatggaaaaatcatatctagtttacattttcacttttgggaattttttgaagaagtttttcttgtggaattctcg

SEQ ID NO: 2126 - protein, 128 aa, Haemophilus influenzae
  Name: NTH1179
MLSATQFLVLEKALSKERLSTYKNYVKNKTSESINDNMVALYEWNSEIAGYFLELCNIYEISLRNAIYRSIDSYDHYGIRQRQILRQSPKLREKVEELGRNATDGKIISSLHFHFWEFFEEVFLVEFS

SEQ ID NO: 2127 - DNA, 702 bp, Haemophilus influenzae
  Name: NTH1180
atgaaaaatatgttactgctcagtagctcaaaatacaagaacacaggttatcttgaacacaccctaccttggttacaaaatttcttggctgattatcgtggtaaaacaattgcttttgtaccttatgctggggtaagccgcacttttgatgaatatgaaaaaactgtgcaaaatgcactttccgatttagggatgaatattgtttccgttcatcatggtaaacagcatcgggatattattgaacaagcagatgtcatctctattggcggtggaaatacattttgtttgttaaaacagctttatgaacacaatttgattgatatcattcgtgaaaaagtaaataacggtacgccttattttggttggagtgctggggcaaatgtagctggcgcatctattatgacaactaatgatatgccgattacttatcctccttcatttcaagcattacaactttttcctcatcaaattaatccgcactttatttcaggtaaaatgcaaggccacaatggtgaaagccgagaagaacgtttggcagaatttttactcgttaatccaaccgcacttgtatatgcattacctgaaggttctgcgcttcatatacaaaatgaaatggcaactgtattgggcgaaaatcctattttgtgcttcagtgaaaatatggaatgtggcacatttgatatcaatacaactttttcttat

SEQ ID NO: 2128 - protein, 234 aa, Haemophilus influenzae
  Name: NTH1180
MKNMLLLSSSKYKNTGYLEHTLPWLQNFLADYRGKTIAFVPYAGVSRTFDEYEKTVQNALSDLGMNIVSVHHGKQHRDIIEQADVISIGGGNTFCLLKQLYEHNLIDIIREKVNNGTPYFGWSAGANVAGASIMTTNDMPITYPPSFQALQLFPHQINPHFISGKMQGHNGESREERLAEFLLVNPTALVYALPEGSALHIQNEMATVLGENPILCFSENMECGTFDINTTFSY

SEQ ID NO: 2129 - DNA, 567 bp, Haemophilus influenzae
  Name: NTH1181
atggaattatttaaatccatcgttgcagtgattggcattattgccacaatttattttctgattaaaaaagccgaaacccgaaccgttttgattggtgtcggtttaataatgtccattctaacgcttaatccaatgggtgcattagatgcttttgccaaaagcatgacatctggcggattaattatggctatctgttctagtatgggttttgcttatgtaatgaaatacactcaatgtgatactcatctagtgcatttacttaccaaaccattaagcggattaaaattcttcttaattccaattgcaacagtcattacctttttcatcaatattgctattccttctgctgctggttgtgctgctgcggttggcgcaacattaattcccgttttaaaaagtgcgggtgttcgaccagctactgctggtgcagctattttaccacggacttttggatcaatgatgacgtcgggttttttctactctgcaacgattattgaaatgcacaggattacctctcactcaagaacacctttcccctgttccttaccacacgaacgcgacagcaaa

SEQ ID NO: 2130 - protein, 189 aa, Haemophilus influenzae
  Name: NTH1181
MELFKSIVAVIGIIATIYFLIKKAETRTVLIGVGLIMSILTLNPMGALDAFAKSMTSGGLIMAICSSMGFAYVMKYTQCDTHLVHLLTKPLSGLKFFLIPIATVITFFINIAIPSAAGCAAAVGATLIPVLKSAGVRPATAGAAILPRTFGSMMTSGFFYSATIIEMHRITSHSRTPFPCSLPHERDSK

SEQ ID NO: 2131 - DNA, 1158 bp, Haemophilus influenzae
  Name: NTH1182
atgattagaaaagcttacgaagaaaaagcgaccgttatcggtttaatcaacggcaaagtgaaaggtggcttcacagttgagttaaacggtgttcgtgcattcttaccaggttctttagttgatactcgtccagcgcgtgaagcagatcacttacttggtaaagaattagaattcaaagtaatcaaattagatcaaaaacgtaacaacgttgttgtttctcgtcgtgcagtaattgaatctgaaaacagccaagaacgtgaacaagtattagaaaatcttgttgaaggttcagaagttaaaggtatcgttaaaaacttaactgagtacggtgcattcgttgatcttggtggtgttgatggtttattacacatcacagatatggcttggaaacgtgttaaacacccaagtgaaatcgtaaatgttggcgatgaagtaactgttaaagtattaaaattcgataaagatcgtactcgcgtatctttaggcttaaaacaattaggtcaagatccttgggctgcaattgctgaaaatcatccagtaaacagcaaattaacaggtaaagtaactaacttaactgactatggctgtttcgttgaaatcttagatggcgttgaaggtttagttcacgtttctgaaatggattggactaataaaaatatccacccatctaaagtggttagcttaggcgatactgtagaagtaatggtattagaaattgatgaagaacgtcgtcgtatttctttaggcttaaaacaatgtaaagctaacccttggactcaatttgctgatactcacaacaaaggcgataaagtaacgggtaaaatcaagtctatcactgatttcggtatcttcatcggtcttgaaggtggtatcgatggtttagttcacttatctgatatttcttggagtatttcaggcgaagaagctgttcgtcaatacaaaaaaggtgacgaagtgtcagctgttgtattagctgttgatgcagtaaaagaacgtatctctttaggtattaaacaacttgaagaagatccattcaataactttgttgcaatcaacaaaaaaggtgcggtagtatctgcaactgttgttgaagcagatgctaaaggtgctaaagttgaattagcaggtggtgttgaaagttatatccgttctgctgat

SEQ ID NO: 2132 - protein, 386 aa, Haemophilus influenzae
  Name: NTH1182
MIRKAYEEKATVIGLINGKVKGGFTVELNGVRAFLPGSLVDTRPAREADHLLGKELEFKVIKLDQKRNNVVVSRRAVIESENSQEREQVLENLVEGSEVKGIVKNLTEYGAFVDLGGVDGLLHITDMAWKRVKHPSEIVNVGDEVTVKVLKFDKDRTRVSLGLKQLGQDPWAAIAENHPVNSKLTGKVTNLTDYGCFVEILDGVEGLVHVSEMDWTNKNIHPSKVVSLGDTVEVMVLEIDEERRRISLGLKQCKANPWTQFADTHNKGDKVTGKIKSITDFGIFIGLEGGIDGLVHLSDISWSISGEEAVRQYKKGDEVSAVVLAVDAVKERISLGIKQLEEDPFNNFVAINKKGAVVSATVVEADAKGAKVELAGGVESYIRSAD

SEQ ID NO: 2133 - DNA, 282 bp, Haemophilus influenzae
  Name: NTH1183
atgactaagtcagaacttatggaaaaattgtcagcaaaacagccaactttatctgcaaaagaaattgaaaatatggtaaaagatattttagagtttatttctcaatctcttgaaaatggtgatcgtgttgaagttcgaggttttggtagcttttctttacatcatcggcaaccacgtttgggaagaaatccgaaaacaggcgattcagtaaacttatcagctaagtctgttccatattttaaagcgggtaaagaattaaaagctagagtggatgttcaggct

SEQ ID NO: 2134 - protein, 94 aa, Haemophilus influenzae
  Name: NTH1183
MTKSELMEKLSAKQPTLSAKEIENMVKDILEFISQSLENGDRVEVRGFGSFSLHHRQPRLGRNPKTGDSVNLSAKSVPYFKAGKELKARVDVQA

SEQ ID NO: 2135 - DNA, 339 bp, Haemophilus influenzae
  Name: NTH1184
ttgattaaaaagtttattttgggttacaaatattttaaaggaaatgaaatgattaaatatattttaggcattgtgatctttattgcgattgtgttagttgcaattaccattggtgcgaataacgatcagattattacatttaattatattgtggcagaaagtcagtttcagctttcaagcctcgttgcaattttatttgggttaggtttaattcttggttggttaattactgcttttttctatattaagttaaaattaaaaaatatggcactagctcgtcaagtgaaacgtcagactttacaaatcaatgaattgacgactacgcgcgataaggtcgct

SEQ ID NO: 2136 - protein, 113 aa, Haemophilus influenzae
  Name: NTH1184
LIKKFILGYKYFKGNEMIKYILGIVIFIAIVLVAITIGANNDQIITFNYIVAESQFQLSSLVAILFGLGLILGWLITAFFYIKLKLKNMALARQVKRQTLQINELTTTRDKVA

SEQ ID NO: 2137 - DNA, 1188 bp, Haemophilus influenzae
  Name: NTH1185
atgatagaattactctttctattattgcctattgctgctgcctatggctggtatatggggcggcgtagtgcgaagaaagatcaagatgacataagtaataaactctcccgagattatgttacgggagtgaattttttactttctaatcaaactgataaagctgtagatttgtttttagatatgttgcaaaagcaagaaatcgaaaatgaaatcgaaagccactcccaatttgaagccgagcttacacttggtaatctgtttcgttctcgaggcgaagttgatcgtgcattgcgtattcatcaagctttagatcttagtcctaattatacttttgaacaaaaattacttgcaaaacaacagcttgctcgagattttatggtggttggtttttttgaccgagctgagaatctttatattttactagtagatgaacctgaatttgcagaaaatgctttacagcaacttttagtgatttatcaaaaaacaaaagaatggaaaaaagcagtcaatattgctgaaaaactcgctaaaataaagccacaagagaataatattgaacttgcgcaatgttattgtgaatattcacaaagtttagaacctgaaagtgcggttgaaaaacgcagtgttttacaaaaggctttgtcggtttctccgacttgtgttcgcgcttctttattgcttgcaaatttagcaatgcttgatggtcaatatcaacaagcagtagaaattttagaaaatgttttggagcaaaatccagattatacgggtgaaattttgtcacctttaaaacattgttatgaagaattaaatcagttagataattttgagttatttttaattcgtgcaggtcaaattattaataatgatgaagtagaactagctctagtcaaattaattgaagaaaaagatggtaagtctgctgcgcaagctaagctttatcaacaacttacaaaaaatccaagtactttaattttccatcgttttatgcagtatcaaattgatgatgcagaagacgggcggggaaaagaaagcttaattttattacataaaatggttggcgaaaggattaagcaaacatcgccttatcgttgtacaaattgtggttatcaaattcataagctattgtggaattgcccatcttgccgtcaatgggaaagtattaaaccggtttcaaatcaagaacataat

SEQ ID NO: 2138 - protein, 396 aa, Haemophilus influenzae
  Name: NTH1185
MIELLFLLLPIAAAYGWYMGRRSAKKDQDDISNKLSRDYVTGVNFLLSNQTDKAVDLFLDMLQKQEIENEIESHSQFEAELTLGNLFRSRGEVDRALRIHQALDLSPNYTFEQKLLAKQQLARDFMVVGFFDRAENLYILLVDEPEFAENALQQLLVIYQKTKEWKKAVNIAEKLAKIKPQENNIELAQCYCEYSQSLEPESAVEKRSVLQKALSVSPTCVRASLLLANLAMLDGQYQQAVEILENVLEQNPDYTGEILSPLKHCYEELNQLDNFELFLIRAGQIINNDEVELALVKLIEEKDGKSAAQAKLYQQLTKNPSTLIFHRFMQYQIDDAEDGRGKESLILLHKMVGERIKQTSPYRCTNCGYQIHKLLWNCPSCRQWESIKPVSNQEHN

SEQ ID NO: 2139 - DNA, 582 bp, Haemophilus influenzae
  Name: NTH1186
atgtttactacacttggtattaattttgtaaaacaattacatcaacgtaactttgatgtttttttggatcttaaatatcacgatattccaaatacggtagcaagagcagttcgttctgctgctgatttaggcgtatggatggtggatttacacgcaagtggtggtttgcgtatgatggaagaggcgaagaaaattcttgaaccttatgggaaagatgcaccattgcttattgccgtgacggtattaaccagtatggaagatttggatttattacaaattgggattaatgcatcgccaatggaacaagttttacgcttagctcatttaacccaacgggcgggtttagatggtgtagtctgttcccctcaagaagttgaaattttacgtaatacttgtggtaaagagtttaaattagttacaccggggattcgtccaataggaactgattttggtgatcaacgacgtgtgatgacgcctactgcagcaattcgtgcaggttcagattatttagttattggacgccctataactcaagcggataatcctgcggaggttctccgttctattaatgtatctattggg

SEQ ID NO: 2140 - protein, 194 aa, Haemophilus influenzae
  Name: NTH1186
MFTTLGINFVKQLHQRNFDVFLDLKYHDIPNTVARAVRSAADLGVWMVDLHASGGLRMMEEAKKILEPYGKDAPLLIAVTVLTSMEDLDLLQIGINASPMEQVLRLAHLTQRAGLDGVVCSPQEVEILRNTCGKEFKLVTPGIRPIGTDFGDQRRVMTPTAAIRAGSDYLVIGRPITQADNPAEVLRSINVSIG

SEQ ID NO: 2141 - DNA, 114 bp, Haemophilus influenzae
  Name: NTH1187
atgtcagattttgttttagtgtattctacagatgtggggcgaattaaagaggaaaaggcttctgtagttcgcccaaaagagacggtgttgtacgtatccaaaaacaaacagtgg

SEQ ID NO: 2142 - protein, 38 aa, Haemophilus influenzae
  Name: NTH1187
MSDFVLVYSTDVGRIKEEKASVVRPKETVLYVSKNKQW

SEQ ID NO: 2143 - DNA, 543 bp, Haemophilus influenzae
  Name: NTH1188
atggaaagggattttataaggaataattttatgttaaaaaaatatttgatctctttagataaagatattcaacgtcggaaattattcttttctcaaaaaaataccgaggatttccaaattttttctgccattaataccatgcaaaaagattgggatgaattagcctctatttttaatattgaacaatttaaagcacattattttcgtaatgtcactaagggcgagatcggttgtactttaagccacctttctgtgtaccaaaaaattattgaagacaacgatattgctgaagatagctatgcactagtctgtgaagacgatgctttattccactcagattttcagcaaaatttaaccgcacttttatcagaaaaacttgaggctgaaattatattgcttggacagtcaaaaattaataatttcaatgatactgatttagaaattaattatcccacaactttttcttttctatgcaaaaaaacgggcattgtaatttacgccttccttattaaaggttatttgctggcccggggggctttttta

SEQ ID NO: 2144 - protein, 181 aa, Haemophilus influenzae
  Name: NTH1188
MERDFIRNNFMLKKYLISLDKDIQRRKLFFSQKNTEDFQIFSAINTMQKDWDELASIFNIEQFKAHYFRNVTKGEIGCTLSHLSVYQKIIEDNDIAEDSYALVCEDDALFHSDFQQNLTALLSEKLEAEIILLGQSKINNFNDTDLEINYPTTFSFLCKKTGIVIYAFLIKGYLLARGAFL

SEQ ID NO: 2145 - DNA, 792 bp, Haemophilus influenzae
  Name: NTH1189
gtggttgatggtgcaattatgcttttttctgctttggcgttggttaatttaaatataaaacatattttatgggagcattattcttttaattttacgggcaatcgtctcgttcgcacgctcggtaaatatttagctgtaacaacttgcgataaaatagttacattgacagaagcagaaaaaacgctgtggcaagaaaaatttaaaacgaacaatataatcagtattgctaatccaaatacgcttttgccaaagaataaattagcaaaatgggaaaataaaactgttttatctgtaggtcatttattttcttataaaggttttgattatttattaaaagtttggcaagttttggcaaaaaaatatccagattggaatttgaaaatagcgggttcaggcgaggaagaagaaaatttaaaaaatcttgctaaagcattgaatattgaagattcagttaattttattcctcgtactaatgatgttgctttttattatgaaagcagttcaatttattgtttaccttcacaaacagaagggttgcctttagtcgttattgaagcgatggcatttggcttacctattgttgcctttaattgttctcctggcgtaaagcaattagtcgaacataaagaaaatggttttctttgtgaacaaaataatattgaagaaatggttaaaggtttagatttattaatcaataatcctgaactttatcaacaaatgtcagacaaatctcgtttaatgagtgaagattatggcattgagaaaattattgaagaatggaaagggatttta

SEQ ID NO: 2146 - protein, 264 aa, Haemophilus influenzae
  Name: NTH1189
VVDGAIMLFSALALVNLNIKHILWEHYSFNFTGNRLVRTLGKYLAVTTCDKIVTLTEAEKTLWQEKFKTNNIISIANPNTLLPKNKLAKWENKTVLSVGHLFSYKGFDYLLKVWQVLAKKYPDWNLKIAGSGEEEENLKNLAKALNIEDSVNFIPRTNDVAFYYESSSIYCLPSQTEGLPLVVIEAMAFGLPIVAFNCSPGVKQLVEHKENGFLCEQNNIEEMVKGLDLLINNPELYQQMSDKSRLMSEDYGIEKIIEEWKGIL

SEQ ID NO: 2147 - DNA, 171 bp, Haemophilus influenzae
  Name: NTH1190
atgaaaaaaattggtttctttattatgaatatcgaaagtgcgggtggaacggagcgagtttccattaatgttgttaatgctcttgctaaacaggatatgatgtttcttttattagcattggcggtaacaagccttttttccaagttgatgaaaaaattaatatttacccaa

SEQ ID NO: 2148 - protein, 57 aa, Haemophilus influenzae
  Name: NTH1190
MKKIGFFIMNIESAGGTERVSINVVNALAKQDMMFLLLALAVTSLFSKLMKKLIFTQ

SEQ ID NO: 2149 - DNA, 912 bp, Haemophilus influenzae
  Name: NTH1191
atgaatctcattctttgttgtacaccattgcaagtattaattgcgagaaaaataattgaattacatcctaatgaacaattctttggcgtaatgtttggtagggtatgggataaaaaaagaaccttgtatgcgagtaaattagcggaggtttgtagtgattcgatgaatattgatacgggaaaagatctaaaaggtttcgattttctcaagttaatgcgccagcttaagaataaaattacgcacaaaggttttgataaggtttttctcgccaatcttaattcattatggctacaaacttatcttagtcatgtttcatttaaagagctttatacctttgatgatggttcagataatattttcccacatcctaatttattgagagagcctgacacatttaaatataaactgattaaagcttttattggcgataaatatagtgtgaataaattatttaaaaaaataaaaaaacattatacggtttatcctaattacaaaaatattgtttctaatattgaaccaatttctttatgggataatcaaatagattgcgagatagatggtgaggtctcattttttattgggcaaccattgttaaatacaaaagaggaaaatatctcattaataaaaaaattaaaagaacaattttcttttgattattatttccctcatccagcagaagattatcgagttgatggggtaaattatgttgaatctgaattaatttttgaagattacgtatttaaatatttatcaaataaaataataattatttatacgttcttcagttctgttgcatttaatttgttaagtcatcctaatgtagaaattcgttttattagaacgagtattccaagatggcaattctgttacgattcatttccagaccttggattaaagatttataaggaaatt

SEQ ID NO: 2150 - protein, 304 aa, Haemophilus influenzae
  Name: NTH1191
MNLILCCTPLQVLIARKIIELHPNEQFFGVMFGRVWDKKRTLYASKLAEVCSDSMNIDTGKDLKGFDFLKLMRQLKNKITHKGFDKVFLANLNSLWLQTYLSHVSFKELYTFDDGSDNIFPHPNLLREPDTFKYKLIKAFIGDKYSVNKLFKKIKKHYTVYPNYKNIVSNIEPISLWDNQIDCEIDGEVSFFIGQPLLNTKEENISLIKKLKEQFSFDYYFPHPAEDYRVDGVNYVESELIFEDYVFKYLSNKIIIIYTFFSSVAFNLLSHPNVEIRFIRTSIPRWQFCYDSFPDLGLKIYKEI

SEQ ID NO: 2151 - DNA, 480 bp, Haemophilus influenzae
  Name: NTH1192
atgggggctcaacttgctttaattgtttctattgctattcaagcacttaataaagcgattattccctatttttatgaagccttaaaacaaaagaaattagttattcaacagctacataaatgggcgttattttcctttttgctaatacctattcctgccttaataatgtggattattcctgaggatgtgttagtttggattttaggtagtcaatttgtgggaacgaaatattattttattttatttttaatttcgaccacattaagtattccttatttgattttagttaattatcttttctattatgggaaaaataaacttatttcccaatgttccgttttatctacaatcatttatgtggcaagccttgtagctttaacttttacagaaattaaatatatcccttatgctggaattattggttcgctttccattattcctattctttattttatgacatctaaagtgagtaaaacccta

SEQ ID NO: 2152 - protein, 160 aa, Haemophilus influenzae
  Name: NTH1192
MGAQLALIVSIAIQALNKAIIPYFYEALKQKKLVIQQLHKWALFSFLLIPIPALIMWIIPEDVLVWILGSQFVGTKYYFILFLISTTLSIPYLILVNYLFYYGKNKLISQCSVLSTIIYVASLVALTFTEIKYIPYAGIIGSLSIIPILYFMTSKVSKTL

SEQ ID NO: 2153 - DNA, 576 bp, Haemophilus influenzae
  Name: NTH1193
gtgcggaagagacgattaactggctctttaacgagcttaaatcaatttttcctggttggcgtgcagcctttgaaaccgaaagcggattatctctctgctaaaaaaacttggttgcgtgtgttggtacgagaaaaaattacgagacctcagttggagaacgggatttgtgaagcggaaaaatcgcttgataaatttttacctagcgtagggttgttcgtttattggtgcaaagcctacgactatcacgcactaggtttaccgaacgaagcggaattataccaacgttataacactttcttaggctatgcccgattcaatcgggatgaatttcaatatcgttcaaaagtggaattttggttgcttaaaaatctgtacgaaaagtgcaagaaaaaatcggaagaggacacgttgaaagctattccgaaattactcacagaagcggcggaaaaagtgcggtcgaattttccttttgaggatattccgaagatgattccagcaaagccaagtttttacgataaagcgaaggctgataaggcgcgcgatagcttgatggcaatgatgaaaggggcattgcaa

SEQ ID NO: 2154 - protein, 192 aa, Haemophilus influenzae
  Name: NTH1193
VRKRRLTGSLTSLNQFFLVGVQPLKPKADYLSAKKTWLRVLVREKITRPQLENGICEAEKSLDKFLPSVGLFVYWCKAYDYHALGLPNEAELYQRYNTFLGYARFNRDEFQYRSKVEFWLLKNLYEKCKKKSEEDTLKAIPKLLTEAAEKVRSNFPFEDIPKMIPAKPSFYDKAKADKARDSLMAMMKGALQ

SEQ ID NO: 2155 - DNA, 141 bp, Haemophilus influenzae
  n 70, 110: n is any nucleotide
  Name: NTH1195
ttgcattgcgtaccgtccactgtgaaattcattcctgcaaccagcctgtctgcgtatcgcaatttgggtntttggggggggggaaatggcccaaatgcgggaaattgggncccaggttttcatcacgccatccatgatgcg

SEQ ID NO: 2156 - protein, 47 aa, Haemophilus influenzae
  Xaa 24, 37: Xaa is any amino acid
  Name: NTH1195
LHCVPSTVKFIPATSLSAYRNLGXWGGGNGPNAGNWXPGFHHAIHDA

SEQ ID NO: 2157 - DNA, 366 bp, Haemophilus influenzae
  n 188, 228: n is any nucleotide
  Name: NTH1196
atggctgacagtcgtatacgacaactgggaagatttatcgccccgccaacgcaaaagggtattaaccaaggcatttcaccgcttgcaaacaagcggcaagcggggatttcgattgtgagcgtggagatttgcattgacgcaaccggcaggattttacgcatcatggatggcgtgatgaaaacctgggncccaatttcccgcatttgggccatttccccccccccaaanacccaaattgcgatacgcagacaggctggttgcaggaatgaatttcacagtggacggtacgcaatgcaatattccaataccacaaaacccaaattacacgctcccaccagaacgagcacagcgtgcggaagagacgat

SEQ ID NO: 2158 - protein, 122 aa, Haemophilus influenzae
  Xaa 63, 76: Xaa is any amino acid
  Name: NTH1196
MADSRIRQLGRFIAPPTQKGINQGISPLANKRQAGISIVSVEICIDATGRILRIMDGVMKTWXPISRIWAISPPPXTQIAIRRQAGCRNEFHSGRYAMQYSNTTKPKLHAPTRTSTACGRDD

SEQ ID NO: 2159 - DNA, 372 bp, Haemophilus influenzae
  Name: NTH1197
gtgcctgtttatagctatgtagaacatactcgcaccaacgaaacaacgcatttcacaccaaaacgaatcgtaattttagaagggattttattgctcacagacgaaagagtacgccaattagccgatatttctgtattcgtagacacaccacttgatatttgtttcatccgccgtttacaacgtgatatggaagaacgtggtcgctctctacaatcagtgattgatcaatatcgtgcaaccgtgcgtccaatgttcttacaatttattgagccatctaaacaatatgcggatattgtcattcctcgtggtggtaaaaaccgtattgcaatcaatatgttaaaagctcaaatccttcatttattgaatcaaaaa

SEQ ID NO: 2160 - protein, 124 aa, Haemophilus influenzae
  Name: NTH1197
VPVYSYVEHTRTNETTHFTPKRIVILEGILLLTDERVRQLADISVFVDTPLDICFIRRLQRDMEERGRSLQSVIDQYRATVRPMFLQFIEPSKQYADIVIPRGGKNRIAINMLKAQILHLLNQK

SEQ ID NO: 2161 - DNA, 585 bp, Haemophilus influenzae
  Name: NTH1198
atgcgtctttgcgatactgatattgaacgctatctcgatgatggcattatttctttaacaccacgtccaaataatgacaaaatcaatggtgcgacaattgatgttcgcttaggtaattctttccgtgtatttcgtgaacactctgcacctttcattgatttaagtggcccgaaagaagaagtatccgcccagcttgaatcagtaatgagcgatgaaattcttattccagagggggaagcatttttcttacatcctggtactttagccttagcaaccacgcttgaatccgtgaaattgccagccaatattatcggttggttagatggccgttcttctttagcccgtttaggcttaatggtacacgtcaccgcacaccgaattgacccaggttgggaaggaaaaatcgtgctggaattttataattcagggaaattaccattagcattacgcccaaatatggtaattggtgcgttaagttttgaagtattaagtggcgaagcaaaacgaccatacagtagccgcaaagatgcaaaatataaaaatcaacaaagtgcagtagccagtcgtattgacgaagacaaggaa

SEQ ID NO: 2162 - protein, 195 aa, Haemophilus influenzae
  Name: NTH1198
MRLCDTDIERYLDDGIISLTPRPNNDKINGATIDVRLGNSFRVFREHSAPFIDLSGPKEEVSAQLESVMSDEILIPEGEAFFLHPGTLALATTLESVKLPANIIGWLDGRSSLARLGLMVHVTAHRIDPGWEGKIVLEFYNSGKLPLALRPNMVIGALSFEVLSGEAKRPYSSRKDAKYKNQQSAVASRIDEDKE

SEQ ID NO: 2163 - DNA, 1173 bp, Haemophilus influenzae
  Name: NTH1200
atgaaaaagttcgcgcttatcgtagggatcgtcgctttggcgatcttttcttttttatatattcaactttaccgcgtgcaaagtgctattaatgaacaactggcacaacaaaacattgccgttcagtcaatcaatttatcattattttctcccgcactttcccttgaaaatctaaaaactacgcaattttcagctcaaaaaattgaagctaaatttagttttttgcctcttttgtatggaaacgcagcacttcattcactgaatattcaacagctcaaattaactcaaaacacacaaaatcctgccaatgtatcgatagaggtttcgcctttttcgttaaaacagcttttatcaaaaaaagtaatattaaatggcgaaaaccatattcgcattgaatttaataagcctatttatggaaaaacaaaaactttccatttttctttccataaagcgaatttagacttctcaacatcagaatcaaccccacttcaatttgtagatgcaagcctaaataatcagcctatcggttatattgaaagccacacagcccaccaacaaatagtgacttatataaaaccacaatgcgataacgattgtttagccgtattgaaatatcaacaaatagacaatcaaagtgcggtaaatttttcgggtaaatatttccctgttcaacgcttattcgcactattaaatttgccagaaattttaagtggacacgccgattttgatcttgatttcagcttttcatcttccgcgcttattcaaggtaaattaaattttttagcgcaaaatggcgaaattcttggtgtgaatctattggatatggtagcgcaatatttcccgattaattacaacaatgatctgttacaaaacaaagaattaaacactcgctttgaacaattttacttgcaattatttctccaacaaaatcaactcattgctgaaaaaatcgaattaaaaacgcccgcacttttggggcaaggaaaaggcatcattgatttaaatcgaatggaatgcaatgtggatattaatttaaattctacggatcaacgctatcaaaatttgacacttccaatcaatttttttggtaactgcaattctccacaatacaaaattaattttacgaagaaattccgccatcaattaattgatgcgattaaagaaaagttacgt

SEQ ID NO: 2164 - protein, 391 aa, Haemophilus influenzae
  Name: NTH1200
MKKFALIVGIVALAIFSFLYIQLYRVQSAINEQLAQQNIAVQSINLSLFSPALSLENLKTTQFSAQKIEAKFSFLPLLYGNAALHSLNIQQLKLTQNTQNPANVSIEVSPFSLKQLLSKKVILNGENHIRIEFNKPIYGKTKTFHFSFHKANLDFSTSESTPLQFVDASLNNQPIGYIESHTAHQQIVTYIKPQCDNDCLAVLKYQQIDNQSAVNFSGKYFPVQRLFALLNLPEILSGHADFDLDFSFSSSALIQGKLNFLAQNGEILGVNLLDMVAQYFPINYNNDLLQNKELNTRFEQFYLQLFLQQNQLIAEKIELKTPALLGQGKGIIDLNRMECNVDINLNSTDQRYQNLTLPINFFGNCNSPQYKINFTKKFRHQLIDAIKEKLR

SEQ ID NO: 2165 - DNA, 1206 bp, Haemophilus influenzae
  Name: NTH1201
atgtcgttatatttaaaagctgaaaaaatccaatcatggcgcgtgcttattatggcttgcgcaggatttatttttaatactacagaatttgtacccgttgcaatgttaagcgatattgcacaaagttttgatatgcaaactgctgatactggtttaatgatgacagtttatgcttggacggtgctaattatgtctttaccagcgatgcttgccacgggcaatatggaacgtaaaagtctgcttattaagcttttcattatatttattgttgggcatattttattggtcattgcatggaatttctggatattacttctcgctcgaatgtgtattgcattagcccattcggtgttttggtcaattactgcctcacttgtgatgcgcatctcacctaaacacaagaaaactcaagcattaggaatgctcgctattggcaccgcacttgccaccatcttaggcttaccgattgggagaatcgtcggacagcttgtcggttggcgagtcacttttggcattattgcggtactggcattatccatcatgtttttaattattcgattattgccaaatttacccagtaaaaatgctggctctattgcaagtttacccttgcttgcgaaacgcccattattactttggctttacgtaacaacggcaatcgtcatttcagcacattttactgcttatacttatatcgaaccatttatgattgatgtcgggcatttagatccaaattttgccacggctgtattattagtttttggtttctcaggcattgcagcaagcctattatttaacagattataccgatttgctcccacaaaatttattgttgtttcgatgagtttattgatgttctctctattgctcctgttattttcaactgaagcaataatagcaatgttcagccttgtgtttatttgggggattggcatttcttgtatcggactatctctacaaatgcgcgtactaaaacttgcgccagatgcaaccgatgttgccacagctatttactcgggcattttcaatgcaggaattggcgcaggcgcattatttggaaaccttgcgacaacctatttaggattaaatgaaattggttatacaggcgcagcattaggtttaatcggtttcatcatttttattacaacgcacttaaaatatcgccatacctttcttctgcaaaacaataaaaaaataaccgcactt

SEQ ID NO: 2166 - protein, 402 aa, Haemophilus influenzae
  Name: NTH1201
MSLYLKAEKIQSWRVLIMACAGFIFNTTEFVPVAMLSDIAQSFDMQTADTGLMMTVYAWTVLIMSLPAMLATGNMERKSLLIKLFIIFIVGHILLVIAWNFWILLLARMCIALAHSVFWSITASLVMRISPKHKKTQALGMLAIGTALATILGLPIGRIVGQLVGWRVTFGIIAVLALSIMFLIIRLLPNLPSKNAGSIASLPLLAKRPLLLWLYVTTAIVISAHFTAYTYIEPFMIDVGHLDPNFATAVLLVFGFSGIAASLLFNRLYRFAPTKFIVVSMSLLMFSLLLLLFSTEAIIAMFSLVFIWGIGISCIGLSLQMRVLKLAPDATDVATAIYSGIFNAGIGAGALFGNLATTYLGLNEIGYTGAALGLIGFIIFITTHLKYRHTFLLQNNKKITAL

SEQ ID NO: 2167 - DNA, 474 bp, Haemophilus influenzae
  Name: NTH1202
gtgaaatctgagcttgatcgtcgtttagattttattgattttgctcgggtgcattttatttcagccttgcacggaagtggtgtaggtaatctttttgattcgattaaagaagcctatgcttgtgccactcaaaaaatgacgacttcgcttttaactcgtattttgcaaatggcaacggatgagcaccaaccgccgatgattggcggtcgtcgcattaaattaaaatatgctcacccaggtggttataatccgccgattatagtagttcacggtaaccaaatggataaactaccagattcttataaacgttatttatctaattattatcgtaagagcttaaaaattattggttcaccgattcgtctgcttttccaagaaggctcaaacccatttgcaggacgcaaaaataaactcactccgaatcaattgcgtaaacgtaaacgtttgatgaagtttattaagaaagcaaaacgt

SEQ ID NO: 2168 - protein, 158 aa, Haemophilus influenzae
  Name: NTH1202
VKSELDRRLDFIDFARVHFISALHGSGVGNLFDSIKEAYACATQKMTTSLLTRILQMATDEHQPPMIGGRRIKLKYAHPGGYNPPIIVVHGNQMDKLPDSYKRYLSNYYRKSLKIIGSPIRLLFQEGSNPFAGRKNKLTPNQLRKRKRLMKFIKKAKR

SEQ ID NO: 2169 - DNA, 165 bp, Haemophilus influenzae
  Name: NTH1203
atgaccaattttagattaaacgtgcttgcctattccgttatgcttgggctaacggcaagtgttgcttatgcagagccaaccaaccaaccaaccaaccaaccaaccaaccaaccaaccaaccaaccaaccaaccaaccaaccaaaatagtaatgcttctgaacaac

SEQ ID NO: 2170 - protein, 55 aa, Haemophilus influenzae
  Name: NTH1203
MTNFRLNVLAYSVMLGLTASVAYAEPTNQPTNQPTNQPTNQPTNQPTKIVMLLNN

SEQ ID NO: 2171 - DNA, 150 bp, Haemophilus influenzae
  Name: NTH1204
atgagagaatctgcacctttggtaattttggcatcagataaagtttcaatttcaattccattacgcgtgttattaaaattaccatatccttcaaacaggtctttaaaaccttgggaagataatgttctgcttgagcaacgccatcaaccg

SEQ ID NO: 2172 - protein, 50 aa, Haemophilus influenzae
  Name: NTH1204
MRESAPLVILASDKVSISIPLRVLLKLPYPSNRSLKPWEDNVLLEQRHQP

SEQ ID NO: 2173 - DNA, 219 bp, Haemophilus influenzae
  Name: NTH1205
ttgaaggatatggtaattttaataacacgcgtaatggaattgaaattgaaactttatctgatgccaaaattaccaaaggtgcagattctctcatgtctggtagtggtgcattgggtggctccgtcatctataaaactaaagatgcaagagatcttctgcttaacaaaaactacgcgtttaaatataaaactggttttaccagcgagaatgatgaaagat

SEQ ID NO: 2174 - protein, 73 aa, Haemophilus influenzae
  Name: NTH1205
LKDMVILITRVMELKLKLYLMPKLPKVQILSCLVVVHWVAPSSIKLKMQEIFCLTKTTRLNIKLVLPARMMKD

SEQ ID NO: 2175 - DNA, 2208 bp, Haemophilus influenzae
  n 2205: n is any nucleotide
  Name: NTH1206
ttgaaaattggtacaaatcttggtgaaaataatcgcattgccgtagcctatgatagaagacgggttgaaaataaaggtctagacaaatcttactcattacatggatgcacgaaatatgtttgtgatgataatgaaatagatactcgccatactcatgatgaaagcattagaaccagtaaatctatagcatttgaaaatacaaatataaacccactttgggataccctaaaactctcttatacagatcaaagtattactcaacgagcaagaagtgacgaacattgtgatggtgaacggtgtcctggggtacaaaaccccataggactacattataacaacgataataaacttgttgataaaaataataatcctgtaacctataaattagaaaatcgttctgtaacatactattcttacattgatgaatctatctttaatcgatacagtaactttaaagaagaagttcctgtagaactcgctaaggaatggaaacttaaagaatatggtggaaaatattatattgactcgcctcgctgctttaaaaatcacggtgatgctaatcacgaggggatgtgtagactaagatctgatgtaaaagaggaaaaggaaacattagtagctaataacatcacttatgatttaaaaaaggagtattttattaactcaaggctcacgaatagtgataatttattatcttgtgatggaattaactgtgataaaggtacaattcaaggtttcgaagctgatggaacgcctaaggatttaccaataaaaataatcccaaaagaaggtaaaaaatttgcacttattgaaaaaatttcagatcaaaatggctacaatattggcccagagaaagcatctcgttttctagtacctaattcacctggttataatagaaacatttggaaaaaacgtgaccttgatactcgtactcaacaaattaatttggatttaacaaaacattttgaactaggaaaaagccaacatgatttatcttatggtttagtttggagtaaaacaacaaaatcaatgataaataaagaagggttaaaagttaatagtggaaaatggtggattgattatccaaaagactgtgaatctagtacatcagatttatgtacaaaaaatagtacagcatcatttcttattcctgtagaaacaaaagatggttctctctattttaaagatgaatttagagtaaatgatcgtcttggcttagatatcggttatcgatatgacaaagtcaaatacaaaaccaattatcaaccgggtataacgccaaaaatccctgatgatatgttagttaatttatttataaaagaaccttttgtaaaaaacacacggagtctaaaccctaatgatccaaatgaaattaatcgacgaaaaaatgcagaagctaatattaattatatttctcaacccaaaaaatttaatgcgagttcttatgctttaagcacaaaattcgatccattggattggttacaagttcaagcaaaatatagcaaaggtttcagagcaccaacagctgatgaattatacttcacattcaagcacccagaatttactgttcttccaggctctaaattaaaacctgaaattgcaaaaactaaggaattatcattaactttacatgatgatgaaatcggttttatttctggtggatatttcatcacaaattataataattttattgattttagttatctaggaacaaaatcatttggttctcaagcaactaagcatgaattatatcaatctgttaatttagataatgctaaagtgacaggatttgaattgaaaaccaaatttacattaggaaaatggatatcatggttgaagaatgttgattttggttaccaattaactaaacaaaaaggtaaagcaagcgataaccgcccacttaatgctattcagccaatgacacaagtgatgagtttagcctatacgcatcctgataatctgtttggggcaaatttatatcttactcatgtttcccaaaaagaagcgagtgacacatataacatttattcaaaagatgctacagcaggagataaagaatatgttcaaaataaacatattaaatggcgtagtaaagcttacacagtgacagattttactttcttcgtgaaacctatgaagaatttaactttacgagcgggtgtttacaatttatttgacaaaaaatatagacttgggatggggatncta

SEQ ID NO: 2176 - protein, 736 aa, Haemophilus influenzae
  Xaa 735: Xaa is any amino acid
  Name: NTH1206
LKIGTNLGENNRIAVAYDRRRVENKGLDKSYSLHGCTKYVCDDNEIDTRHTHDESIRTSKSIAFENTNINPLWDTLKLSYTDQSITQRARSDEHCDGERCPGVQNPIGLHYNNDNKLVDKNNNPVTYKLENRSVTYYSYIDESIFNRYSNFKEEVPVELAKEWKLKEYGGKYYIDSPRCFKNHGDANHEGMCRLRSDVKEEKETLVANNITYDLKKEYFINSRLTNSDNLLSCDGINCDKGTIQGFEADGTPKDLPIKIIPKEGKKFALIEKISDQNGYNIGPEKASRFLVPNSPGYNRNIWKKRDLDTRTQQINLDLTKHFELGKSQHDLSYGLVWSKTTKSMINKEGLKVNSGKWWIDYPKDCESSTSDLCTKNSTASFLIPVETKDGSLYFKDEFRVNDRLGLDIGYRYDKVKYKTNYQPGITPKIPDDMLVNLFIKEPFVKNTRSLNPNDPNEINRRKNAEANINYISQPKKFNASSYALSTKFDPLDWLQVQAKYSKGFRAPTADELYFTFKHPEFTVLPGSKLKPEIAKTKELSLTLHDDEIGFISGGYFITNYNNFIDFSYLGTKSFGSQATKHELYQSVNLDNAKVTGFELKTKFTLGKWISWLKNVDFGYQLTKQKGKASDNRPLNAIQPMTQVMSLAYTHPDNLFGANLYLTHVSQKEASDTYNIYSKDATAGDKEYVQNKHIKWRSKAYTVTDFTFFVKPMKNLTLRAGVYNLFDKKYRLGMGXL

SEQ ID NO: 2177 - DNA, 273 bp, Haemophilus influenzae
  n 260, 261, 262, 263, 264: n is any nucleotide
  Name: NTH1207
atgacaacattgggcgagcgattgaaatttttgctgattgaaaggaatgttacacaagcagaattggcggaaatggtgggaactacccaaggtgcgatcagtaatatcgtgaaaggtgaaactcaaaaaccaagaaatattcttgagattgccaatgcgttaggtgtagatccaaactggttaaaatatgggagtacaaaaatgacaaaatttcgagagagattaaaagcgggataccgaggccgatataagcaaacatnnnnnttaattaat

SEQ ID NO: 2178 - protein, 91 aa, Haemophilus influenzae
  Xaa 87, 88: Xaa is any amino acid
  Name: NTH1207
MTTLGERLKFLLIERNVTQAELAEMVGTTQGAISNIVKGETQKPRNILEIANALGVDPNWLKYGSTKMTKFRERLKAGYRGRYKQTXXLIN

SEQ ID NO: 2179 - DNA, 204 bp, Haemophilus influenzae
  Name: NTH1208
ttgatcaataaaacaattaaaattgcgattgatgaatgtggtggtcaagccaaattagcaaagctgtgcagtgtcgcacagcctacggtttttgcttggcttcaccgtggtggtattagtggcaaatacatcccgcttatcgccaaagcatccaatggaaaagtcaccgaaaccgacatcttgcgctcactcacaaagtcacaa

SEQ ID NO: 2180 - protein, 68 aa, Haemophilus influenzae
  Name: NTH1208
LINKTIKIAIDECGGQAKLAKLCSVAQPTVFAWLHRGGISGKYIPLIAKASNGKVTETDILRSLTKSQ

SEQ ID NO: 2181 - DNA, 450 bp, Haemophilus influenzae
  Name: NTH1209
atgaacagtaaagacattcagcgcacgttacatcgcgattgtaaaaacgcatctggcggtatcactacgctggcactcacgctaggcaaatcgccgaatattttaggcaataaacttaacgtagaatgcgaaaacaatcatctcagctttatcgaagccctcgatctcatcgaaatcaccaatagcacgcgcaccgtcgccgccattgccgacaaaatcgatcatcttatcgtacctatgcccaaatgcgccagttgctgcgccgatgtcgtgcaaggctttttagacattaccaccaatgcagggaaaattggcgaacaaatcaaaagcgcagtccatcctaattcagatttagggcgcgagttatccaacaaagaaaaacaaacgatttccgccagcattgacgcgctcattgaaagcgcattgtgcttaaagtgggaattagagcaa

SEQ ID NO: 2182 - protein, 150 aa, Haemophilus influenzae
  Name: NTH1209
MNSKDIQRTLHRDCKNASGGITTLALTLGKSPNILGNKLNVECENNHLSFIEALDLIEITNSTRTVAAIADKIDHLIVPMPKCASCCADVVQGFLDITTNAGKIGEQIKSAVHPNSDLGRELSNKEKQTISASIDALIESALCLKWELEQ

SEQ ID NO: 2183 - DNA, 231 bp, Haemophilus influenzae
  Name: NTH1210
atggagaatactaatccaaacgaaaaaataagtcaatcgcaatgtgaccgtattttgcgttatttgcaatcaggtaagcgactgacatcactcgaagctttagacaaattcggttgcttgcgtctttcggcgcgaattttagatttaaaaaaccgctggcatcagatttcggacgagttcgtccacgatgcacgcacaggcaaagtatataaagcgtattttatggcggta

SEQ ID NO: 2184 - protein, 77 aa, Haemophilus influenzae
  Name: NTH1210
MENTNPNEKISQSQCDRILRYLQSGKRLTSLEALDKFGCLRLSARILDLKNRWHQISDEFVHDARTGKVYKAYFMAV

SEQ ID NO: 2185 - DNA, 666 bp, Haemophilus influenzae
  n 661, 662, 663, 664, 665: n is any nucleotide
  Name: NTH1211
atgagtgttgagttaatgactaaagcatttaaaagcaaaaccggcaatcctttaacaaaattagtgctggtaaaattagccgataatgcgaatgatgatggcgtttgttatccaagttataaacgtattgcaatccaatgtgaagtttcgcgccctacggcaatttcgcacgttaagaaattggaagcgatgaaatatttatccattcgtgaacgtaaaaccgaaaacggcaacgccactaatgtgtatatcttgcatcccgaaaactgggaaatattagagccttttactagtaaagcagctttaccacccctagtaaacgagcttaaccaccctagtaaagcagctttaccacccctagtaaacgagcttaaccctgaaccatcaatagaaccatcagataaccatcatattaaaaaaactacgcaaaaaagcgaatccgaaatgttgcttgagcagttcggtattaccggacaactggcgaaagattttatcgcacaccgcaaagccaaaaagggcgtaattaaccaaacgcaactcaaccgcctgcaaaaacaagcggacaaggcggggatttcgatttgtgaagcggtggagatttgcattgaacgcaactggcagggatttaacgcatcatgggattggcgtgatgaaaaactgnnnnnt

SEQ ID NO: 2186 - protein, 222 aa, Haemophilus influenzae
  Xaa 221, 222: Xaa is any amino acid
  Name: NTH1211
MSVELMTKAFKSKTGNPLTKLVLVKLADNANDDGVCYPSYKRIAIQCEVSRPTAISHVKKLEAMKYLSIRERKTENGNATNVYILHPENWEILEPFTSKAALPPLVNELNHPSKAALPPLVNELNPEPSIEPSDNHHIKKTTQKSESEMLLEQFGITGQLAKDFIAHRKAKKGVINQTQLNRLQKQADKAGISICEAVEICIERNWQGFNASWDWRDEKLXX

SEQ ID NO: 2187 - DNA, 690 bp, Haemophilus influenzae
  n 677, 678, 679, 680, 681: n is any nucleotide
  Name: NTH1212
ttgcaccttaccagagaaaacaaaatgacaacccaaaacttccttgtagaaatcggcacagaagagctgccaccaaaagctctcaaaacattagcgacctcttttgcggataacgttgaggcggaattgaatcaagcaggtttatcattcgataaaatcgaatggtttgcggcaccgcgtcgtttagccgtaaaagtgttgaacttagcaacccaacaaccgagcaaagaaatcgaaaaacgagggcctgcagtatcagccgcctttgatgcggaaggtaaaccaactaaagcggcagaaggctgggcgcgtggttgtggcattactgttgagcaagcagaacgcattgcaactgataaaggcgaatggctcgttcaccgtacaaaaattaaaggtcagccgaccaaaaacttacttaacgatattgtggcaaatgcgttagcgaaattgccaattccaaaaccaatgcgttgggcagataaaaccgtgcaatttatccgcccagttcacactgtgactatgttgttaggtgatgagttaatcgaaggcgaaattttaggtgtggcaagtgctcgcaccattcgcggtcaccgcttcttaggcgagaaagaatttgacattcaacatgcagaccaatatccgcaattattgcgtgataaaggttctgtggtggcagnnnnnttaattaat

SEQ ID NO: 2188 - protein, 230 aa, Haemophilus influenzae
  Xaa 226, 227: Xaa is any amino acid
  Name: NTH1212
LHLTRENKMTTQNFLVEIGTEELPPKALKTLATSFADNVEAELNQAGLSFDKIEWFAAPRRLAVKVLNLATQQPSKEIEKRGPAVSAAFDAEGKPTKAAEGWARGCGITVEQAERIATDKGEWLVHRTKIKGQPTKNLLNDIVANALAKLPIPKPMRWADKTVQFIRPVHTVTMLLGDELIEGEILGVASARTIRGHRFLGEKEFDIQHADQYPQLLRDKGSVVAXXLIN

SEQ ID NO: 2189 - DNA, 414 bp, Haemophilus influenzae
  Name: NTH1214
atgacattacagaaatttttgttacccccattattatttttatcaataaatacctttgcagcaccagcatatttgctttttggtggagataatcatgataaatttttaggctgtttgaactgtagtaaacatgataactcatcaatttggaataaatatggtgaattcggctctaaatataatagcgatagtatttggaataaatacggaacttatggctctaagtataacagtgaaagtccttggaataagtattctacaagtgggccagtgattgttgataatgaaggtaacttttatggtaaattcacaactaataagtatgataatcagacaagaattaaatctcttctttggattttagaaaatcatgaatatattattgaaaatattaatgatgtgatagataaaatg

SEQ ID NO: 2190 - protein, 138 aa, Haemophilus influenzae
  Name: NTH1214
MTLQKFLLPPLLFLSINTFAAPAYLLFGGDNHDKFLGCLNCSKHDNSSIWNKYGEFGSKYNSDSIWNKYGTYGSKYNSESPWNKYSTSGPVIVDNEGNFYGKFTTNKYDNQTRIKSLLWILENHEYIIENINDVIDKM

SEQ ID NO: 2191 - DNA, 363 bp, Haemophilus influenzae
  Name: NTH1215
atgcaaccctatgaaaaatacttaaagctgaattcgcagaaactgcgagcggatcaaacggatacagaaagaaagctatggcaacgcatcaatcgagatcaattattaggatttcgatttaatcgacaaaagccacttttaagttatatcgttgatttttattgtgcaaagacaaagctgattattgaattagatggtagtcagcactataaacctgattatcaggaaaaagatgcattgcgagatgcagaattaaattcacttggttttacagtgatgcggtttagcaatgatgaagtcatgcgtgaaattgaagcggtagtagagcagatttatttgtttttagagaatgtaaggactgat

SEQ ID NO: 2192 - protein, 121 aa, Haemophilus influenzae
  Name: NTH1215
MQPYEKYLKLNSQKLRADQTDTERKLWQRINRDQLLGFRFNRQKPLLSYIVDFYCAKTKLIIELDGSQHYKPDYQEKDALRDAELNSLGFTVMRFSNDEVMREIEAVVEQIYLFLENVRTD

SEQ ID NO: 2193 - DNA, 159 bp, Haemophilus influenzae
  Name: NTH1216
atgaaaactgctgttctatctttcccaaaacttaaaaaattacttttaactttgataggtctaaaacaacatcgccatttggtaataacaatgcaggaatgcctaaatagccatttgctttcgagttatcaaattctgcactgctatcgcgtaaacgaa

SEQ ID NO: 2194 - protein, 53 aa, Haemophilus influenzae
  Name: NTH1216
MKTAVLSFPKLKKLLLTLIGLKQHRHLVITMQECLNSHLLSSYQILHCYRVNE

SEQ ID NO: 2195 - DNA, 156 bp, Haemophilus influenzae
  Name: NTH1217
atgacttcattacctaatctcaaacaattcattcgtttacgcgatagcagtgcagaatttgataactcgaaagcaaatggctatttaggcattcctgcattgttattaccaaatggcgatgttgttttagacctatcaaagttaaaagtaattttt

SEQ ID NO: 2196 - protein, 52 aa, Haemophilus influenzae
  Name: NTH1217
MTSLPNLKQFIRLRDSSAEFDNSKANGYLGIPALLLPNGDVVLDLSKLKVIF

SEQ ID NO: 2197 - DNA, 732 bp, Haemophilus influenzae
  Name: NTH1218
atgttcaaccttcacgccgcccaacggacggtcgttacggtgaaaaccccaaaccgtttacaacactactatcaattccaagtagtgatcaaaccttctccagataatattcaagaactttatttaggctcgcttgaaatgctcggtttcgatccaacacaaaacgacatccgtttcgtggaagataactgggaaaacccaacattaggtgcatggggcttgggttgggaagtatggctaaacggtatggaagtaacccagtttacctatttccaacaagtgggtggcttagaatgtaaacccgtaacaggtgaagtgacttacggtttagagcgtttagcgatgtacattcaaggcgtagattctgtgtatgacttagtttggtctgacggtccattaggcaaaaccacttatggcgatgttttccatcaaaatgaagttgagcaatcaacctataactttgaacacgcaaacaccgatttcttattctactgcttcgatcaatacgaaaaagaagcacaagagttattagccttagaaaaaccgttaccattgccagcttatgaacgtattttgaaagcagcacacagctttaacttattagatgcgcgtaaagcaatttcggtcaccgaacgccagcgctatattttacgcattcgtgccttaaccaaaggcgtggcggaagcctattatgcaagccgtgaagccttaggtttcccaggttgtaaaaaa

SEQ ID NO: 2198 - protein, 244 aa, Haemophilus influenzae
  Name: NTH1218
MFNLHAAQRTVVTVKTPNRLQHYYQFQVVIKPSPDNIQELYLGSLEMLGFDPTQNDIRFVEDNWENPTLGAWGLGWEVWLNGMEVTQFTYFQQVGGLECKPVTGEVTYGLERLAMYIQGVDSVYDLVWSDGPLGKTTYGDVFHQNEVEQSTYNFEHANTDFLFYCFDQYEKEAQELLALEKPLPLPAYERILKAAHSFNLLDARKAISVTERQRYILRIRALTKGVAEAYYASREALGFPGCKK

SEQ ID NO: 2199 - DNA, 114 bp, Haemophilus influenzae
  Name: NTH1220
ttgttcgttaatcaacaaaaagtgcggtcatttttcaccgcactttttacctgttatttgattttgctaaatcaaatagctgctcaaatagccaagagtgggcagaataatacc

SEQ ID NO: 2200 - protein, 38 aa, Haemophilus influenzae
  Name: NTH1220
LFVNQQKVRSFFTALFTCYLILLNQIAAQIAKSGQNNT

SEQ ID NO: 2201 - DNA, 1290 bp, Haemophilus influenzae
  Name: NTH1221
ttgttgattaacgaacaaaaggattttcccttggatagcattccccttagtactttatttattattcttattatctgtttagttttatcagcctatttttctggttctgaaactggactactctccctcaataaatatcgtcttcgttttctatctgaacaaggcaataaaggcgcgaaaaaagcggaaaaactgctagaaaagccagatactttgttaagttttattcttatttttaataaccttgtgaatatcagcgcatctgcaattgcaacagtaattggtatgcgtttatatggcgatgctggcgtggcgattgcaacgggtttgctcactttcgtaatgcttgtattttctgaaatattccccaaaacggtggctgcaatgcacgcagaaaaagtgagttttttttcaagtcatattttaacttcattgcttaaaatcttttatccgctcgtttggttaatgaatatttttactaaatccttgatgcaaatagtagggttaaaacttgatatgcaaaaacaagtaattagtagtgaagaactgcgtagtattgtgtcagaagcaggcgaagcaacaccaaatgaacaacatccacaaatgttgctgtctattttggatatggagacagtcactgttgatgacattatggttccccgcaacgaaatcggcggtataaatattgatgatgattggcgagctattatgcgccagctcaatcatgctgcacataaccgcgtggtgctttacaaaggcagccttgatgaacaagtgcttggcattttgcgcgtgcgtgaagcattccgcttactgcttgaaaaaaatgaatttaccaaagaaaccttaattcgtgccgcagatgaagtgtatttcattcctgaaagcacgccattaaaaacgcaacttgcaaatttccgtacaaataaagagcgaattggcttagttgtagatgaatacggcgatattaaagggcttgtgacgttggaagatattttggaagaaattgttggggattttaccacttccaccgccccaagcattgacaaagaagtaattcaacagtctgatggttcaatgattatcgatggctccgctaatctacgcgatctcaacaaaatgtttaactgggaattagatacagaagatgctcgtacttttaatggtttaatcttagaacacttagaggaaatacccgatgaaggcacgatttgcgaaattgatggtttgctaatcactattcttgaagtgggcgataatatgataaaacaggcgaaagtcgtcaaactt

SEQ ID NO: 2202 - protein, 430 aa, Haemophilus influenzae
  Name: NTH1221
LLINEQKDFPLDSIPLSTLFIILIICLVLSAYFSGSETGLLSLNKYRLRFLSEQGNKGAKKAEKLLEKPDTLLSFILIFNNLVNISASAIATVIGMRLYGDAGVAIATGLLTFVMLVFSEIFPKTVAAMHAEKVSFFSSHILTSLLKIFYPLVWLMNIFTKSLMQIVGLKLDMQKQVISSEELRSIVSEAGEATPNEQHPQMLLSILDMETVTVDDIMVPRNEIGGINIDDDWRAIMRQLNHAAHNRVVLYKGSLDEQVLGILRVREAFRLLLEKNEFTKETLIRAADEVYFIPESTPLKTQLANFRTNKERIGLVVDEYGDIKGLVTLEDILEEIVGDFTTSTAPSIDKEVIQQSDGSMIIDGSANLRDLNKMFNWELDTEDARTFNGLILEHLEEIPDEGTICEIDGLLITILEVGDNMIKQAKVVKL

SEQ ID NO: 2203 - DNA, 459 bp, Haemophilus influenzae
  Name: NTH1222
ttgaaccgcacttttgacttggatcataagtgcggttctttttttgcgcattttttagaaaagatttttataattctttctaggtatattttgatagagaagaaagatatggaacacgaatatcaacgggcggtgactcgcgtgtgcgtacaaacggcactgctcttgttacaacatggggcagaaagtaccgtggtggtgcaaatggcacagcgtttaggcgtagcacttggcgtagaaagtgtagaatgtgcgcttacggcaaatgcagttgtgctgacgaccttatcagataatcattgcattactaccgcacgaaaaaatacagataaaggcattaatatgcaaatggttactgatgttcaacgcattgtgattgccgttgagcatcatttgtatgagttagagatcgtacaaagaaaactggatcaattaaaccgcttaaatatacccgatggt

SEQ ID NO: 2204 - protein, 153 aa, Haemophilus influenzae
  Name: NTH1222
LNRTFDLDHKCGSFFAHFLEKIFIILSRYILIEKKDMEHEYQRAVTRVCVQTALLLLQHGAESTVVVQMAQRLGVALGVESVECALTANAVVLTTLSDNHCITTARKNTDKGINMQMVTDVQRIVIAVEHHLYELEIVQRKLDQLNRLNIPDG

SEQ ID NO: 2205 - DNA, 180 bp, Haemophilus influenzae
  Name: NTH1224
atgattggcttatcttgtgcagcattcgcccatttatctggcggagactggataatttgtagcattacctttgtggcagccgccattgccatgtttgtgcgacaagaattttctaaacggcactataatccccttatcgtcttttccatcacctctttcgtcgcctctctgattctggcg

SEQ ID NO: 2206 - protein, 60 aa, Haemophilus influenzae
  Name: NTH1224
MIGLSCAAFAHLSGGDWIICSITFVAAAIAMFVRQEFSKRHYNPLIVFSITSFVASLILA

SEQ ID NO: 2207 - DNA, 225 bp, Haemophilus influenzae
  Name: NTH1225
gtgagcttaaaatataacttaggtaacgatcctcaaattgctttagcgtctagtgtgttattacttgtgccagggtttcctctgattaattctttggcggatatattaaaaggttatgtgaatatgggattaggccgttggacgattgcgactgttctcacttttggcgcatgtcttggtattgtattcgctttaagcctattacatattacaacttgggggcat

SEQ ID NO: 2208 - protein, 75 aa, Haemophilus influenzae
  Name: NTH1225
VSLKYNLGNDPQIALASSVLLLVPGFPLINSLADILKGYVNMGLGRWTIATVLTFGACLGIVFALSLLHITTWGH

SEQ ID NO: 2209 - DNA, 477 bp, Haemophilus influenzae
  Name: NTH1226
atgttatcagacatcacaatatttatcttgaaattactcgatgatatgctatgtgctgcgattccagcggtgggctttgctttagtatttaatgtgccgcccaaagccttaaaatattgtgcaattttagccgcacttgggcatgttacacgcacattattactgcatattaatatgcctattgtatttgctacattctttgccacttgtgtgattggatttttaggcgtgcatctttcccatcgttatttagcccatcccaaagccttcaccgttgccgcaattatccccatgatccccggtgttcatgcttataaagcaatgatttcaatggtacaaattcatcattttggcttttctgatgctttatttgaacagatgattagctcctttattaataccagttttatcctaggcgcaatagtatttggattagctttaccaggcttattgttttatcgacaaaaacctgtggtg

SEQ ID NO: 2210 - protein, 159 aa, Haemophilus influenzae
  Name: NTH1226
MLSDITIFILKLLDDMLCAAIPAVGFALVFNVPPKALKYCAILAALGHVTRTLLLHINMPIVFATFFATCVIGFLGVHLSHRYLAHPKAFTVAAIIPMIPGVHAYKAMISMVQIHHFGFSDALFEQMISSFINTSFILGAIVFGLALPGLLFYRQKPVV

SEQ ID NO: 2211 - DNA, 339 bp, Haemophilus influenzae
  Name: NTH1227
atggtaaaaattgagcgtaaggcgacagattctgcgtatcatgaatttacaaaaattcttacttcatccgctcaattagtggcttttttaaatcaatctgattttgtgaaagcgagagctaaagttgaaaatgaaactgttcagcaaattgcctcacattttaagttttctcaagaaaataatcttaatcaattaattctatcctcttttgatcgtaaagaagaggatcaactttttgtggaatacattcgttatgtgaataatcaagcgcgccaaacattaaataatgaattgattacaaaatggaaatcgttatttgaaaaaagaaaaattacggat

SEQ ID NO: 2212 - protein, 113 aa, Haemophilus influenzae
  Name: NTH1227
MVKIERKATDSAYHEFTKILTSSAQLVAFLNQSDFVKARAKVENETVQQIASHFKFSQENNLNQLILSSFDRKEEDQLFVEYIRYVNNQARQTLNNELITKWKSLFEKRKITD

SEQ ID NO: 2213 - DNA, 594 bp, Haemophilus influenzae
  Name: NTH1228
atgatcgatccaaatttactccgtaataatttagcagaagtcgcagaaaaattaaaagtaaaacgcaactttatgcttgatacggaaaaactcaccgcgttagaagatcagcgcaaaaacttacaagtcactaccgaaaacttacaagcggaacgtaatgctcgttccaaagccattggtgctgctaaagtgcgtggtgaagatatcgcaccattattggcagaaatggatgatatgggcaatcaattgactgaagcaaaagcacaattagatgcggtacttgcagaaatcaatcaaattgcattaagtattccaaatctacccgcagacgaagtgccattaggcaaagatgacacagaaaataaagaaatcttacgttggggtacaccgcatacatttgattttgaagtgaaagatcatatcactttgggtgaagaagcaaatggcttagattttgctgctggggctaaattagctggtgcgcgttttgccgtaatgaaaggtcaaatcgctaaaatgcaccgcgcattggcacaattcatgttagatcttcatactgaacaacacggctatttagaaacctatgtgccttat

SEQ ID NO: 2214 - protein, 198 aa, Haemophilus influenzae
  Name: NTH1228
MIDPNLLRNNLAEVAEKLKVKRNFMLDTEKLTALEDQRKNLQVTTENLQAERNARSKAIGAAKVRGEDIAPLLAEMDDMGNQLTEAKAQLDAVLAEINQIALSIPNLPADEVPLGKDDTENKEILRWGTPHTFDFEVKDHITLGEEANGLDFAAGAKLAGARFAVMKGQIAKMHRALAQFMLDLHTEQHGYLETYVPY

SEQ ID NO: 2215 - DNA, 846 bp, Haemophilus influenzae
  n 841, 842, 843, 844, 845: n is any nucleotide
  Name: NTH1229
atgaaaagcctattagatatttttactcgagttcaaaaaacatttgtttttgcaaccgcacttttattcgcattttccttgtttactcaagcggaaatggtggatacctatcaattccaaaatcaagatgatcgtactcgtgccgtagagttggcaaaatctttacgctgcccacaatgtcaaaaccaaaatttggtggaatctaattctccaattgcttatgacttgcgtcttgaagtgtacaaaatggtggatgagggcaaaagcaatcagcaaattatcgataaaatgacggctagatttggtgattttgtgaattacaaaccgccattcaaatggaatacggcgttgttatggttattgccagtcgcccttttaattctagctgcagtattgctttatttctcaaataggaaaaaacagttttcagaaaaagtggttgcacaacaactagagaatgatgaaataatttccctcccctcaacctttggcagctccccccgcaagcaaggggagccaagtaaactttctaagggaaaagtgaatagcaaaatttattttgtgctttttactttactcatcgctattccagctacttattatttttcccttgatcgttttagtcgtgttcaacaaggcgagcaatcgatgattgagcaacataatcaaaatgttgaaatgaatgatgaacacaaaaatgaaaatgtgattgagaagctccaaaataaactgcgaactgatccgaataatgcggaaacttggcttcaacttggggaagcctatgtgcagaataatgaatttgatagcgcgcttgtggcttattctaatgcggaaaaatgtnnnnnt

SEQ ID NO: 2216 - protein, 282 aa, Haemophilus influenzae
  Xaa 281, 282: Xaa is any amino acid
  Name: NTH1229
MKSLLDIFTRVQKTFVFATALLFAFSLFTQAEMVDTYQFQNQDDRTRAVELAKSLRCPQCQNQNLVESNSPIAYDLRLEVYKMVDEGKSNQQIIDKMTARFGDFVNYKPPFKWNTALLWLLPVALLILAAVLLYFSNRKKQFSEKVVAQQLENDEIISLPSTFGSSPRKQGEPSKLSKGKVNSKIYFVLFTLLIAIPATYYFSLDRFSRVQQGEQSMIEQHNQNVEMNDEHKNENVIEKLQNKLRTDPNNAETWLQLGEAYVQNNEFDSALVAYSNAEKCXX

SEQ ID NO: 2217 - DNA, 528 bp, Haemophilus influenzae
  Name: NTH1230
atgaacaaaaaacttctcttttttgcaccgctctttgtgcttttaggcgtgtgtgtattattaattgctgggttaaatcaagatccgaaaaaaattgcgtcggctttaattgataaacccgttccagagttttatcaggctaatttacatgatccatcacaaatcgtaagcccgaaagattttcctaaacagccatttttattaaatgtgtggggcagttggtgtggttattgcaaagaagaacatccgttgttaattgagattgcaaaaacgttgcctattgtgggtgtagattatcgcgacaatccgcaaaatggtattgaaatacttaagagaatgggcaatccgttcatcttaactattgatgatagtcagggagaacttgccctcaaattaggcgtggatggtgcgccagaaacttatcttgtggatgaaaatggtgtgattcgttatcgccattctggtttattggataaagaaacttggcaaacggtatttttgccaaaaattgaagcattgaagaataaa

SEQ ID NO: 2218 - protein, 176 aa, Haemophilus influenzae
  Name: NTH1230
MNKKLLFFAPLFVLLGVCVLLIAGLNQDPKKIASALIDKPVPEFYQANLHDPSQIVSPKDFPKQPFLLNVWGSWCGYCKEEHPLLIEIAKTLPIVGVDYRDNPQNGIEILKRMGNPFILTIDDSQGELALKLGVDGAPETYLVDENGVIRYRHSGLLDKETWQTVFLPKIEALKNK

SEQ ID NO: 2219 - DNA, 1521 bp, Haemophilus influenzae
  Name: NTH1231
ttgggattgatttgctttggttttgcggtgtttattttattttattccaatccatttggacgcattttccctgctcccgcagaagggcgcgatctcaatccaatgttgcaagatgtgggattaattttccatccgcctttattatatgttggctatgtgggctttgcggtaaattttgcaatgagtttgagtgcgttgatttataaccaatctgcacgacaaattgcccgctcaatgcgtggatgggtgttggtttcttggttgtttttaaccattggcattgtgcttggtgcttggtgggcatattacgaacttggctggggcggttggtggttctgggatcccgtagaaaatgcgtctttaatgccttggttgcttgggttagcgttattacacagtttaatggcgacggaaaaacaaggcgtatttagttattggacaacgcttttttctctgcttgcttttgcctttagcgtattaggcacgtttattgttcgttctggcgcgctcacttctgtgcacgcctttgcattggataacacgcgcggttatgtgttgttattaattttctttgttttgacagcgttagcctttggtttattcgctttacgagcgggaagttcatcagaaagtgcggtgaaatttcagttcatttctaaatcgggtggcattttattactgaatattttgctgaccattgcgacggtttctacctttttaggtaccttttacccgatgttattccaagcgatgaattggggctcaatttcggtgggaagtccttattttaatagtattttcttccccattattacggcgattttaatcctaatggtaattgtgcttagcatacgtaaggggcaatttgatcgcacattattgatacgttgtgggtggttgcttattccgtctttaattcttgcaggcctaatgatttggcaacagctacgccataattctgcgttgaattttcacgctttcgcttttgtgttattaactcttgcgatttggcttttgttggtcactttatggcaaaattggcgacaaattcgtttgtctcaatttggtatgattttagcgcattgtggcgtggcgattgtaactattggtgcggtaatgagtggttattttggcagtgaaattggtgtgcgtttagcaccgcaacaaagtcaaacgctgggacaatatgaatttcactatcgccaattttctaatgaaatcggaccaaactttacggcagaagtcgccttttttgacgtaactgaaaatggtaaaccttatgcagaaattatccccgaacgccgttattacgatgttcgtacaatgacaatgagtgaagtggggcttaatggcggtttttggggcgatttatatattgtgatgggcgattctctcggcaaaggggaatttactttccgcttacattataaaccactgattcgttggctttgggcgggcggtattttaatggcctttggcgcactttttagcgtcttcggattacgcagaaaacaggaaaaa

SEQ ID NO: 2220 - protein, 507 aa, Haemophilus influenzae
  Name: NTH1231
LGLICFGFAVFILFYSNPFGRIFPAPAEGRDLNPMLQDVGLIFHPPLLYVGYVGFAVNFAMSLSALIYNQSARQIARSMRGWVLVSWLFLTIGIVLGAWWAYYELGWGGWWFWDPVENASLMPWLLGLALLHSLMATEKQGVFSYWTTLFSLLAFAFSVLGTFIVRSGALTSVHAFALDNTRGYVLLLIFFVLTALAFGLFALRAGSSSESAVKFQFISKSGGILLLNILLTIATVSTFLGTFYPMLFQAMNWGSISVGSPYFNSIFFPIITAILILMVIVLSIRKGQFDRTLLIRCGWLLIPSLILAGLMIWQQLRHNSALNFHAFAFVLLTLAIWLLLVTLWQNWRQIRLSQFGMILAHCGVAIVTIGAVMSGYFGSEIGVRLAPQQSQTLGQYEFHYRQFSNEIGPNFTAEVAFFDVTENGKPYAEIIPERRYYDVRTMTMSEVGLNGGFWGDLYIVMGDSLGKGEFTFRLHYKPLIRWLWAGGILMAFGALFSVFGLRRKQEK

SEQ ID NO: 2221 - DNA, 1140 bp, Haemophilus influenzae
  n 1131, 1132, 1133, 1134, 1135: n is any nucleotide
  Name: NTH1233
atgtcaaaagttgcttccttagacgcatttttaacaaaagttgctcaacgcgatggttatcaacctgaatttttacaagcggttcgcgaggtattcacatcaatttggccttttttagaagccaatcctaaatatcgttcagaagcattattagaacgtttagttgagcctgaacgtgcatttcaattccgtgtggcgtggactgacgataaagggcaagtgcaagtaaacagagcatttcgtgtacaatttaatagtgccataggcccatttaaagggggaatgcgtttccatccatcagtaaatttatctatcttaaaattcttaggttttgagcaaatctttaaaaatgctttaacaacattgcctatgggcggagcaaaaggcggttcagattttgatcctaaaggcaaatctgatgctgaagttatgcgtttttgccaagcattaatggctgaactttatcgtcacgtaggagctgatacagatgttcccgcaggcgatataggtgttggtgggcgcgaagttggctatttagctggctatatgaaaaaattatcaaaccaatcagcctgtgttttcactggtcgcggtctttctttcggtggtagtttaattcgtccggaagcaacgggatatggattaatttattttgctcaagcaatgcttgctgaaaaaggcgattgttttgctggtaacgtactctcagccccttggttacgctattgtacgcaattttgcctttggagaaccctcccccacttcctccgtcccattattctcccccctcttcccctcatcccttccgttccccgtttatccttttttccctcctttcccgccttctttaccccctgttttttctctccgttcttgttctcctggttcctttctcgcgtttttttttttcccccctccttcctctccctttttcttcccctcctccttcttcctcccctccccttttttctttttttccgccccctttttttcctccttcctcccctcctttccttcccgccttcttccttccctccctgccgcattctctttcttcttcccgctctttctccgcttcttctgtatcgccgtctctcacgagttctcgtttttctcgcccccacccttcannnnnttaat

SEQ ID NO: 2222 - protein, 380 aa, Haemophilus influenzae
  Xaa 377, 378, 379: Xaa is any amino acid
  Name: NTH1233
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMAELYRHVGADTDVPAGDIGVGGREVGYLAGYMKKLSNQSACVFTGRGLSFGGSLIRPEATGYGLIYFAQAMLAEKGDCFAGNVLSAPWLRYCTQFCLWRTLPHFLRPIILPPLPLIPSVPRLSFFPSFPAFFTPCFFSPFLFSWFLSRVFFFPPSFLSLFLPLLLLPPLPFFLFFRPLFFLLPPLLSFPPSSFPPCRILFLLPALSPLLLYRRLSRVLVFLAPTLXXXN

SEQ ID NO: 2223 - DNA, 96 bp, Haemophilus influenzae
  Name: NTH1234
ttgttgatgttgtgtgtattgtattttttattgtatacgcctcgtgaagcgcatagacaatatgcaatggctaatttaatcttgcaaccattttta

SEQ ID NO: 2224 - protein, 32 aa, Haemophilus influenzae
  Name: NTH1234
LLMLCVLYFLLYTPREAHRQYAMANLILQPFL

SEQ ID NO: 2225 - DNA, 108 bp, Haemophilus influenzae
  Name: NTH1235
ttggttgataaaatcgagcgaccaatagaccgagctcaaacagcaagcacatcggtatggcaagcaaagtttgtgaaaaaacatcaggaggcgttaaaagcattccaa

SEQ ID NO: 2226 - protein, 36 aa, Haemophilus influenzae
  Name: NTH1235
LVDKIERPIDRAQTASTSVWQAKFVKKHQEALKAFQ

SEQ ID NO: 2227 - DNA, 492 bp, Haemophilus influenzae
  Name: NTH1236
ttgggcttttattgcacctgctttatatcagcacgaaaaacggatgatttatccgttgtattttccagtacgattttattttatgcgggtgttgcttttgcttactatgtcgtctttcctcttgtattcagcttctttacacaaacagccccagaaggcgttaccatcgcaacagatattagtagttatttagattttgctttagcgttatttttagcttttggcgtttgttttgaagtgccaattgcgattattctactttgctggactggtattaccactgtaaaggctctttccgaaaaacgcccttatattattgttgcagcattttttattggaatgcttttaacgcctcctgatgttttttcacaaactttgcttgccataccgatgtgcttgctgtttgagctcggtctattggtcgctcgattttatcaaccaaaagacgacgaaagtgcggttaaaaataatgatgaatcagaaaaaacacaa

SEQ ID NO: 2228 - protein, 164 aa, Haemophilus influenzae
  Name: NTH1236
LGFYCTCFISARKTDDLSVVFSSTILFYAGVAFAYYVVFPLVFSFFTQTAPEGVTIATDISSYLDFALALFLAFGVCFEVPIAIILLCWTGITTVKALSEKRPYIIVAAFFIGMLLTPPDVFSQTLLAIPMCLLFELGLLVARFYQPKDDESAVKNNDESEKTQ

SEQ ID NO: 2229 - DNA, 111 bp, Haemophilus influenzae
  Name: NTH1237
gtgcagcaacaaaatgataaatatcattggaaaaatacaccaaagcaacaaaaaccaacactacacaaatcacacagcgtaataaacggtttcttagttcaacaaggtgcg

SEQ ID NO: 2230 - protein, 37 aa, Haemophilus influenzae
  Name: NTH1237
VQQQNDKYHWKNTPKQQKPTLHKSHSVINGFLVQQGA

SEQ ID NO: 2231 - DNA, 465 bp, Haemophilus influenzae
  Name: NTH1238
atgagtaatgtggatgaatctcaacctttaattacgcaccttgttgaactaagaaaccgtttattacgctgtgtgatttgtgtagtgttggtttttgttgctttggtgtatttttccaatgatatttatcattttgttgctgcacctttaacggctgttatgccaaaaggcgcaacaatgattgcaaccaatattcaaactcctttctttacgccaattaaattaactgcgattgttgcaatttttatttctgtcccttatttgctttatcaaatttgggcttttattgcacctgctttatatcagcacgaaaaacggatgatttatccgttgtattttccagtacgattttattttatgcgggtgttgcttttgcttactatgtcgtctttcctcttgtattcagcttctttacacaaacagccccagaaggcgttaccatcgcaacagatattagtagttatt

SEQ ID NO: 2232 - protein, 155 aa, Haemophilus influenzae
  Name: NTH1238
MSNVDESQPLITHLVELRNRLLRCVICVVLVFVALVYFSNDIYHFVAAPLTAVMPKGATMIATNIQTPFFTPIKLTAIVAIFISVPYLLYQIWAFIAPALYQHEKRMIYPLYFPVRFYFMRVLLLLTMSSFLLYSASLHKQPQKALPSQQILVVI

SEQ ID NO: 2233 - DNA, 285 bp, Haemophilus influenzae
  Name: NTH1239
atgaaagcggagctagaagataaagcagctcaagctggtacaacggtggaagatcaaatcaaagaaatcaaaaatgcggctgaaaatgcagaaaaacctcaaaatgcaatctcagttgaggaggctgcagaaactttatctgaagcagaaaaaacacctacagatttgaccgcacttgaaactcacgagaaagtagaactgaacacacatttatctagctattatcctcctgatgatattgaaatcgctccagcgtcaaaatctcaatcttcaaaaactaaatca

SEQ ID NO: 2234 - protein, 95 aa, Haemophilus influenzae
  Name: NTH1239
MKAELEDKAAQAGTTVEDQIKEIKNAAENAEKPQNAISVEEAAETLSEAEKTPTDLTALETHEKVELNTHLSSYYPPDDIEIAPASKSQSSKTKS

SEQ ID NO: 2235 - DNA, 270 bp, Haemophilus influenzae
  Name: NTH1240
gtgtttgatattggtttttcagaacttattttactaatggttttgggattggttgtattaggcccgaaacgtttgcctatagcaattcgcactgtaatggattgggtaaaaacaattcgtggtttagctgctaacgttcaaaatgagttgaaacaagagctaaaattgcaagaattacaagatagtattaaaaaagcggaatcccttaacttgcaagccctttcaccagaattgagtaaaacggtgggaagaattaaaagctcaagcaga

SEQ ID NO: 2236 - protein, 90 aa, Haemophilus influenzae
  Name: NTH1240
VFDIGFSELILLMVLGLVVLGPKRLPIAIRTVMDWVKTIRGLAANVQNELKQELKLQELQDSIKKAESLNLQALSPELSKTVGRIKSSSR

SEQ ID NO: 2237 - DNA, 285 bp, Haemophilus influenzae
  Name: NTH1241
atggctaaaaagagtatattccgagccaaattttttcttttttacagaacggagtttattatgtttggtttatcccccgctcaactgattattttattagtcgttattttattgatttttggcacgaaaaaattaagaaatgctggctcagatcttggtgcagcagtgaaaggtttcaaaaaggcgatgaaagaagatgaaaaagtaaaagatgcggaatttaagtctatagataatgaaacagcgtctgcaaaaaaagaaaatataaaagagaaagagcaggct

SEQ ID NO: 2238 - protein, 95 aa, Haemophilus influenzae
  Name: NTH1241
MAKKSIFRAKFFLFYRTEFIMFGLSPAQLIILLVVILLIFGTKKLRNAGSDLGAAVKGFKKAMKEDEKVKDAEFKSIDNETASAKKENIKEKEQA

SEQ ID NO: 2239 - DNA, 405 bp, Haemophilus influenzae
  Name: NTH1242
gtgacttacaccaccgctaaagctgctgaaaaaataggcatttccgcctacaccttacgcttttatgacaaagaaggcttgttacctaatgtcggacgtgatgaatacggtaatcgccgttttaccgacaaggatttgcaatggttgagtttattacaatgcttgaaaaatacaggaatgagcttaaaagacatcaaacgctttgcagaatgtaccatcattggcgacgatactattgaagaacgcctttccttatttgaaaatcaaacaaaaaatgtaaagtgtcaaattgccgaattaaaacgttatttagatttgcttgaatacaaattagcgttttaccaaaaagcgaaagcactaggctcggtaaaagctgtgaatttaccgcaaattcctgaaacgagc

SEQ ID NO: 2240 - protein, 135 aa, Haemophilus influenzae
  Name: NTH1242
VTYTTAKAAEKIGISAYTLRFYDKEGLLPNVGRDEYGNRRFTDKDLQWLSLLQCLKNTGMSLKDIKRFAECTIIGDDTIEERLSLFENQTKNVKCQIAELKRYLDLLEYKLAFYQKAKALGSVKAVNLPQIPETS

SEQ ID NO: 2241 - DNA, 255 bp, Haemophilus influenzae
  Name: NTH1244
atgagtaagaaaaaaacaaaacctaagattgagatagatttatcaatggttgaaagtcttgccgctcaggggcttactaatcaacaaattgcagatagcttaggtatttcagagagaacgcttcaaaatcgtaaaaaagataatgcagaatttgccgaagctataaaaaaaggcaaggctaaaggaattgcggtggttacgaatgctttaatgaagaaaattaaatcggggaacgttaccgcgatgatatctttc

SEQ ID NO: 2242 - protein, 85 aa, Haemophilus influenzae
  Name: NTH1244
MSKKKTKPKIEIDLSMVESLAAQGLTNQQIADSLGISERTLQNRKKDNAEFAEAIKKGKAKGIAVVTNALMKKIKSGNVTAMISF

SEQ ID NO: 2243 - DNA, 246 bp, Haemophilus influenzae
  Name: NTH1245
ttgctaataatcactaaggagataaatatgatgaagaaaattgatgtattaaaagatttgatggctaaaaatgaatggaaaaaagcaatctcactagcaagtaaatttcctagattgggaaatgctaaagatgcaattaaatcagcgcaaatggcttacacaaaccctaattttgtccgccagataaaaaaagaccccgataagttaatttatcagggcatccaagcattgattgccaaatacggt

SEQ ID NO: 2244 - protein, 82 aa, Haemophilus influenzae
  Name: NTH1245
LLIITKEINMMKKIDVLKDLMAKNEWKKAISLASKFPRLGNAKDAIKSAQMAYTNPNFVRQIKKDPDKLIYQGIQALIAKYG

SEQ ID NO: 2245 - DNA, 90 bp, Haemophilus influenzae
  Name: NTH1246
atgaagacaattaaccgtatttggcaatcaatgcttggatgccctgataaattaacttatcggggtctttttttatctggcggacaaaat

SEQ ID NO: 2246 - protein, 30 aa, Haemophilus influenzae
  Name: NTH1246
MKTINRIWQSMLGCPDKLTYRGLFLSGGQN

SEQ ID NO: 2247 - DNA, 417 bp, Haemophilus influenzae
  Name: NTH1247
ttgcccccttatgccgatctagaagtttattctaataaccctaatgatttatctaatatggattatgataattttaaaaaagcgtattttgaaattatcaaaaaatcttgtgatatgttgaaagataatcgctttgcttgttttgttgtcggtgaagttagggataaaaaagggaattactataatttcgtaggagatactattcaggctttcttagaagccggtttaagctactataatgaaatgattttagttaatgtatgtgggactatgcctatgcgtgcggctacgccttttaaaggtagccgcaagataggaaaggtgcatcagaatgtcttggtctttgtgaaaggaaatcctaaaattgctgctgaatattgtggagatgtagacgtgtacatcccgaatgaagacaat

SEQ ID NO: 2248 - protein, 139 aa, Haemophilus influenzae
  Name: NTH1247
LPPYADLEVYSNNPNDLSNMDYDNFKKAYFEIIKKSCDMLKDNRFACFVVGEVRDKKGNYYNFVGDTIQAFLEAGLSYYNEMILVNVCGTMPMRAATPFKGSRKIGKVHQNVLVFVKGNPKIAAEYCGDVDVYIPNEDN

SEQ ID NO: 2249 - DNA, 957 bp, Haemophilus influenzae
  Name: NTH1248
atgatgaataaagatttaaatattgaatatatttctacggatgttctaaagccttatgtcaataatagtcgcactcattctgatgaacaaatcgatcagatttgtgaaagcattgaagagttcggttttacaaatccaattttgattggcgagaataatggaattatagcgggtcacggtagattattagccgcaataaaactgaacttatatactgtgccgacgattagattaacgggcttatccgatattcagaaaaaagcctacgtgattgctgataactcactggcgttgaatgccggctggaattttgagctattaagtttagaattaaatgaattaaaagatctcggttttgatattgatttgcttggctttgatgatgattttttaaaaagtttagatggtgatttattggctgatataagcggtgattccaattctaaggaaaaacttgatcttaaacaggcgtttttagccccccctttctcaattttaaattctagagaaggttggtggcaggatagaaaaagaaaatggaaagccttgggtattgatagcggttcaggtcgcgatagcggtatgcagcgcggtatgaacagtatggcaaggtataactcgaaagaagatacttcaatgtctgaaagcgatgattcaatatttgatcctgtgctttgtgaaatactgtattcttggtttagccctaaaggctgtcaaattttagatccgtttgcaggtggtagtgttcgcggtattgtggctagtaaattaaatagaaattatatcggtgttgatcttagagccgagcaaattgaagctaatttgaagcaacgaaacttggtttgttctaatgatgagttgcagcctatatggatttgtggcgatagcataaatattgataaattagctaatggtgtctccgccgatttagtctttagttgcccccttatgccgatc

SEQ ID NO: 2250 - protein, 319 aa, Haemophilus influenzae
  Name: NTH1248
MMNKDLNIEYISTDVLKPYVNNSRTHSDEQIDQICESIEEFGFTNPILIGENNGIIAGHGRLLAAIKLNLYTVPTIRLTGLSDIQKKAYVIADNSLALNAGWNFELLSLELNELKDLGFDIDLLGFDDDFLKSLDGDLLADISGDSNSKEKLDLKQAFLAPPFSILNSREGWWQDRKRKWKALGIDSGSGRDSGMQRGMNSMARYNSKEDTSMSESDDSIFDPVLCEILYSWFSPKGCQILDPFAGGSVRGIVASKLNRNYIGVDLRAEQIEANLKQRNLVCSNDELQPIWICGDSINIDKLANGVSADLVFSCPLMPI

SEQ ID NO: 2251 - DNA, 228 bp, Haemophilus influenzae
  Name: NTH1249
gtgttgctgacgagttgcgcaagtaagccagaaattgaataccgcacgcttgccttttcgccgccggtgagtttgcttgccccctgccctattccatcattccacggttcaacctttggggagacggtggaatatgcgttattgctcaagcaagaattgcggttatgtgcgaataaggtggacggggtgcgggagtatgtgaaggcgcgggaaagtgcggcggaaaat

SEQ ID NO: 2252 - protein, 76 aa, Haemophilus influenzae
  Name: NTH1249
VLLTSCASKPEIEYRTLAFSPPVSLLAPCPIPSFHGSTFGETVEYALLLKQELRLCANKVDGVREYVKARESAAEN

SEQ ID NO: 2253 - DNA, 387 bp, Haemophilus influenzae
  Name: NTH1250
atgacgtggtggctatttgttataaaaaaacttgggcttaacgtgtttagtcatggttgcaagcatttcaataaagttgtcgctgtatttgcaggagtgtttattcttgcgttgctttatatgcagcacacaaataagctcaatattgaacgccaatcagctgttattgattctctgcatgaaaaagtcattaagcgggataagattattgatgaattacacgaagatgtggacgagcaaagaaagattgccgaaaagcggttagcgcaagagcagttaatcagggagcaaagttatgcgcaaattcaatccattaagaaaatactggaaagtaatcagtgcagccgtactgtactgcctaacggtgttgctgacgagttgcgcaag

SEQ ID NO: 2254 - protein, 129 aa, Haemophilus influenzae
  Name: NTH1250
MTWWLFVIKKLGLNVFSHGCKHFNKVVAVFAGVFILALLYMQHTNKLNIERQSAVIDSLHEKVIKRDKIIDELHEDVDEQRKIAEKRLAQEQLIREQSYAQIQSIKKILESNQCSRTVLPNGVADELRK

SEQ ID NO: 2255 - DNA, 426 bp, Haemophilus influenzae
  Name: NTH1251
ttgcgtctaaattggggattaaagatgagcaaatttaagctatctgctgctagtgaagaaaaactagtaggcgttcacgcggatttagtgaaagtggtgcaccgtgcaattgaattaagtgtggtggattttaaagttattgagggtaaacgcacgttagagcgacaaaaagaattgtttgccaagaaagcgacaaagacaatgaatagtcgccatttaactggtcatgcggtggatttagtgccgttaccagtgaattggaatgatcgcgagccatttaagaatgttgccagtgctatgtttcaagctgctaaacaattgggcgttgctattcgctggggcggtgattggaatatgaatgagagttctaatgatgagcgtttttatgatggaccgcattttgagttattacggagtgtatatcca

SEQ ID NO: 2256 - protein, 142 aa, Haemophilus influenzae
  Name: NTH1251
LRLNWGLKMSKFKLSAASEEKLVGVHADLVKVVHRAIELSVVDFKVIEGKRTLERQKELFAKKATKTMNSRHLTGHAVDLVPLPVNWNDREPFKNVASAMFQAAKQLGVAIRWGGDWNMNESSNDERFYDGPHFELLRSVYP

SEQ ID NO: 2257 - DNA, 360 bp, Haemophilus influenzae
  Name: NTH1252
ttggggcttttctgtatctgtaaaataggttttattatgccgactaaagatccgactaacttggaatcttttttacgctggctcccattggtttttatcggattatttgccggcgttgcaaaatacgcaagcgatattcaagcgggaaagctccactttagcgtggggctttttttatgccaagtgcttgtgtctatgtttgcggggtggattgggggattgatttgtctttcttccggtcttgatagcgatttagtttatgtaggctcagggctttctggttatggtggtggcgcggtgcttaatgccatttggcgggggttctttgcgtctaaattggggattaaagatgagcaaatt

SEQ ID NO: 2258 - protein, 120 aa, Haemophilus influenzae
  Name: NTH1252
LGLFCICKIGFIMPTKDPTNLESFLRWLPLVFIGLFAGVAKYASDIQAGKLHFSVGLFLCQVLVSMFAGWIGGLICLSSGLDSDLVYVGSGLSGYGGGAVLNAIWRGFFASKLGIKDEQI

SEQ ID NO: 2259 - DNA, 798 bp, Haemophilus influenzae
  n 3, 8, 30, 39, 42, 59, 86, 91: n is any nucleotide
  Name: NTH1253
atnccaanctggttaaatatgggagtacanaaaatgcanaanttatcagagagattaanagcgttgctggtagaaaaaggaataanccaancccgaattgctaatatgatcggcattgctcaaccctctatgcagaaaatccttgccggagaaaccagaaatccacgcaaaattgttgaaatagcaaaagagctcggtacaacgccggattatttgttgtatggcgatatgaccgttagtcattccactttggaaaattctcagatcaataacaatcaggggcagaccgtcaataatttttttgacagtggaagtgatgaattacgcgagatgttgcataagcagcagatttcattaaaaacgaagccaacggaagaatgggtttttgccttagatgtaaatcgtttagctgagacagatataattaatgtgcatttccctcgcccttttgaagctttgcacctttcgcaagatgggatgatggatttattgaaattacgctctacggcgaacgtggcgatgataacgatgtttaatgagagtatgtcgccggtaattaataaaaaagatttgatgtttgtggatacgacttgtaaacaatatgctggcgaagggatttatttgtttgtaatgaataatgagttgtatgtgcgtcgtttatatcaaacaccgagcggtgtattaaatgcggtggcggagaatgagcgcgtgggatcgagctttgaaattgatgatttgtcacgtttaaacgtactgggtcgttgcgtgcgaaaattttctattgttgcagaggattta

SEQ ID NO: 2260 - protein, 266 aa, Haemophilus influenzae
  Xaa 1, 3, 10, 13, 14, 20, 29, 31: Xaa is any amino acid
  Name: NTH1253
XPXWLNMGVXKMXXLSERLXALLVEKGIXQXRIANMIGIAQPSMQKILAGETRNPRKIVEIAKELGTTPDYLLYGDMTVSHSTLENSQINNNQGQTVNNFFDSGSDELREMLHKQQISLKTKPTEEWVFALDVNRLAETDIINVHFPRPFEALHLSQDGMMDLLKLRSTANVAMITMFNESMSPVINKKDLMFVDTTCKQYAGEGIYLFVMNNELYVRRLYQTPSGVLNAVAENERVGSSFEIDDLSRLNVLGRCVRKFSIVAEDL

SEQ ID NO: 2261 - DNA, 303 bp, Haemophilus influenzae
  Name: NTH1254
atgattgcaggtatgttctatgcctttggtggtatgcttgaagcgggtcgtatcggttctgcaactaacaacttaggttttatgtatgaattagatgctatcgccgcttgcgtagtgggtggcgtatcttttgctggtggggtaggtacagtaattggtgttatcactggggttattatctttactgttatcaactacggtttaacttacatcggtgtaaacccttactggcaatacatcattaaaggtagcattatcattctagcggtagccattgactcgttaaaatatgcgaagaaaaaa

SEQ ID NO: 2262 - protein, 101 aa, Haemophilus influenzae
  Name: NTH1254
MIAGMFYAFGGMLEAGRIGSATNNLGFMYELDAIAACVVGGVSFAGGVGTVIGVITGVIIFTVINYGLTYIGVNPYWQYIIKGSIIILAVAIDSLKYAKKK

SEQ ID NO: 2263 - DNA, 762 bp, Haemophilus influenzae
  Name: NTH1255
ttgcgccaccattttcatagagagaaaaaaatgctaattaactttacacaagtattgcaagacagttggaatttcttccgtaatcagaaaaaaattatgctgcaatttgtcgcaattttatttattgtgcaaagcgcgagtgcacttttaagtttttcagttaatgatgaaaataaaaatgatgtattaaatctcgccaatacagatatcacaagttttatattttcagttgcaatcactcaaattttaacgagctttattgcagcttggggattaacctcaatccataaaattagcctacaaaattatcgcactttaggtgaaaccttctcacttaccttgcgccgttttgcaggcgtaattgtgttagatctattaatggttgcaccaatgttacttggtcttggtgaagcctttgctgcattactcacaaaaaaatcgccctctattatgtcacttatcgcgatgcttgttggcgtttggttctttgtccgtttaaatttaacggtagtacattatctttctactcaagaggcactttcgcaaactatccgaaaaatttggatgcgaggaaatactcgaaaaggcgtattgtttatttacaccctactggtttattttctcgtgccaattcttattttccaattaagcgcattttccaataatgctatatttgatatggtaataggcattttcaccgcattacttaatattttcatgctagtagtgacttatcgtttctacagcttatttatgaaggat

SEQ ID NO: 2264 - protein, 254 aa, Haemophilus influenzae
  Name: NTH1255
LRHHFHREKKMLINFTQVLQDSWNFFRNQKKIMLQFVAILFIVQSASALLSFSVNDENKNDVLNLANTDITSFIFSVAITQILTSFIAAWGLTSIHKISLQNYRTLGETFSLTLRRFAGVIVLDLLMVAPMLLGLGEAFAALLTKKSPSIMSLIAMLVGVWFFVRLNLTVVHYLSTQEALSQTIRKIWMRGNTRKGVLFIYTLLVYFLVPILIFQLSAFSNNAIFDMVIGIFTALLNIFMLVVTYRFYSLFMKD

SEQ ID NO: 2265 - DNA, 555 bp, Haemophilus influenzae
  Name: NTH1256
atgaaacaactccttgactttatccctttaattttattttttatcacttacaaactcggtggtgtacgtgaagcagccatcgtattagtggttgcaacaattttgcagatcgtgattttaaaatggaaatacggaatagttgaaaaacaacaaaaaattatggcaagtgcggtcgttttttttggacttttaaccgcttactttaatgaaatccgctatttgcaatggaaagtgacaattatcaatggcttatttgctattgttttgctcgtcgcacaatttcaatttaaaaccccattaatcaaaaagttacttggtaaagagctacaactgcccgaaaaggcttggaatacacttaaccttggctgggcattattctttattatttgcatgttggtgaatatttatatcagccataatatgtcggaagaagcttgggttgatttcaaatcttttggaattattggtatgacagtgattgcaaccattatttcgggagtttatatttatcgttatttgcctaaagatggctcaaattcaaaagacggagagaaa

SEQ ID NO: 2266 - protein, 185 aa, Haemophilus influenzae
  Name: NTH1256
MKQLLDFIPLILFFITYKLGGVREAAIVLVVATILQIVILKWKYGIVEKQQKIMASAVVFFGLLTAYFNEIRYLQWKVTIINGLFAIVLLVAQFQFKTPLIKKLLGKELQLPEKAWNTLNLGWALFFIICMLVNIYISHNMSEEAWVDFKSFGIIGMTVIATIISGVYIYRYLPKDGSNSKDGEK

SEQ ID NO: 2267 - DNA, 462 bp, Haemophilus influenzae
  Name: NTH1258
atgtctgccaattttactgataaaaatggtcgccaatcaaaaggagttcttttactacgaactttggcgatgccttctgacaccaatgctaacggagatatttttggtggctggattatgtctcaaatggatatgggcggcgcgattttagcgaaagaaatcgcacacggacgcgtggttactgttgccgttgaaagtatgaattttatcaaaccaatctctgtgggcgatgttgtttgttgctacggtgaatgtctcaaagttgggcgttcttccattaaaattaaagtagaagtatgggtaaaaaaagtggcgagtgagccaattggcgaacgttattgtgtcaccgatgcggtatttacttttgttgcagttgataataatggtcgctctcgcacgattccccgtgaaaataaccaagagttagaaaaagcattagccttaatttcagaacaacccttg

SEQ ID NO: 2268 - protein, 154 aa, Haemophilus influenzae
  Name: NTH1258
MSANFTDKNGRQSKGVLLLRTLAMPSDTNANGDIFGGWIMSQMDMGGAILAKEIAHGRVVTVAVESMNFIKPISVGDVVCCYGECLKVGRSSIKIKVEVWVKKVASEPIGERYCVTDAVFTFVAVDNNGRSRTIPRENNQELEKALALISEQPL

SEQ ID NO: 2269 - DNA, 294 bp, Haemophilus influenzae
  Name: NTH1259
atgtactatgttatttttgcccaagatattcccaatacgttagaaaagcgtcttgccgtacgcgagcaacacttggctcgtttaaaacaacttcaagcggaaaatcgcttactgacagcaggcccaaatcctgcaattgatgatgaaaatccgagtgaagctggttttacaggttcaaccgttattgctcaatttgaaaatctacaagcggcaaaagactgggctgcacaagatccttatgtagaagctggcgtatatgcggatgttattgtaaagccgtttaaaaaagtcttt

SEQ ID NO: 2270 - protein, 98 aa, Haemophilus influenzae
  Name: NTH1259
MYYVIFAQDIPNTLEKRLAVREQHLARLKQLQAENRLLTAGPNPAIDDENPSEAGFTGSTVIAQFENLQAAKDWAAQDPYVEAGVYADVIVKPFKKVF

SEQ ID NO: 2271 - DNA, 474 bp, Haemophilus influenzae
  n 440, 469, 470, 471, 472, 473: n is any nucleotide
  Name: NTH1261
atgaaaaaagtcgccttaatttctctttgtatttttaccgcactttctgcttttgccgattcgcctaatacggcaacagcatcaatcaatcttgagcaagagaaacaaaactgggcgtcaatacagcatcaagactacttaaaacgtctaaaacaacgtgaagtctttttgcaagttgaaggtttgctaaaaagtgcggtaaaaaaacagcaattttctgaagcgattcaaaatatcacaaaaaccttaatagactcattgcaaggctaccctttgcaatatgatctgcttgctcgattttgggagacaaaaatcgcctttttgcagaatgatgatattcaaggaaaacaacaagcaataaatgaagtcaatgcgttagtgcaacaaaattacccttttgtgacaccagcatttcaagccttattacaaaaggggtctcntagagcagaccgcaggcagcaagctggcnnnnnt

SEQ ID NO: 2272 - protein, 158 aa, Haemophilus influenzae
  Xaa 147, 157, 158: Xaa is any amino acid
  Name: NTH1261
MKKVALISLCIFTALSAFADSPNTATASINLEQEKQNWASIQHQDYLKRLKQREVFLQVEGLLKSAVKKQQFSEAIQNITKTLIDSLQGYPLQYDLLARFWETKIAFLQNDDIQGKQQAINEVNALVQQNYPFVTPAFQALLQKGSXRADRRQQAGXX

SEQ ID NO: 2273 - DNA, 705 bp, Haemophilus influenzae
  Name: NTH1262
atgaaattaacctctccgatctttaatgatcaacaaaaacgtcgtgcaatcatctggctcagctttttccacatattcatcattgcagcgagcaattactttgtacaaatcccttttgaaatcacgctaaaattaaccgcacttggtgcagcaaacgatttttctttccacagcacttggggaacgctcacattcccatttatctttttagctaccgatttaaccgtacgcattttcggtgcggaagatgcgagaaaaatcatcttcgtggtgatgtttcctgcacttattgtaagttacgtcatatctgttttattctctgaaagcaaattccaaggtttcgaatcattaacgcattttgatctgtttgtattccgtattgctattgcgagctttgccgcttacgtggtaggacaattgcttgatgtgatcgtatttaaccgcttacgccagttaaaaacttggtgggtggcgccaactagctcaatgacatttggctcaatggcggatacattcgttttcttcagtgtagccttctatcaaagtgcagatccgttcatggctgaacactgggcacaactcggttttgtagattacctatttaagctatttgtcggcattatattattcgtaccagcctatggcgtagtattaaatgttattttacgaaaactacaaatgctcgtaacagaacgcgttcctgca

SEQ ID NO: 2274 - protein, 235 aa, Haemophilus influenzae
  Name: NTH1262
MKLTSPIFNDQQKRRAIIWLSFFHIFIIAASNYFVQIPFEITLKLTALGAANDFSFHSTWGTLTFPFIFLATDLTVRIFGAEDARKIIFVVMFPALIVSYVISVLFSESKFQGFESLTHFDLFVFRIAIASFAAYVVGQLLDVIVFNRLRQLKTWWVAPTSSMTFGSMADTFVFFSVAFYQSADPFMAEHWAQLGFVDYLFKLFVGIILFVPAYGVVLNVILRKLQMLVTERVPA

SEQ ID NO: 2275 - DNA, 687 bp, Haemophilus influenzae
  Name: NTH1263
atgattttacagcctttattctatttgtgtttttcatcaaatttgaaaggagagaaaatggagttacacaatattcgtgatgaatatactaaacgcgtgctttcacaacatgattgccataaaaatccaatttcgcaatttgaacagtggcagaaagaggctattcatgctcaagtcaatgagccaaccgcaatgaatattgcgactgttgatgaacaaggtcgcccaaatagccgaatggttttgttaaaagaagtcaatgagcaaggatttgtcttttttaccaattatcttagtcgaaaaggcggctgtattgagcgcaatccttatgtcgcgctgactttcttttggcctgaattggaacgccaagtgcggattgaaggtaaggcggttaaaattccagcagaacaatccgataaatattttgctacccgaccttacaccagtcgtataggggcttgggcaagtgagcaaagtgcggtgatttctaattataaatctttgctagcaaaagccgcattggttgctgctaaacatccgttaaatgtgcctcgaccagattattggggcggctatttagtggtgccagaaaccgtggaattttggcaggggcgtccaagccgtttacatgatcgcattcgttatcgtaaagaaagtgataattggattagagaaagactttctcct

SEQ ID NO: 2276 - protein, 229 aa, Haemophilus influenzae
  Name: NTH1263
MILQPLFYLCFSSNLKGEKMELHNIRDEYTKRVLSQHDCHKNPISQFEQWQKEAIHAQVNEPTAMNIATVDEQGRPNSRMVLLKEVNEQGFVFFTNYLSRKGGCIERNPYVALTFFWPELERQVRIEGKAVKIPAEQSDKYFATRPYTSRIGAWASEQSAVISNYKSLLAKAALVAAKHPLNVPRPDYWGGYLVVPETVEFWQGRPSRLHDRIRYRKESDNWIRERLSP

SEQ ID NO: 2277 - DNA, 486 bp, Haemophilus influenzae
  Name: NTH1264
atggccttcgtggagaactttatgacaatgacttctggtacaggcttactttactcaagctttagcccctacgatgagatcaaaggtggggatatcggccaacgtaaaaacggcgtattaatttctaatgcgacaggcaaagcacttggctatgcattatttggcttacaagaacgtggtaagttaatgattgatgcaaacgtagaagtttatgaagggcaaattatcggtattcatagccgctcaaatgacttaaccgtaaactgcttgcaaggtaaaaaactaactaatatgcgtgcgtcaggtaaagacgatgcgattgtgctaactacacctgtaaaattcagtcttgaacaagcgattgaatttatcgatgatgatgaactagtggaagtaacacctgagtcgattcgtatccgtaaaaaacttttaacggaaaacgatcgtaaacgtgcaaatcgtacaacaacaagtactagcacgcat

SEQ ID NO: 2278 - protein, 162 aa, Haemophilus influenzae
  Name: NTH1264
MAFVENFMTMTSGTGLLYSSFSPYDEIKGGDIGQRKNGVLISNATGKALGYALFGLQERGKLMIDANVEVYEGQIIGIHSRSNDLTVNCLQGKKLTNMRASGKDDAIVLTTPVKFSLEQAIEFIDDDELVEVTPESIRIRKKLLTENDRKRANRTTTSTSTH

SEQ ID NO: 2279 - DNA, 168 bp, Haemophilus influenzae
  n 155, 156, 157, 158, 159: n is any nucleotide
  Name: NTH1265
atgtccgcagaaggcgtaggacgtttatttgccgttgataaaattgcaaatggcccaatgccagaacactatgaaccagttgaaagcccaattgatacaaacccatttcatccaaatgtagtaaccgatccaactttacgtatctataaagaagnnnnnttaattaat

SEQ ID NO: 2280 - protein, 56 aa, Haemophilus influenzae
  Xaa 52, 53: Xaa is any amino acid
  Name: NTH1265
MSAEGVGRLFAVDKIANGPMPEHYEPVESPIDTNPFHPNVVTDPTLRIYKEXXLIN

SEQ ID NO: 2281 - DNA, 207 bp, Haemophilus influenzae
  Name: NTH1266
atgcttactggagcctcagcccttggcatcgattcttgcccaattgaaggttttcattacgacaaaatgaatgaatgcctcgccgaagaaggattattcgatcctcaagaatatgcggtttctgtcgccgcaacctttggctaccgctcacgcgatattgcgaaaaaatcccgtaaagggttggatgaagtggtgagatgggtgggg

SEQ ID NO: 2282 - protein, 69 aa, Haemophilus influenzae
  Name: NTH1266
MLTGASALGIDSCPIEGFHYDKMNECLAEEGLFDPQEYAVSVAATFGYRSRDIAKKSRKGLDEVVRWVG

SEQ ID NO: 2283 - DNA, 1158 bp, Haemophilus influenzae
  Name: NTH1267
gtgattaaatatgtccgacaaatttactctactaaacaggaagttattatggcaacctacttttctgataatttgactgccgaccagcaaaatcaagttcagcagattattcaacaatttcagcatccaactctgcaaaaggatctgattgtgcttaatactttgaaaaaagtggaaaagggcggcgatacgttacgcattgaattgaaattgccttttgcgtggaattctggtgcagaacagttaaaacaagcggtttcagatgcgttattgaaagcaacagattgtaaatcaattaaatgggcggtggcttatcaaatcgccacacttaaacgtgcaaataatcaaccggcagtaaaaggtgtgaaaaatattattgctgtgagttctggtaaaggcggcgtagggaaatcatcggtttctgttaatctagctttagcattacaagcacaaggcgcacgtgttggaattttagatgcggatatttatggcccttctattccacacatgttaggcgcagcgaatcaacgtccaacttcgccagataatcaacacatcaccccaattaaagcacatggtttatctgcaaattccattggctttttaatgaatgaagatagtgcaacaatttggcgcggcccaatggcgagtagtgcattaagccaattattaaatgaaaccctatgggatagtttagattatcttgttatcgatatgcctcctggcactggcgatattcaacttaccttatcacaacaaattcctgtgactggcgcagtggttgtgacaactccacaagatattgctctgcttgacgcagtaaaaggtatttcaatgtttgagcgagtatccgtaccagtgttaggcattgtggaaaatatgtcgatgcatatttgtagtaagtgcggtcaccacgaagcgatttttggcacaggcggtgcagagaaaatggcggaaaaatacaatgtgaaagtattagctcaacttcctctgcatattcgtatccgtgaagatttagatgcaggcaacccgaccgttgtgcgagtgcctgaaaatgaaatttcacaagcgttcttacaacttgcagaaaaagtctctacagaactttactggcaaggttccgtaatcccaagcgagattttatttaaagaagtgaaa

SEQ ID NO: 2284 - protein, 386 aa, Haemophilus influenzae
  Name: NTH1267
VIKYVRQIYSTKQEVIMATYFSDNLTADQQNQVQQIIQQFQHPTLQKDLIVLNTLKKVEKGGDTLRIELKLPFAWNSGAEQLKQAVSDALLKATDCKSIKWAVAYQIATLKRANNQPAVKGVKNIIAVSSGKGGVGKSSVSVNLALALQAQGARVGILDADIYGPSIPHMLGAANQRPTSPDNQHITPIKAHGLSANSIGFLMNEDSATIWRGPMASSALSQLLNETLWDSLDYLVIDMPPGTGDIQLTLSQQIPVTGAVVVTTPQDIALLDAVKGISMFERVSVPVLGIVENMSMHICSKCGHHEAIFGTGGAEKMAEKYNVKVLAQLPLHIRIREDLDAGNPTVVRVPENEISQAFLQLAEKVSTELYWQGSVIPSEILFKEVK

SEQ ID NO: 2285 - DNA, 1380 bp, Haemophilus influenzae
  Name: NTH1268
atgacaactcaaccccgtaaaattttagtcacttgcgccttgccttatgccaatggggcaattcatttaggccatatgttagaacatatccaagcggatatttgggtgcgttttcaacgtatgcgtggcaataaaatccattttgtctgtgcggacgatgcgcacggcacgccgattatgttgaatgctgataaacttggcattacacctgaagaattaattgctaaagcaaaagccgatcacattcgtgattttgcaggtttcaatattagttttgataactatcattccactcacagcgaagaaaacaaacagctcactgcagaaatttacaataaactcaaagccaatggctttattaagagtaaagttatttctcagttattcgaccctgaaaaaaatatgttcttgcccgatcgttttgtgaaaggcacttgcccgaaatgtaaagcagaagatcaatatggcgataactgcgaagtttgtgcttctacttacagcccaatggatttaattaatcctcgttcagctgtttctggcacaacacctatcgtaaaagaatctgaacactttttctttgacttgcctgcatttgaagggatgttaaaagaatggactcgttctggctcacttcaatctgaaattgcgaacaaaatgcaagaatggtttgagagcggtttacaacaatgggatatttcacgtgatgcaccttatttcggttttgaaattcccggcgcaaaagataaattcttctatgtttggttagatgcgccaatcggctatatggcttcattcaaaaatctatgtgagcgtgaaggcattgatttcaacgaattttgggctgaaggcagtgatgcggagctttatcatttcatcggtaaagatatcgtttatttccacagtctattctggcctgcaatgcttgaaggcagcggctatcgtaaaccgactaatgtgttcgctcatggctatgtaacggtggatggggcgaagatgtcaaaatctcgcggcacattcattcaagccagcacttatttgaatcatatcgatcctgaatgtttgcgttattactatgcagcaaaattaaatgatcgcattgaagatttagactttaaccttgaagatttcgtacaacgtgtaaatacagatatcgtaaacaaattagtgaatttagcttcacgcaatgcaggttttattgcgaaacgctttgaaggcaaactttcggataaactggaagacgaagcattatttgcagaatttaccgctcaagccgagcaaatcgctgcttattacgaaagccgtgaatacaataaagccattcgtgaaattatggcattaacggataaagccaataaatacattgatgaaaaagcccctggg

SEQ ID NO: 2286 - protein, 460 aa, Haemophilus influenzae
  Name: NTH1268
MTTQPRKILVTCALPYANGAIHLGHMLEHIQADIWVRFQRMRGNKIHFVCADDAHGTPIMLNADKLGITPEELIAKAKADHIRDFAGFNISFDNYHSTHSEENKQLTAEIYNKLKANGFIKSKVISQLFDPEKNMFLPDRFVKGTCPKCKAEDQYGDNCEVCASTYSPMDLINPRSAVSGTTPIVKESEHFFFDLPAFEGMLKEWTRSGSLQSEIANKMQEWFESGLQQWDISRDAPYFGFEIPGAKDKFFYVWLDAPIGYMASFKNLCEREGIDFNEFWAEGSDAELYHFIGKDIVYFHSLFWPAMLEGSGYRKPTNVFAHGYVTVDGAKMSKSRGTFIQASTYLNHIDPECLRYYYAAKLNDRIEDLDFNLEDFVQRVNTDIVNKLVNLASRNAGFIAKRFEGKLSDKLEDEALFAEFTAQAEQIAAYYESREYNKAIREIMALTDKANKYIDEKAPG

SEQ ID NO: 2287 - DNA, 210 bp, Haemophilus influenzae
  Name: NTH1269
atgtcaaaaactgcacaaattgctgttgtgatgggttccaaaagcgattgggctaccatgcaagaggcaactcagattttagatgaattagaagtaccttatcatgtggaaatcgtctctgctcatcgtacgcctgataaactttttgaatttgctgaaaatgcacaaaaaaatggctataaagtaattattgctggggcctgcggggcg

SEQ ID NO: 2288 - protein, 70 aa, Haemophilus influenzae
  Name: NTH1269
MSKTAQIAVVMGSKSDWATMQEATQILDELEVPYHVEIVSAHRTPDKLFEFAENAQKNGYKVIIAGACGA

SEQ ID NO: 2289 - DNA, 246 bp, Haemophilus influenzae
  Name: NTH1270
atgggacgaactgaaaaattattagataagctcgcacaatcaaaatctacatttaattggaatgaattagtttctttgttagctcaacaaggttatgaaaagcgagaaatggcaggctctcgagtgagattttataatagaacactcgaacatacgattttgttacacaagcctcaccctgaaaattatattaaaggtggtgctttaaagtcagtgaaagaatcattaaaacaggtaggtattcta

SEQ ID NO: 2290 - protein, 82 aa, Haemophilus influenzae
  Name: NTH1270
MGRTEKLLDKLAQSKSTFNWNELVSLLAQQGYEKREMAGSRVRFYNRTLEHTILLHKPHPENYIKGGALKSVKESLKQVGIL

SEQ ID NO: 2291 - DNA, 342 bp, Haemophilus influenzae
  Name: NTH1271
atgaagttattaaattataaaggttatgttggcacgattgaggcggatttagaaaacaatatattgtttggcaaacttgcttacattcgtgatttagtgacttacgaagcagagtcattatctgagctagaaaaagaatttcgtcaatctgttgatttatatttacaagattgtttggaattaggtaaagaaccgaataagccttttaaaggtgtatttaatgtacgaattggcgaggaattgcatagagaagctacgatcatagcaggcgatcgttctcttaatgcttttgttacggaagcgattcaagaaaaaatttttcgtgaaaaaccaagtttaaga

SEQ ID NO: 2292 - protein, 114 aa, Haemophilus influenzae
  Name: NTH1271
MKLLNYKGYVGTIEADLENNILFGKLAYIRDLVTYEAESLSELEKEFRQSVDLYLQDCLELGKEPNKPFKGVFNVRIGEELHREATIIAGDRSLNAFVTEAIQEKIFREKPSLR

SEQ ID NO: 2293 - DNA, 1788 bp, Haemophilus influenzae
  Name: NTH1272
atgttagccaaagcaaaatatagaaaagattacaaacaaccagattttacggtcacagacatttatttagattttcaacttgatcctaaacatactgtggtaaccgcaagcacaaaattccaacgcttaaatgatgaagcgacttctttacgtttagacgggcatagcttccagttttcttctattaaatttaatggcgagccattttctgcttatcaacaagatggcgagagtttaacgctcgatttgaaaggcaaaagtgcggaagaatttgaacttgaaattgtgactttccttgtgccagctgaaaatacttcattacaaggattgtatcagtctggcgagggtatttgtacgcaatgtgaggcggaaggtttccgtcaaatcacttatatgcttgaccgtccagatgtattggcgtgctatacaaccaaaattacggcggacaaaagcaaatatccattcttactttctaatggcaatcgcattgcaagtggcgaattagaagatggtcgtcattgggtggaatggaatgacccattcccaaaaccaagctatttatttgctttagtggcaggggattttgatttattacaagataaatttattactaaaagtggccgtgaagttgcgttagagctttatgtggatcgcggtaatcttaaccgtgcaacttgggcaatggaaagtttgaaaaaagcgatgaaatgggatgaagatcgctttaatttagaatacgacttagatatttatatgatcgtcgctgtcgattttttcaatatgggtgcaatggaaaacaaagggttgaatatttttaattctaaatttgtattagccaatccacaaacggcaacagatgaggattatcttgctattgaaagtgtgattgcacacgaatatttccataactggacaggcaatcgtgtgacttgccgtgattggttccaattaagtttgaaagaaggcttaacggttttccgtgatcaagaattttcttcagatacaggttcgcgtgcagtgaatcgcattaataatgtgaaatttttacgcactgtgcaatttgccgaagatgcaagcccaatgtcacacccaattcgccctgaaaaagtgattgaaatgaataatttttataccgtaaccgtatatgaaaaaggggcagaagtgattcgtatgttgcataccttattaggtgaacaaggcttccaaaaagggatgcagctttatattgctgaaaatgatggcaaagcggcaacctgtgaagattttgtttctgcgatggaacgtgcaaataacctcgatttaaaccagttccgccgttggtatagccaatcgggtacaccagaattattgattagcgatgcttatgacgaaaaaacgcatacttatcgtttaacggtttcacaatccacaccgccaaccgcagatcaaatggaaaaagtgaatttacatattccattaaaaatcgcgctttatgatgcgaatggcacgaaacaaatgttacaacataatggcgaattgttgagtgatgtattaaatgtcactgaaaaagaccaagtctttgaatttcacggcatttatggtcgcccaattccagcattattatgtgatttttctgcgccagtaaaactggattatgattataaaacggaacagttattaggcttgctgaaatttgcagacaatcaatttatccgttgggatgcagcacaaatgctatttgcgcaagaattacgtcgtaatgttgtgcgtttccaacaaggcgaggcactagaaatttcgcctgaattt

SEQ ID NO: 2294 - protein, 596 aa, Haemophilus influenzae
  Name: NTH1272
MLAKAKYRKDYKQPDFTVTDIYLDFQLDPKHTVVTASTKFQRLNDEATSLRLDGHSFQFSSIKFNGEPFSAYQQDGESLTLDLKGKSAEEFELEIVTFLVPAENTSLQGLYQSGEGICTQCEAEGFRQITYMLDRPDVLACYTTKITADKSKYPFLLSNGNRIASGELEDGRHWVEWNDPFPKPSYLFALVAGDFDLLQDKFITKSGREVALELYVDRGNLNRATWAMESLKKAMKWDEDRFNLEYDLDIYMIVAVDFFNMGAMENKGLNIFNSKFVLANPQTATDEDYLAIESVIAHEYFHNWTGNRVTCRDWFQLSLKEGLTVFRDQEFSSDTGSRAVNRINNVKFLRTVQFAEDASPMSHPIRPEKVIEMNNFYTVTVYEKGAEVIRMLHTLLGEQGFQKGMQLYIAENDGKAATCEDFVSAMERANNLDLNQFRRWYSQSGTPELLISDAYDEKTHTYRLTVSQSTPPTADQMEKVNLHIPLKIALYDANGTKQMLQHNGELLSDVLNVTEKDQVFEFHGIYGRPIPALLCDFSAPVKLDYDYKTEQLLGLLKFADNQFIRWDAAQMLFAQELRRNVVRFQQGEALEISPEF

SEQ ID NO: 2295 - DNA, 525 bp, Haemophilus influenzae
  Name: NTH1273
atggtgatcggtacaacgggttttgatcaaaatggtaaagcagcgattaaagcagcttcagataaaattgctattgtgtttgcatcaaatttcagtgttggcgtgaatttagtcttcaagcttttagaaaaagcagcaaaagtgatgggggattattgcgatattgaagtgatcgaagctcatcaccgtcataaagttgatgcgccatctggcactgcactttctatgggcgaacatatcgcaaaaaccttaggtcgcgatttaaaaacgcacggagtcttctgccgtgaaggaattacaggcgaacgtaaacgggatgaaattggtttttcaactattcgcgcttcggatgtggtgggggaacacacggtttggttcgcagatattggcgaacgtgtagaaatttcccataaagcatcaagccgaatgactttcgctaatggtgcagtgcgtgctggtaaatggttagaaaataaggcgaatggcttatttgatatgaccgatgtattagatttaaataattta

SEQ ID NO: 2296 - protein, 175 aa, Haemophilus influenzae
  Name: NTH1273
MVIGTTGFDQNGKAAIKAASDKIAIVFASNFSVGVNLVFKLLEKAAKVMGDYCDIEVIEAHHRHKVDAPSGTALSMGEHIAKTLGRDLKTHGVFCREGITGERKRDEIGFSTIRASDVVGEHTVWFADIGERVEISHKASSRMTFANGAVRAGKWLENKANGLFDMTDVLDLNNL

SEQ ID NO: 2297 - DNA, 246 bp, Haemophilus influenzae
  Name: NTH1274
atgaaaatccaccttatccgccataacaccacattagaattcaataatgaaacaagtttacttgatcatctcgagaaaaataatattcatcacgaatatcaatgccgtagtggctattgtggttcttgtcgcgttaagatcaaaaaaggcaaggtgtcttataaagaaatgcctcttgcctttattcaacctgatgagattttattatgttgctgtcacgtagaaagtgaccttgaaattgattta

SEQ ID NO: 2298 - protein, 82 aa, Haemophilus influenzae
  Name: NTH1274
MKIHLIRHNTTLEFNNETSLLDHLEKNNIHHEYQCRSGYCGSCRVKIKKGKVSYKEMPLAFIQPDEILLCCCHVESDLEIDL

SEQ ID NO: 2299 - DNA, 738 bp, Haemophilus influenzae
  Name: NTH1275
atgaaattattgataaaaacttcacttagtcagtggatttgcttgaattttgccaaaattcctatttttaaaatgctaggttttataaccgcactttttattacggcttgtagttctattagcaaagaaccagtgaagactgtggatatttatattaaaccttattattctgctgaaaatggaaaagcagaaaatgtatttgtacataaagaaattgatcctatgttacgtgaaaatacgctaaaaggttataaaagtacggtaaaatttttagaagaaaatccagctcgcatttcaccaatgacaatgtttaccttagccgctcgggcttacgattttggcttaagagatgaagcggttacttggttttatcgtggtcaaaatcgtttgatcaccgcactttatgtgttggatttaccaaaacaaacggtgcaggataatacagggttcagccatgttgtagggcagtttgttaatgcttatgcgttttgtgattttgataaacaaagtcgtgctgccgaaaatgcggtgaaatggacaattgcgcatccttatgaagtggttttcttaccagcattacccgcaaaatttgcagatcgtcaaaaagcgttaaaagaatcggaagaaaaattagttcaacgtttacaggaacaagcccgtttttttgctaatccaaaaaataaagaaaaatggcaaaaaaagcggtcagaaaattttgtgaatgaacgattttgttgg

SEQ ID NO: 2300 - protein, 246 aa, Haemophilus influenzae
  Name: NTH1275
MKLLIKTSLSQWICLNFAKIPIFKMLGFITALFITACSSISKEPVKTVDIYIKPYYSAENGKAENVFVHKEIDPMLRENTLKGYKSTVKFLEENPARISPMTMFTLAARAYDFGLRDEAVTWFYRGQNRLITALYVLDLPKQTVQDNTGFSHVVGQFVNAYAFCDFDKQSRAAENAVKWTIAHPYEVVFLPALPAKFADRQKALKESEEKLVQRLQEQARFFANPKNKEKWQKKRSENFVNERFCW

SEQ ID NO: 2301 - DNA, 987 bp, Haemophilus influenzae
  Name: NTH1276
atgcaacatctgaacgagcttgttgagaaagcgaaattagcgattgaatccattcaggataaaagtttaacggctttggatgaaatccgtgtcgaatattttggtaagaaagggtattttacgcaattaatgcaagaattgcgtaacgtgtcagcagaagaacgtcctgcgatgggcgcaaaaattaacgaagcaaaacaagctgcgttagaatttttaaatgcaaaaaaaacggagtgggaacaggctgaacttaacgcaaaattagaaaaagaacgtgtagatgtcagtttaccaggtcgcaaagttgaaactggtggcttacacccagttaccatgacgattaatcgtgtaacaaaatttttctcagaacttggcttttcagttgaaaatggccctgaaattgaaagtgattattacaactttgatgcgttaaatattcctaaacatcacccagcacgtgccgatcacgatactttctggtttaatccagaattattacttcgtactcaaacttctggcgtgcaaattcgtactatggaaaaaatgcagccaccaattcgcattatggctccaggacgtgtatatcgtaatgactacgatcaaacgcatacgccaatgttccatcaaattgaactactttatgtggataaaaaagcaaatttcaccgaattgaaaggtttattgcacgatttcttacgcgctttctttgaagaagatttacaagtgcgtttccgtccatcttatttcccattcacagagccttcagcggaagtggatgtgatgggtaaaaatggtaaatggttagaagtgttgggctgcggtatggtgcatccaaatgtgttgcgtaacgttggtattgatccgaatgaatattctggttttgccgtgggaatgggtgttgagcgtttaacaatgttacgttataacgtaacagatttacgttcgttctttgaaaacgacttacgtttcttaaaacaatttaag

SEQ ID NO: 2302 - protein, 329 aa, Haemophilus influenzae
  Name: NTH1276
MQHLNELVEKAKLAIESIQDKSLTALDEIRVEYFGKKGYFTQLMQELRNVSAEERPAMGAKINEAKQAALEFLNAKKTEWEQAELNAKLEKERVDVSLPGRKVETGGLHPVTMTINRVTKFFSELGFSVENGPEIESDYYNFDALNIPKHHPARADHDTFWFNPELLLRTQTSGVQIRTMEKMQPPIRIMAPGRVYRNDYDQTHTPMFHQIELLYVDKKANFTELKGLLHDFLRAFFEEDLQVRFRPSYFPFTEPSAEVDVMGKNGKWLEVLGCGMVHPNVLRNVGIDPNEYSGFAVGMGVERLTMLRYNVTDLRSFFENDLRFLKQFK

SEQ ID NO: 2303 - DNA, 1119 bp, Haemophilus influenzae
  n 1110, 1111, 1112, 1113, 1114: n is any nucleotide
  Name: NTH1277
atgaaatttagtgaacagtgggtaagagaatgggtgaaccctgcggtgtccaccgagcaattatgcgagcaaattaccatgcttggcttagaagtagatggcgtggaaagcgttgcgggtacatttaatggtgtcgttgttggtgaagtagtggaatgtgcacaacatccagatgcagataaattacgtgtaactaaagtgaacgtaggcggtgatcgtttattggatatcgtgtgtggcgcagcaaattgtcgtcaaggcttaaaagtggcttgtgcaacagaaggtgcggtattacctggcgatttcaaaattaagaaaacgaaattacgtggtcagccatcagaagggatgctttgttcattttctgaattaggtattgatgttgaagcggatggtattattgaattgccacttgatgcaccaattggtactgatttacgtgaatatttagctttagatgataatgccatcgaaattagcttaacgccaaaccgtgcagattgtttgagcatcgcaggtattgcgcgtgaaattggtgtggtaaataaacaactcgtaaatcaaccgcactttgaagcagtgccagcaacaatttctgataaagttcaaattgatttacaagcaccagaagcttgcccgcgttatttattacgtgtgataaagaacgtcaatgtaaaagcaccatcgccaatgtggatgcaagaaaaattgcgtcgctgtggtattcgttctatcgatcctattgtcgatattactaactatattttgcttgagttcggtcagccaatgcacgcgtttgatgcagctaaagttacacaacctgttcaagttcgtttcgcgaaagagggggaagaattagtattattagatggctcaaccgcaaaacttcaatcaaatacgttattaattgctgaccaaaatgggcctttagcaatggcagggatctttggtggtgcaaccagtggcgtgaatagtgaaacgaaagatgtgattttagaatccgcatttttcgctccattagcgattgcaggccgtgcaagacaatatggtttacatactgatgcatcgcaccgttttgaacgtggtgtggattttgaattagcccgnnnnnttaat

SEQ ID NO: 2304 - protein, 373 aa, Haemophilus influenzae
  Xaa 371, 372: Xaa is any amino acid
  Name: NTH1277
MKFSEQWVREWVNPAVSTEQLCEQITMLGLEVDGVESVAGTFNGVVVGEVVECAQHPDADKLRVTKVNVGGDRLLDIVCGAANCRQGLKVACATEGAVLPGDFKIKKTKLRGQPSEGMLCSFSELGIDVEADGIIELPLDAPIGTDLREYLALDDNAIEISLTPNRADCLSIAGIAREIGVVNKQLVNQPHFEAVPATISDKVQIDLQAPEACPRYLLRVIKNVNVKAPSPMWMQEKLRRCGIRSIDPIVDITNYILLEFGQPMHAFDAAKVTQPVQVRFAKEGEELVLLDGSTAKLQSNTLLIADQNGPLAMAGIFGGATSGVNSETKDVILESAFFAPLAIAGRARQYGLHTDASHRFERGVDFELARXXN

SEQ ID NO: 2305 - DNA, 858 bp, Haemophilus influenzae
  Name: NTH1278
atgttacgtccgaaaaaacaatctttaaaacctaagttaaaacaccgtccatttttaaaatgggcggggggaaaatttcgtttaacggacgagataaataaagcctttccaaacaaaaaaaactgcttaattgagccatttgtgggtgctggagcgatatttctgaattctaattttgaacgctatattttggcagatatcaaccctgatttaatcaatctattcaatattgttaaagaaaatgtagagggttatattgaagattgtaagccgattttcttcgctgatgatgccaatacacccgattattactatgctaaacgtcgccaattcaatgcatcaacagatcctttcgaacgttcgattatttttttatatttgaaccgttttgggtttaacggattatgccgttataacagcaagaatgaatttaatgtgccttttggagcttacaaaactcattattttccagaagatgaattacgttatttcgctcataaagcgcaaagtgcggtatttttatgctgtgattttcaaaaaacttttgaatttgccgataaggattcggtgatttattgtgatccaccttatgctccgctacaacaagagactaattttactggttatgcagggaatgagtttggactagtgcagcaacgtgctttggcagatttagcgaaatctatacaaaaagaaaaacaaatttcgatattgatctcgaatcacgatactaaatttacgcgtgaaatttataacggtgctaaatttaaacgggtaaaagtccaacgttctattagccaaaacccagaaaaacgcgtaaaagtgaaagaattgattgcgatatttggtgctcgtaaa

SEQ ID NO: 2306 - protein, 286 aa, Haemophilus influenzae
  Name: NTH1278
MLRPKKQSLKPKLKHRPFLKWAGGKFRLTDEINKAFPNKKNCLIEPFVGAGAIFLNSNFERYILADINPDLINLFNIVKENVEGYIEDCKPIFFADDANTPDYYYAKRRQFNASTDPFERSIIFLYLNRFGFNGLCRYNSKNEFNVPFGAYKTHYFPEDELRYFAHKAQSAVFLCCDFQKTFEFADKDSVIYCDPPYAPLQQETNFTGYAGNEFGLVQQRALADLAKSIQKEKQISILISNHDTKFTREIYNGAKFKRVKVQRSISQNPEKRVKVKELIAIFGARK

SEQ ID NO: 2307 - DNA, 894 bp, Haemophilus influenzae
  n 31: n is any nucleotide
  Name: NTH1279
atgttttattgccagatggcgaaaaatacanaaacacttgaatctttaaacttaattttcaccgcacttttgcaagataatcatgggcgagataccacgattattgcattgggcggcggcgtaattggcgatgttgctggctttgtggcggcaagttatcagcgcggtgtgcgtttaattcaaatgccaaccacattgctttcacaagtggattcttcagtgggcggtaaaacggcggttaatcatgaattaggcaaaaatatgattggcgcgttctatcagccatcaatggttattattgatacgctcacgcttaatacgcttcctaaacgtgaagtaaacgcggggcttgccgaagttatcaaatatggtgccattttagattacgaattttttgaatggctagagcaacatattgatgaacttgtcgctttgcatcctgaggcgcttcaacattgtatttctcgttgttgccaaattaaagcagatgttgttgcgagagatgaaacagaaaaaggcgatcgtgcattgcttaatcttggacatacttttggacatgccattgaaactcacttaggttatggaaactggcttcatggtgaagctgtttcgacgggaatgatgatggcagcggtgctttcggaagaacttggagatatttctattgcagatgtgtctcgccttgaaaaattacttgctcgtgccaatttgcccaccgtatcaccggatacgatgcagccagaagactatttaccgcatatgatgcgtgataaaaaagttctatcgggtaaattgcgtctggtgttactcaaatctctaggccaagcttatgtggcgaatgataccgatcataccctcgtgttaaacgcaattcgtcgttgtactcaaacggat

SEQ ID NO: 2308 - protein, 298 aa, Haemophilus influenzae
  Xaa 11: Xaa is any amino acid
  Name: NTH1279
MFYCQMAKNTXTLESLNLIFTALLQDNHGRDTTIIALGGGVIGDVAGFVAASYQRGVRLIQMPTTLLSQVDSSVGGKTAVNHELGKNMIGAFYQPSMVIIDTLTLNTLPKREVNAGLAEVIKYGAILDYEFFEWLEQHIDELVALHPEALQHCISRCCQIKADVVARDETEKGDRALLNLGHTFGHAIETHLGYGNWLHGEAVSTGMMMAAVLSEELGDISIADVSRLEKLLARANLPTVSPDTMQPEDYLPHMMRDKKVLSGKLRLVLLKSLGQAYVANDTDHTLVLNAIRRCTQTD

SEQ ID NO: 2309 - DNA, 222 bp, Haemophilus influenzae
  n 217, 218, 219, 220, 221: n is any nucleotide
  Name: NTH1280
atggaacattatattagcctatttgttaaggcagtcttcattgaaaatatggcactttctttcttcttaggaatgtgtactttcttagcggtatctaaaaaggtgtccactgcgtttggtcttgggattgcggtaactttcgttcttggtatcgcagtgccagtaaaccaattaatttatgcaaatgtactaaaagaaaatgctttaatgaagtgtnnnnnt

SEQ ID NO: 2310 - protein, 74 aa, Haemophilus influenzae
  Xaa 73, 74: Xaa is any amino acid
  Name: NTH1280
MEHYISLFVKAVFIENMALSFFLGMCTFLAVSKKVSTAFGLGIAVTFVLGIAVPVNQLIYANVLKENALMKCXX

SEQ ID NO: 2311 - DNA, 624 bp, Haemophilus influenzae
  Name: NTH1281
atgtctggaaaaacaagttataaagatctgttgttagcgccaattgctaaaaacaaccctattgcattgcaaatcttagggatttgttctgcattagctgtaacaacaaaattagaaactgcttttgttatggcgattgcagttaccttagtaactggattatcaaacttatttgtttccctaatccgcaattatatccctaacagcattcgtattattgtacagctcgcaatcatcgcttcgcttgttatcgtagtggatcaaattctaaaagcctatgcttatggtttatctaaacaactttcagtattcgttggtttgattattactaactgtatcgtaatggggcgtgctgaagcatttgcgatgaaatcccctccagttgaaagttttgtagatggtatcggaaatggcttaggttatggttcgatgttaattatcgtagcatttttccgtgaacttatcggttcaggtaaattatttggtatgactattttcgaaactattcaaaatggtggctggtatcaagcaaatggtttattcctacttgcaccaagtgcattctttatcatcggatttgtgatctggggattaagaacttggaaaccagaacaacaggagaag

SEQ ID NO: 2312 - protein, 208 aa, Haemophilus influenzae
  Name: NTH1281
MSGKTSYKDLLLAPIAKNNPIALQILGICSALAVTTKLETAFVMAIAVTLVTGLSNLFVSLIRNYIPNSIRIIVQLAIIASLVIVVDQILKAYAYGLSKQLSVFVGLIITNCIVMGRAEAFAMKSPPVESFVDGIGNGLGYGSMLIIVAFFRELIGSGKLFGMTIFETIQNGGWYQANGLFLLAPSAFFIIGFVIWGLRTWKPEQQEK

SEQ ID NO: 2313 - DNA, 807 bp, Haemophilus influenzae
  Name: NTH1282
ttgcaaacttatttgcaccgattttcgactacatcgttgttcaagcaaatatcaaacgtcggagagcaagaacaaatggctaagtttaataaagacagcgtaggcggcacaatccttgttgtgctactactgagtttagtttgttccattattgttgctggttccgcagtaatgttaaagcctgcacaagaagaacaaaaattgcttgataaacaaaaaaatattttaaatgtagctggtcttttacaagcaaatacgaatgtaaaagaaacttatgcaaaatttattgagccgcgtttcgttgatttagcaacgggtgaatacacacaacaagcagatgatagccaacaagcaattcctgctgatgcggataaagcacgtattcgttctcgtagcaaaacaactgaagtttatcttgtaaaagatgaacagggtcaaactcaacaagttattttaccaatttatggcactggcttgtggtcagtgatgtatggcttagtatctgttcaaccagatggtaatactattaatggaatcacttactatcaacacggagaaacaccgggattgggcggagaaattgaaaatccaaactgggcaagtctatttaaaggtaaaaaattatttgatgagcaacatcaacctgccattcgtattgtaaaaggtcaagctccacaagatgaacatagcattgatggtttatctggtgcaactttaacaggtaatggtgttcaaggtacctttaattattggttcagcaaagatggctttggtccatatcttgaaaaacttcattcaggagcaaac

SEQ ID NO: 2314 - protein, 269 aa, Haemophilus influenzae
  Name: NTH1282
LQTYLHRFSTTSLFKQISNVGEQEQMAKFNKDSVGGTILVVLLLSLVCSIIVAGSAVMLKPAQEEQKLLDKQKNILNVAGLLQANTNVKETYAKFIEPRFVDLATGEYTQQADDSQQAIPADADKARIRSRSKTTEVYLVKDEQGQTQQVILPIYGTGLWSVMYGLVSVQPDGNTINGITYYQHGETPGLGGEIENPNWASLFKGKKLFDEQHQPAIRIVKGQAPQDEHSIDGLSGATLTGNGVQGTFNYWFSKDGFGPYLEKLHSGAN

SEQ ID NO: 2315 - DNA, 1233 bp, Haemophilus influenzae
  Name: NTH1283
atgggtttgaaaaatctttttgaaaaaatggaacccgcgtttttacccggtggtaaatacagcaagctttatccgatctttgaatcgatttataccttgctttatacacctggtacggtaacgcacaaaaacactcacgttcgtgatgcgttagattcaaaacgtatgatgattacggttttccttgcgttgttccctgcgattttctatgggatgtacaatgtgggtaaccaagcgattccagcgttaaatcaattaggcaatttagatcaactaattgctaacgattggcactatgctcttgcaagttcattaggtttagatttaactgccaatgcaacttggggctctaaaatggctcttggagcaattttctttttaccaatttacttagtggtatttaccgtttgtactatttgggaattgttattctctgtggttcgtggtcacgaagtaaatgaaggaatgttcgtttcaaccattttatttgccttgatcgttccaccaacattgccactatggcaagccgcattaggtattacttttggtatcattgttgcaaaagaaatttttggtggcgtaggtcgtaactttatgaaccctgcacttgctggtcgtgcgttcttattcttcgcatatccagctcaaatttcaggcgatacggtttggactgccgcagatggtttctctggtgcaaccgcactttcacagtggtcacaaggtggtcaaggtgcattgcaacataccgtaacaggcgctccaattacttggatggatgcttttgttggtaacttacctggttcaatgggggaagtttctacccttgcaattttaattggcggtgctgttattgtattcactcgcattgcagcttggcgcattattgctggtgtgatgattggcatgattgcaacctcaaccttgtttaacctaattggctcagagactaaccctatgttctcaatgccttggcattggcactttgttttaggtgggtttgcattgggtatggtatttatggcgaccgatcctgtttcagcatcttttactaatactggtaaatggtggtacggtgcattaattggcgtaatggctgtattaattcgtactgtaaacccagcctatccagaaggaatgatgttagcgattttatttgcaaacttatttgcaccgattttcgactacatcgttgttcaagcaaatatcaaacgtcggagagcaagaacaaatggc

SEQ ID NO: 2316 - protein, 411 aa, Haemophilus influenzae
  Name: NTH1283
MGLKNLFEKMEPAFLPGGKYSKLYPIFESIYTLLYTPGTVTHKNTHVRDALDSKRMMITVFLALFPAIFYGMYNVGNQAIPALNQLGNLDQLIANDWHYALASSLGLDLTANATWGSKMALGAIFFLPIYLVVFTVCTIWELLFSVVRGHEVNEGMFVSTILFALIVPPTLPLWQAALGITFGIIVAKEIFGGVGRNFMNPALAGRAFLFFAYPAQISGDTVWTAADGFSGATALSQWSQGGQGALQHTVTGAPITWMDAFVGNLPGSMGEVSTLAILIGGAVIVFTRIAAWRIIAGVMIGMIATSTLFNLIGSETNPMFSMPWHWHFVLGGFALGMVFMATDPVSASFTNTGKWWYGALIGVMAVLIRTVNPAYPEGMMLAILFANLFAPIFDYIVVQANIKRRRARTNG

SEQ ID NO: 2317 - DNA, 144 bp, Haemophilus influenzae
  Name: NTH1284
gtgggcgatactgatggcgctcaagagttaggttgtctggaattagacgaagaagacttggcgttatgttctttcgtttgtccaggcaaatatgaatacggttcaatcttgcgtcaagtcttagataagattgagaaggaaggt

SEQ ID NO: 2318 - protein, 48 aa, Haemophilus influenzae
  Name: NTH1284
VGDTDGAQELGCLELDEEDLALCSFVCPGKYEYGSILRQVLDKIEKEG

SEQ ID NO: 2319 - DNA, 762 bp, Haemophilus influenzae
  Name: NTH1285
atgaaagtgaagctcttctattttgtaaacgcgatggataccaatccattagcagccgatccctctgtcgtattaaaagaatattcgcaagacttcactaacggtttaaccgtattaagtcgtctattcccttcaaaaccattacacttatgtaaagcgggcgattctaatattcccactgctgatcttgaaaatttacagattcatgattttactggtgttcatccagctggtcttgtagggacgcatattcactttattgatcctgtcggtattcaaaaaactgtatggcatatcaattatcaagatgtgatcgctgtaggtaaattatttacaacaggcgaactttattcagaacgagtaatttctcttgcaggtcctcaagtgaaagaacctcgtttagtacgtacaataatcggtgctaatctttctcaattaacccaaaatgaattaagtgcgggtaaaaatcgtgtaatttctggctcagttctttgtggtcaaatagcaaaagattcacatgattatttaggtcgctatgctctgcaagtatcagtaatcgctgaaggtaatgaaaaagaattttttggttggattatgccacaagccaataaatattctgtgactcgtaccgtattaggccacttcagtaaaaaattgtttaattttactacttcagaaaatggtggcgaacgtgcaatggtgccaatcggtagctatgagcgcgtaatgcccgttggacattttacctacattattattacg

SEQ ID NO: 2320 - protein, 254 aa, Haemophilus influenzae
  Name: NTH1285
MKVKLFYFVNAMDTNPLAADPSVVLKEYSQDFTNGLTVLSRLFPSKPLHLCKAGDSNIPTADLENLQIHDFTGVHPAGLVGTHIHFIDPVGIQKTVWHINYQDVIAVGKLFTTGELYSERVISLAGPQVKEPRLVRTIIGANLSQLTQNELSAGKNRVISGSVLCGQIAKDSHDYLGRYALQVSVIAEGNEKEFFGWIMPQANKYSVTRTVLGHFSKKLFNFTTSENGGERAMVPIGSYERVMPVGHFTYIIIT

SEQ ID NO: 2321 - DNA, 255 bp, Haemophilus influenzae
  n 250, 251, 252, 253, 254: n is any nucleotide
  Name: NTH1286
atgggtacagtaaaaatcacatcgcgttatggcatattgttaggctttattgccctactttgcacaataatttctacaggaattttcttcctaacaaaagataaaattgatgcggtaatcgcagcacaacagcgagaattacttctacaagttatcccacaagattatttcaacaataatttgctagaaagggcggtattcctcaagaaaaaattttgggggtatccaaaaaaattatttgccgaaaaannnnnt

SEQ ID NO: 2322 - protein, 85 aa, Haemophilus influenzae
  Xaa 84, 85: Xaa is any amino acid
  Name: NTH1286
MGTVKITSRYGILLGFIALLCTIISTGIFFLTKDKIDAVIAAQQRELLLQVIPQDYFNNNLLERAVFLKKKFWGYPKKLFAEKXX

SEQ ID NO: 2323 - DNA, 1074 bp, Haemophilus influenzae
  Name: NTH1287
atgtttaaaatggttagctccccacatacccattcgggaaaactcacagcgcatattatgctttgggtcattttggcaatgatgcccgcttttttcacgcaaatttattattttggatttggcgtggtgcttcaatccgcattagccattggtacggcaatcattgctgaatttattgcaataaaattacgaggtaaaaaaccgctcaattatctttcagatttcagcgtagccctaactgcgttaattttggcaatggctattccaccttatgcaccttattggattatcatcattggaacactctgtgcagttttattaggtaaacaggtttatggggggttagggcaaaacccattcaatcccgcgatgattggctatgtaattcttctaatttcattcccattacaaatgacaacttggatgccaccaattaatttattacaggaaccaccgactttttcagatactttttcattaatattttcaggtttaaccacggatggatttaccctttcacaacttacacataacattgatggcatcacccaagcaacgcctttggatagcgcaaaaattttctataaaagtcacaatcaattaagtgatttttatgaattaattaaactgccgatttttatgggtaatggaaccgattttgctcaaggctggtggcaaatcaacgtggctttcttagcgggcggaattttccttattttaaaacgcattattcactggcaaattccagtggcgatgcttgtcacctttttctgtttagccactgcgaccgcttttactggtttcacgcatttaagtgcgattagccaactcgttagtggcgcaatgatgtttggtgcattttttattgcaacagatcctgtcacagcctccattacaccacgcggaaaaattatttttggcgcattagtggggttatttgtttatctcattcgttatcacggaaattatccagacggcgtggcattcgccattttattaagtaatatttgcgtcccacttatcgatcattacacacgtccgcgcgtatctggttatccaacaaaaggaagaaaa

SEQ ID NO: 2324 - protein, 358 aa, Haemophilus influenzae
  Name: NTH1287
MFKMVSSPHTHSGKLTAHIMLWVILAMMPAFFTQIYYFGFGVVLQSALAIGTAIIAEFIAIKLRGKKPLNYLSDFSVALTALILAMAIPPYAPYWIIIIGTLCAVLLGKQVYGGLGQNPFNPAMIGYVILLISFPLQMTTWMPPINLLQEPPTFSDTFSLIFSGLTTDGFTLSQLTHNIDGITQATPLDSAKIFYKSHNQLSDFYELIKLPIFMGNGTDFAQGWWQINVAFLAGGIFLILKRIIHWQIPVAMLVTFFCLATATAFTGFTHLSAISQLVSGAMMFGAFFIATDPVTASITPRGKIIFGALVGLFVYLIRYHGNYPDGVAFAILLSNICVPLIDHYTRPRVSGYPTKGRK

SEQ ID NO: 2325 - DNA, 2037 bp, Haemophilus influenzae
  Name: NTH1290
atgtcgatggctctgaaaaaaaattggttgtgggggaataaatggcggacgtattatctcgtttcaattccggtaaattatggggatttcaaaggtggcattcatgcgccagaaatgaaatctcaatctaattcacagccattacgccatctgcctctcggcacggatttttacattccactcaaacagcacctaggaacaacaggcaatcttttaataaaagagggcgattatgtcttaaaaggacaagccttaacaaaaggcgatggcttgcgtatgttgccagttcacgcgcccacttctggcacaattaaatcgattaaaccttatgttgccacgcatccttcaggtcttgatgaacccacaattcatttacaggcggatggtttagatcaatggatcgaacgtaatcctattgatgatttttcaacgctatcgccagaacaacttattcacaaaatctatcaagcaggtatagcaggtttaggcggtgcagtattcccaactgctgccaaaattcagtcagcagagcaaaaagtcaaactcttaattatcaatggtgcagaatgtgagccttatatcacttgtgatgatcgtcttatgcgtgaacgcgctgatgaaatcataaaaggcattcgtattttacgttatatattgcaccctgaaaaagttgtcattgccattgaagataacaaaccagaagccatatcggcaatccgcacagcactacagggagcaaatgatattagcattcgggttattccaacaaaatatccttcaggtgctaccaaacaactgatttatttgctcacagggatagaagtgccaagcggtgcacgttcatccagcattggcgtattaatgcaaaatgtgggaacaatgttcgcaataaaaagagcaattataaatgacgagcctttaattgagcgtgttgtcacccttactggaaataaaatcgctgaaaaaggcaattattgggtgcgtcttggcacacccatttcccaaatattgagcgatgcaggctatcaatttgacaagcattttcctatatttgcaggtgggccaatgatggggctagagcttccaaacctaaatgcacctgtgacaaaacttgtcaattgtttacttgcgccagattatcttgaatatgccgaacctgaagcagaacaggcttgtattcgttgttctagctgttctgatgcctgcccagtaaatttaatgccacaacaactttattggtttgcgcgcagtgaagatcacaaaaaatcggaagaatacgctctcaaagattgtattgaatgtggaatttgcgcatacgtatgcccaagccatattcctctaattcaatatttccgccaagaaaaagctaaaatctggcaaataaaagaaaaacaaaagaaatcagatgaagccaaaattcgctttgaagcaaaacaagcacggatggaacgtgaagaacaagagcgtaaagcacgttcacaacgtgcagcacaggctcgccgtgaagaattagcacaaactaaaggggaagatccagtcaaggcggcactcgaacgcttgaaagcgaaaaaagccaatgaaacagaaccaacgcagattaaaacactaacctcagaaaaaggagaagttttacctgataacacagatttaatggcacaacgtaaggcacgccgtttagctcgtcagcaagcagcatctcagtgcgaaaaccaagaccaacaaactcaaccaaccgatgcgaaaaaagcagcagtagccgccgccattgctcgagcaaaggcaaaaaaacttgcacaaacaaatagcaccagcgaagccatttcaaactctcaaaccgcagaaaatgaagtagaaaaaccaaagagtgcggtagaaaaaacagaagaaaattcaactgcacttgaccctaaaaaagcagccgtagccgccgccattgcgcgcgcaaaagcaaaaaaacttgcgcaagcaaatagcaccagcgaagctatttcaaactctcaaaccgcagaaaatgaagtagaaaaacaaatagtgcgg

SEQ ID NO: 2326 - protein, 679 aa, Haemophilus influenzae
  Name: NTH1290
MSMALKKNWLWGNKWRTYYLVSIPVNYGDFKGGIHAPEMKSQSNSQPLRHLPLGTDFYIPLKQHLGTTGNLLIKEGDYVLKGQALTKGDGLRMLPVHAPTSGTIKSIKPYVATHPSGLDEPTIHLQADGLDQWIERNPIDDFSTLSPEQLIHKIYQAGIAGLGGAVFPTAAKIQSAEQKVKLLIINGAECEPYITCDDRLMRERADEIIKGIRILRYILHPEKVVIAIEDNKPEAISAIRTALQGANDISIRVIPTKYPSGATKQLIYLLTGIEVPSGARSSSIGVLMQNVGTMFAIKRAIINDEPLIERVVTLTGNKIAEKGNYWVRLGTPISQILSDAGYQFDKHFPIFAGGPMMGLELPNLNAPVTKLVNCLLAPDYLEYAEPEAEQACIRCSSCSDACPVNLMPQQLYWFARSEDHKKSEEYALKDCIECGICAYVCPSHIPLIQYFRQEKAKIWQIKEKQKKSDEAKIRFEAKQARMEREEQERKARSQRAAQARREELAQTKGEDPVKAALERLKAKKANETEPTQIKTLTSEKGEVLPDNTDLMAQRKARRLARQQAASQCENQDQQTQPTDAKKAAVAAAIARAKAKKLAQTNSTSEAISNSQTAENEVEKPKSAVEKTEENSTALDPKKAAVAAAIARAKAKKLAQANSTSEAISNSQTAENEVEKQIVR

SEQ ID NO: 2327 - DNA, 174 bp, Haemophilus influenzae
  Name: NTH1291
atgggctgcccaaaaggtaaccaaggctgttcccgtgatgccattattggtccaaataaagcaatgcacgcgtcattccccgatcttgtaacaggtggcgagctttgtgtgcggccctgcccgacagattgtattttaatgattcccgtgaaaaaaaatattgataattgggat

SEQ ID NO: 2328 - protein, 58 aa, Haemophilus influenzae
  Name: NTH1291
MGCPKGNQGCSRDAIIGPNKAMHASFPDLVTGGELCVRPCPTDCILMIPVKKNIDNWD

SEQ ID NO: 2329 - DNA, 465 bp, Haemophilus influenzae
  Name: NTH1292
atgattattagcagtttaaccaacccaaattttaaagttggtttgccaaaagtgattgctgaagtatgtgattatttaaatacgttagatttgaatgcgttagagaatggtcgccatgatattaacgatcaaatttatatgaacgtaatggaaccagaaactgcagaaccaagcagtaaaaaagcagaattacatcatgaatacttagatgtacaagtgcttattcgtggcacggaaaatatcgaagtgggcgcaacctatccgaatttatctaagtatgaagattacaacgaagcggatgattatcaactttgtgcagatattgatgataaattcaccgtcacaatgaaaccaaaaatgttcgctgtattctatccttatgaaccgcacaagccttgctgtgtagtgaatggaaaaacagaaaaaattaaaaaattagtcgtaaaagtacctgttaaattaatt

SEQ ID NO: 2330 - protein, 155 aa, Haemophilus influenzae
  Name: NTH1292
MIISSLTNPNFKVGLPKVIAEVCDYLNTLDLNALENGRHDINDQIYMNVMEPETAEPSSKKAELHHEYLDVQVLIRGTENIEVGATYPNLSKYEDYNEADDYQLCADIDDKFTVTMKPKMFAVFYPYEPHKPCCVVNGKTEKIKKLVVKVPVKLI

SEQ ID NO: 2331 - DNA, 477 bp, Haemophilus influenzae
  Name: NTH1293
ttgattgttctctctgaaattaggttcttttatatgaaatataatgtaatgatggctagtgatgctaattatcttccttatgtagaaatcacactgaaatctttattaatgcacaatgaaaatctctctgtttttattttacatacaggagatatttctgaatcgtggcaaaatgatcttcaactttattttgctaaacgctattcaacattacaattagttcatatgatttcaattaatactcttgatatttctcttgttatttttcattttacaggtcctcataagcctcttgataatattttttctgaaaatgcttgtgttaatgccgtaatttcattgtttagactttatgcgtcaataagttggcaaatatttgctctctttcactcggtactacaagagctaattggattaatcaagagagatgatgtaatcggtggctttatttcatttaaccgacttggtatcatagtg

SEQ ID NO: 2332 - protein, 159 aa, Haemophilus influenzae
  Name: NTH1293
LIVLSEIRFFYMKYNVMMASDANYLPYVEITLKSLLMHNENLSVFILHTGDISESWQNDLQLYFAKRYSTLQLVHMISINTLDISLVIFHFTGPHKPLDNIFSENACVNAVISLFRLYASISWQIFALFHSVLQELIGLIKRDDVIGGFISFNRLGIIV

SEQ ID NO: 2333 - DNA, 120 bp, Haemophilus influenzae
  Name: NTH1294
ttgtttaacaattggattcacaatgttttccttaaaatttatattaaaaacaatgccttatttcccagattgcgactagcaaaagaaatctttcgaaaaaatgaccgcactttgggcgtt

SEQ ID NO: 2334 - protein, 40 aa, Haemophilus influenzae
  Name: NTH1294
LFNNWIHNVFLKIYIKNNALFPRLRLAKEIFRKNDRTLGV

SEQ ID NO: 2335 - DNA, 1218 bp, Haemophilus influenzae
  Name: NTH1295
gtgaatccaattgttaaacaatttaaatacggtcagcataccgttactctagaaactggcgcgattgcacgtcaagcaacggctgcggttatggcaagcatggacgataccacggtattcgtgactgttgttgctaaaaaagatgtgaaagaaggtcaagacttcttcccattaaccgtaaactaccaagagcgtacttatgcagcgggtaaaatcccaggtggtttcttcaagcgtgaaggtcgtccatctgaaggcgaaactttaattgcacgtttaattgaccgtccaattcgtccattattcccagaaggtttcttcaatgaaatccaagttgtggcaactgtggtttctgtaaacccacaaatcagccctgacttagtggcaatgatcggtgcttctgcagcattaaccttatctggcgtgcctttcaatggtcctatcggtgcagcgcgtgttggttttatcgacaaccaattcgtattaaacccaactatggctgaacaaaaacaaagccgtttggacttagtggttgcaggtactgacaaagccgtattaatggttgaatctgaagctgatattttaactgaagaacaaatgttagcggcagtcgtattcggtcatcaacaacaacaagttgtgattgaagcagtcaaagaatttgcaaaagaagcgggcaaaccacgttgggattgggttgctccacaaccaaacacagatttaatcaacaaagtaaaagcgattgctgaagcacgtttaggcgatgcataccgcattactgaaaaacaagctcgttacgaacagatcgatgcgattaaagcggatgtaattgcgcaaatcacagctgaagatgaagaaatcagcgaaagtaaaatcgtggatatttttaccgcacttgaaagccaaatcgtgcgtggtcgtatcattgcaggcgaaccacgtattgatggtcgtaccgttgatactgttcgtgcattagatatttgcactggtgtattaccacgtactcacggttctgcgatttttactcgtggcgaaacgcaagcattagctgttgcaaccttaggtaccgaacgtgatgcacaaatcattgatgaattaacgggtgaacgtcaagatcacttcttattccattataatttccctccatattctgtaggcgaaacaggtatgatcggctcgccaaaacgtcgtgagatcggtcacggtcgtttagca

SEQ ID NO: 2336 - protein, 406 aa, Haemophilus influenzae
  Name: NTH1295
VNPIVKQFKYGQHTVTLETGAIARQATAAVMASMDDTTVFVTVVAKKDVKEGQDFFPLTVNYQERTYAAGKIPGGFFKREGRPSEGETLIARLIDRPIRPLFPEGFFNEIQVVATVVSVNPQISPDLVAMIGASAALTLSGVPFNGPIGAARVGFIDNQFVLNPTMAEQKQSRLDLVVAGTDKAVLMVESEADILTEEQMLAAVVFGHQQQQVVIEAVKEFAKEAGKPRWDWVAPQPNTDLINKVKAIAEARLGDAYRITEKQARYEQIDAIKADVIAQITAEDEEISESKIVDIFTALESQIVRGRIIAGEPRIDGRTVDTVRALDICTGVLPRTHGSAIFTRGETQALAVATLGTERDAQIIDELTGERQDHFLFHYNFPPYSVGETGMIGSPKRREIGHGRLA

SEQ ID NO: 2337 - DNA, 888 bp, Haemophilus influenzae
  Name: NTH1297
atgccaagccttgcagaattcccgtatgttgtgcgtgtagtatctgaaatcactgaatctaacggttcttcttctatggcatctgtatgtggtgcgtctttagcattaatggatgcaggcgttccaatcaaagctgctgttgcaggtatcgcaatgggtttagtgaaagaagaagagaaattcgtggtgctttcagatatcttaggtgatgaagaccatttaggcgatatggactttaaagtagctggtacacgcgaaggtgtaaccgcccttcaaatggatatcaaaattgaaggtatcacccctgaaattatgcaaattgcattaaaccaagcgaaaagtgcacgtatgcacattcttggtgtcatggaacaagcaatcccagctccacgtgcggatatttcagattacgcaccgcgcatctatacaatgaaaatcgatcctaagaaaatcaaagatgtgattggtaaaggtggtgcaacaatccgttcactaactgaagaaactggtacatcaattgatattgatgacgatggtacagtgaaaattgctgcagtagatagcaatgcagcgaaaaacgtaatgggacgtattgaggaaatcgttgcagaagttgaagctggcgcaatttacaaaggtaaagtcactcgtcttgctgattttggtgcattcgtcgcaatcgttggaaataaagaaggtttggttcatatttctcaaattgctgaagagcgtgtagaaaaagttagcgattaccttcaagtgggtcaagaagtaaacgtaaaagttgttgaaatcgatcgtcaaggtcgtattcgtttaacaatgaaagacttggctccaaaacaagaaactgaaattaaccaagaagatcctgtcgaagaacaggaa

SEQ ID NO: 2338 - protein, 296 aa, Haemophilus influenzae
  Name: NTH1297
MPSLAEFPYVVRVVSEITESNGSSSMASVCGASLALMDAGVPIKAAVAGIAMGLVKEEEKFVVLSDILGDEDHLGDMDFKVAGTREGVTALQMDIKIEGITPEIMQIALNQAKSARMHILGVMEQAIPAPRADISDYAPRIYTMKIDPKKIKDVIGKGGATIRSLTEETGTSIDIDDDGTVKIAAVDSNAAKNVMGRIEEIVAEVEAGAIYKGKVTRLADFGAFVAIVGNKEGLVHISQIAEERVEKVSDYLQVGQEVNVKVVEIDRQGRIRLTMKDLAPKQETEINQEDPVEEQE

SEQ ID NO: 2339 - DNA, 657 bp, Haemophilus influenzae
  n 605: n is any nucleotide
  Name: NTH1298
atgcggtgttttcgcttatctcgccattttatagtctatttatttagcttatgtgcgatcttactccttgctggctgtgttcagtctaggggcggttttgtgtctaaaaatcatgtcgtgttggctgaacaaaacccgaatactcactttgaacaagaagtgatgatcgtgcgattaagccaagtactactggttggaaaaatgagtaatgaagaacgtgcatcgctacattttgaacgtggcgtactctatgattctcttggattatggggacttgctcgttatgatcttactcaagcccttgcattacagccgaaaatggcatctgtgtacaattacttagggctttatttattgcttgaagaagattatgacggcgcattggatgctttcaatacggtgtttgaattagattcaggttatgactatacccaccttaatcgtggtttaaatttttattatgtagggcactaccatcttgctcagcaagatttcttacagttctaccaagccgataaaaaagatccctatcgtgtcttatggctatatttgaacgaacaaaaattaaaaccacaagaagcccaaacaaaccttggtgaacgagncaaagggctatcagaggactttctggggtacacacattcgttcaatattact

SEQ ID NO: 2340 - protein, 219 aa, Haemophilus influenzae
  Xaa 202: Xaa is any amino acid
  Name: NTH1298
MRCFRLSRHFIVYLFSLCAILLLAGCVQSRGGFVSKNHVVLAEQNPNTHFEQEVMIVRLSQVLLVGKMSNEERASLHFERGVLYDSLGLWGLARYDLTQALALQPKMASVYNYLGLYLLLEEDYDGALDAFNTVFELDSGYDYTHLNRGLNFYYVGHYHLAQQDFLQFYQADKKDPYRVLWLYLNEQKLKPQEAQTNLGERXKGLSEDFLGYTHSFNIT

SEQ ID NO: 2341 - DNA, 93 bp, Haemophilus influenzae
  n 80, 81, 82, 83, 84: n is any nucleotide
  Name: NTH1299
gtgccaggggaattgccggaaatcccaacattttgctggaaatctcacagaaacctatttttatttagcaaaacacaatnnnnnttaattaat

SEQ ID NO: 2342 - protein, 31 aa, Haemophilus influenzae
  Xaa 27, 28: Xaa is any amino acid
  Name: NTH1299
VPGELPEIPTFCWKSHRNLFLFSKTQXXLIN

SEQ ID NO: 2343 - DNA, 1407 bp, Haemophilus influenzae
  n 1402, 1403, 1404, 1405, 1406: n is any nucleotide
  Name: NTH1300
ttgctaacaacattaagccattcagagagtgaaattagaaagaataatgcagaaattcaagcattaaaaaaacaacaagaaacagcaacaagtactgattataatgcacagtcacaggacgatttacaaaatagtctcgataagataaatgatcaattacaagatacgcaaaacgcattaggcgcggcaaatgcacaattggcagggcaaaattctatttctgaacgagctcaagcggcattaacggaaaatgttgtacgcactcagcaaattaatcaacaattggccaataatgatattggtagcgcattacgaaaacaatatcagattgaattacaactgattgatttaaagaatagttataatcaaaatttattaaaaaataatgatcagctttctttactttatcaaagtcgttacgacctattgaatttacgtttgcaggtgcaacaacaaaatattattgcgattcaagaagtcattaatcaaaaaaatcttcagcaatcacaaaatcaactagaacaagctcagcagcaacagcaaaaaactgtgcaaaatgattacattcaaaaagaacttgatcgcaatgcacagcttggtcagtatctattacaacaaacagaaaaagcgaattcattaactcaagatgagttaagaatgcggaatattttagatagcctcactcaaactcaacatactattgatgaacaaattagtgcattacaaggcacgttagttctttcacgtattatccagcaacaaaaacaaaaattaccgactaacttaaatattcaaggtttatcaaaacaaattgccgatttgcgtgtgcatatttttgacattactcaaaaacgcaatgaactttatgatctaaataactatattaataaagttgaaagtgaagatggaaaacaatttactgaggcagaaagaacgcaggttaaaacgctattaactgagcgtcgaaaaatgacatctgatctgattaaatctttaaataatcaattaaatctcgcgatttctttggaattaacgcagcagcaaattacacaaatcagtgatcaaattcaatctaaattagagcagcaaagtttttgggtgaaaagtaataatcccattaatttagattggataaaaatgctgccaagagctttaattgaacagtttaatggtatgttgaaaaaattaggttttccaactaattatgacaatttaccttatttacttatgtatttcttagggttatttattgtaggtggtgcaatttttaaatttaaaaatcgtattaaacaacaattaaacaaaattaatcgtgaaatacatcgcttagatacagatagtcagtggagtactccacttgccctgttattaactgcgtttttaacgctttctagtacacttnnnnnt

SEQ ID NO: 2344 - protein, 469 aa, Haemophilus influenzae
  Xaa 468, 469: Xaa is any amino acid
  Name: NTH1300
LLTTLSHSESEIRKNNAEIQALKKQQETATSTDYNAQSQDDLQNSLDKINDQLQDTQNALGAANAQLAGQNSISERAQAALTENVVRTQQINQQLANNDIGSALRKQYQIELQLIDLKNSYNQNLLKNNDQLSLLYQSRYDLLNLRLQVQQQNIIAIQEVINQKNLQQSQNQLEQAQQQQQKTVQNDYIQKELDRNAQLGQYLLQQTEKANSLTQDELRMRNILDSLTQTQHTIDEQISALQGTLVLSRIIQQQKQKLPTNLNIQGLSKQIADLRVHIFDITQKRNELYDLNNYINKVESEDGKQFTEAERTQVKTLLTERRKMTSDLIKSLNNQLNLAISLELTQQQITQISDQIQSKLEQQSFWVKSNNPINLDWIKMLPRALIEQFNGMLKKLGFPTNYDNLPYLLMYFLGLFIVGGAIFKFKNRIKQQLNKINREIHRLDTDSQWSTPLALLLTAFLTLSSTLXX

SEQ ID NO: 2345 - DNA, 252 bp, Haemophilus influenzae
  Name: NTH1301
atgattaggaaacttatgaaaacacctccattttttaccgtactttttgcctcggcaatgtttacccttagtgtttcacaaggggcattaggggcaaattcaacaaatgtattaccaacggagcaatcgcttaaagccgatttggctaacgctcaaaaaatgagtgagggggaagcaaaaaaatacgttgttagcagaattacaaacatcaattgttttattgcagcaaattcaagctcacaaaaagatcaa

SEQ ID NO: 2346 - protein, 84 aa, Haemophilus influenzae
  Name: NTH1301
MIRKLMKTPPFFTVLFASAMFTLSVSQGALGANSTNVLPTEQSLKADLANAQKMSEGEAKKYVVSRITNINCFIAANSSSQKDQ

SEQ ID NO: 2347 - DNA, 1356 bp, Haemophilus influenzae
  Name: NTH1302
atgtatccttggcaaaattttgctattcaacctgatttctcagataaaatcgctttacgtactacgcagagcgatgcgcttacttggatagaattaactacaaagattaaccaaacggtggcttttttacaaaaaaaaggcgtaaatgcggaaagtgcggttgcttttgtgggaaaaaattcagagaaaattttatttttatatctggcgacaattcagcttggcgcaaaagttttaggcatcaatcctgcttttccacaagaaaaaattgcagaattatgtgagttttatcaaattgatttttgtttttatgataaagatttgctgaatttgcaagaaattgatgcttttacacaaaaagctaatttttttcgtcctgcgacgatgacgctaacctctggttctacaggcttaccaaaagcagttgtgcataatgtccaagcgcatttggataatgcaaaaggggtatgtaacttaatgaagtttgattgtaatcaatcttggttactttcattacccttatatcacgtttcaggacaaggtattgtttggcgttggttatattgtggtgcacaattacatttcccaaaagatgatttttatgcttcattattagaaacgacccacgtttctcttgtgccaacgcaattacaacgtttgttagattatttacaggaaaattcgattatttcattttctacacgtcatattttacttggtggtacgcatattcctgctgaactcacgaaaaaaatagtgaaatatggtattgaaacttattctggctacggaatgacggaaatggcttcgacagtttttgccaaaaaatctgatgaaaaacaaggtgtggggcaaccgctcttaggcagagaatatcgcttagtaaatgatgaagtttggctgaaaggtgcgggtttggcgatgggttattggaaggatcgacaaattgtttcattaacgaataaccaaggttggcttccgacaaaagataaaggtgtttggcaagagggcgaacttgttattatcggacgacttgataatatgtttatttctggtggcgaaaatattcagccagaagaaattgaacaagtgattattcaacattcttcagttaatcaagtgtttgttttaccacaaaaaaacaaagaatttggtcagcgtcctgtcgctttagtggattttaatgaatcctttagcaaaagtgcggttgaaaatttaatgttttttttacaagataaactcgcacgttttaaacaacctattgcatattatcctttaccactgatgcttgggaaaggcattaagatctcacgtaaacagcttgccgattggctggcaaagcaagataagataaat

SEQ ID NO: 2348 - protein, 452 aa, Haemophilus influenzae
  Name: NTH1302
MYPWQNFAIQPDFSDKIALRTTQSDALTWIELTTKINQTVAFLQKKGVNAESAVAFVGKNSEKILFLYLATIQLGAKVLGINPAFPQEKIAELCEFYQIDFCFYDKDLLNLQEIDAFTQKANFFRPATMTLTSGSTGLPKAVVHNVQAHLDNAKGVCNLMKFDCNQSWLLSLPLYHVSGQGIVWRWLYCGAQLHFPKDDFYASLLETTHVSLVPTQLQRLLDYLQENSIISFSTRHILLGGTHIPAELTKKIVKYGIETYSGYGMTEMASTVFAKKSDEKQGVGQPLLGREYRLVNDEVWLKGAGLAMGYWKDRQIVSLTNNQGWLPTKDKGVWQEGELVIIGRLDNMFISGGENIQPEEIEQVIIQHSSVNQVFVLPQKNKEFGQRPVALVDFNESFSKSAVENLMFFLQDKLARFKQPIAYYPLPLMLGKGIKISRKQLADWLAKQDKIN

SEQ ID NO: 2349 - DNA, 603 bp, Haemophilus influenzae
  Name: NTH1303
atgaagatcattgaagtagatgaagaattataccaatatattgcgagccaaacccgctctattggggaaagtgcttcggatattttacgccgtttgcttagtttacctgtgcatacttcaagtgttgatgatttagttcttacttcagcagaaactaacaaatccgcagatcaaaagccagaacaggctattaatgtgaaagaagtaaatatcaaaacaacaaaaaagcaatcaataaccgcaattaatcagatagtagaaaaagtccaaactttattaaattcaactgaatttcaagaagaaagtaaggcggtggtgcgtttcttagcgattttacgtgtgctttatcgtacaaatcctgaaagttttgcgcaagcaacggaatctttacaaggacgtactcgagtttactttgcacgtgacgaagcgacattattaatggctggcaatcatacaaaaccaaaacaaattccagatacgccttattgggttattaccaatacaaatagtggacgaaaaatgttgatgctagaaggtgcaatgcaatctatggaattacctgaaacattgattgatgaagtgcgatcatatttcacggtaaat

SEQ ID NO: 2350 - protein, 201 aa, Haemophilus influenzae
  Name: NTH1303
MKIIEVDEELYQYIASQTRSIGESASDILRRLLSLPVHTSSVDDLVLTSAETNKSADQKPEQAINVKEVNIKTTKKQSITAINQIVEKVQTLLNSTEFQEESKAVVRFLAILRVLYRTNPESFAQATESLQGRTRVYFARDEATLLMAGNHTKPKQIPDTPYWVITNTNSGRKMLMLEGAMQSMELPETLIDEVRSYFTVN

SEQ ID NO: 2351 - DNA, 255 bp, Haemophilus influenzae
  Name: NTH1304
atgatcttcatttttatctctctgtttgctaaaatttttttcaattataacgacttctttacaaattctcacgtaaaaattatggcaaaatcattactcaattatcaatttcatcaagtaaaacaaacgattaatacacctgttttaatttttattcacggtttattcggcgatatggataatctcggcgttatcgcgagagcttttagtgaacattacagtattttacgtattgatttacgcaatcacggccca

SEQ ID NO: 2352 - protein, 85 aa, Haemophilus influenzae
  Name: NTH1304
MIFIFISLFAKIFFNYNDFFTNSHVKIMAKSLLNYQFHQVKQTINTPVLIFIHGLFGDMDNLGVIARAFSEHYSILRIDLRNHGP

SEQ ID NO: 2353 - DNA, 195 bp, Haemophilus influenzae
  n 182: n is any nucleotide
  Name: NTH1305
ttgatttacgcaatcacggcccatagttttcattcggaaaaaatgaattatcaactgatggctgaagatgttatcgcagtaatccgccacttaaatttatccaaagtgatattaattggtcattctatgggggaaaaaaccgcccatgaaaatcaccgcactttgcccagaattagtcgaanaattaatcgtaat

SEQ ID NO: 2354 - protein, 65 aa, Haemophilus influenzae
  Xaa 61: Xaa is any amino acid
  Name: NTH1305
LIYAITAHSFHSEKMNYQLMAEDVIAVIRHLNLSKVILIGHSMGEKTAHENHRTLPRISRXINRN

SEQ ID NO: 2355 - DNA, 432 bp, Haemophilus influenzae
  n 56, 237, 251: n is any nucleotide
  Name: NTH1306
atgtcccctatgctttatgagggatttggtcataaagatgtttttaatggcctatntgcggtaaaaaatgcaaagcctgaaaatcgtcagcaagccaaaccgattttaaaacaagaaattaatgatgaagacgttgtacaatttatgttgaaatcttttgatgttaattcagctgattgttttcgttttaatcttaccgcactttttaacaattatgccaatattatggattggganaaagtacgtgtatntacgccaactctttttattaagggtggaaattcctcttatataaaaatagaaaatagcgaaaaaattctagaacaatttcctaatgcaactgcctttacgattaatggcagtggacactgggttcacgccgaaaaacctgattttgttattcgtgcaattaaacgatttctaaataagaat

SEQ ID NO: 2356 - protein, 144 aa, Haemophilus influenzae
  Xaa 19, 79, 84: Xaa is any amino acid
  Name: NTH1306
MSPMLYEGFGHKDVFNGLXAVKNAKPENRQQAKPILKQEINDEDVVQFMLKSFDVNSADCFRFNLTALFNNYANIMDWXKVRVXTPTLFIKGGNSSYIKIENSEKILEQFPNATAFTINGSGHWVHAEKPDFVIRAIKRFLNKN

SEQ ID NO: 2357 - DNA, 123 bp, Haemophilus influenzae
  Name: NTH1307
ttgattgttttcaaacgtaaagactttctgctttattgttttgaaccaagtcacgcccgtgttgcaggacttttctccaaagttttacattatgggctgctaatattacttgctttaccattg

SEQ ID NO: 2358 - protein, 41 aa, Haemophilus influenzae
  Name: NTH1307
LIVFKRKDFLLYCFEPSHARVAGLFSKVLHYGLLILLALPL

SEQ ID NO: 2359 - DNA, 441 bp, Haemophilus influenzae
  Name: NTH1308
atgtttgattggcttttagaaccgctacaatttgagtttatgcaaaatgccttattgaccgcattgattgtttcgattatctgtgcgttactttcttgctatttagtcttgaaaggttggtcattaatgggtgatgcaatttctcacgctgtattacctggtattgtacttgcttatttggcaggaattcctttagccattggtgcatttttctcaggtattttttgttcgcttggtgtgggatatttgaaagaaaatagccgtataaaagaagatacagcaatgggtattgtattttctggaatgtttgctattggtttggttatgtttaccaaaattcaaacagaacagcatttaacccatattttgtttggtaatgtgttgggtgtaagtcatcaagagctgattcaaagtgcggtcatttctgcgatattttttgtt

SEQ ID NO: 2360 - protein, 147 aa, Haemophilus influenzae
  Name: NTH1308
MFDWLLEPLQFEFMQNALLTALIVSIICALLSCYLVLKGWSLMGDAISHAVLPGIVLAYLAGIPLAIGAFFSGIFCSLGVGYLKENSRIKEDTAMGIVFSGMFAIGLVMFTKIQTEQHLTHILFGNVLGVSHQELIQSAVISAIFFV

SEQ ID NO: 2361 - DNA, 846 bp, Haemophilus influenzae
  Name: NTH1309
atgttagatttattgctcgaacctttttcctatgattatatgctcaaggcgatgattttgagtaccgcagtgggtggcatttgtgcttttttgtcttcatatttaatgcttaaaggctggtctctaattggcgatgcgctttcccattctgtcgtgcccggtgttgcaattgcctatgcttttgcgttgccttacgcacttggtgcattttttgccggaattttagccgcactttccattctttggattaaatccatttctaaactgaaagaagatgctgtgataggttttattttcagtactttctttgcattaggtttgttaatcgtttctttaaatccaaccgcagtaaatgtgcaaaatatcattttaggtaatattttaggcattgccgatgacgatatttaccaagtcgcaattattatcggtgtttgtttagtattacttttattattttggaaagatttactactgatttttttcgatgaaacacaagcaagaacggtagggctttcgccattattttataaagttttattttttactttattaagtgcttgtgtggtcgctgcattacaaactgtgggggcgattttagtgattgcgatggttattacccctggtgcaacagcatatttactgacggataaattcaaaaccttgtcaatcatcgccattattttaggagcggtgacaagttttgttggtgtttatattagctattatttagatggtgccacaggcggtgtgattgtgacattgcaaacattattgtttttagtcgctttcttattttcaccaaaatatggcttattaactcgtaataaaaaggcggtagaaaatgtt

SEQ ID NO: 2362 - protein, 282 aa, Haemophilus influenzae
  Name: NTH1309
MLDLLLEPFSYDYMLKAMILSTAVGGICAFLSSYLMLKGWSLIGDALSHSVVPGVAIAYAFALPYALGAFFAGILAALSILWIKSISKLKEDAVIGFIFSTFFALGLLIVSLNPTAVNVQNIILGNILGIADDDIYQVAIIIGVCLVLLLLFWKDLLLIFFDETQARTVGLSPLFYKVLFFTLLSACVVAALQTVGAILVIAMVITPGATAYLLTDKFKTLSIIAIILGAVTSFVGVYISYYLDGATGGVIVTLQTLLFLVAFLFSPKYGLLTRNKKAVENV

SEQ ID NO: 2363 - DNA, 918 bp, Haemophilus influenzae
  Name: NTH1310
atggactctttctcgacatcaatttgggttaatgatgtaactgttcgttacaacaatggtcatactgctattcacaatatgacgttctcactcaatagtggaactatttgtgcgttagttggcgtgaatggaagtggcaagtccacattatttaaaagcataatggggcttgtaaagccacaacaaggcgaaattaaactttgtgatttgccaatttcccaagcactgaaacgtaatttggttgcttatgtaccacaatcagaagaagtggactggcaatttccagtatcagtgtatgatgtcgtgatgatgggacgctatgggtatatgaattttcttcgtatccccaaagcgattgataaacaaaaagttcaagaggcgatgcagcgagtaaatattgaacatcttgcgcatcgtcaaattggcgagttatctggcgggcagaaaaaacgcgtgtttttagcccgcgctttagcacaacaaagtcccattattttattagatgacccttttactggcgttgatgtgaaaactgaaaatgccattgttgatcttcttcaacagcttcgagaagaaggtcatcttattcttgtttcaacccataacttaggttctgttcctgatttttgtgatcaagtggtaatgattaatcgcacagttatcgccgcaggaaaaacagaaaacacctttaaccaacataatttggaaattgtatttggtggggtattacgtcatattaaattattgggcgaaaatttacataatgatgaagataaacgttctgttactgtcttaacagatgatgaaaaagccgttgtattctatggcgaaactaagcaagatccacctgcgccaacaacacaaaattgtcattttgaagattgtccttataaaagtgcggttaaaaataagagggat

SEQ ID NO: 2364 - protein, 306 aa, Haemophilus influenzae
  Name: NTH1310
MDSFSTSIWVNDVTVRYNNGHTAIHNMTFSLNSGTICALVGVNGSGKSTLFKSIMGLVKPQQGEIKLCDLPISQALKRNLVAYVPQSEEVDWQFPVSVYDVVMMGRYGYMNFLRIPKAIDKQKVQEAMQRVNIEHLAHRQIGELSGGQKKRVFLARALAQQSPIILLDDPFTGVDVKTENAIVDLLQQLREEGHLILVSTHNLGSVPDFCDQVVMINRTVIAAGKTENTFNQHNLEIVFGGVLRHIKLLGENLHNDEDKRSVTVLTDDEKAVVFYGETKQDPPAPTTQNCHFEDCPYKSAVKNKRD

SEQ ID NO: 2365 - DNA, 879 bp, Haemophilus influenzae
  Name: NTH1311
atgcgaaattcattcaaaattatgaccgcacttgcacttggtttatttgcaatgcaagctaacgcaaaatttaaagtcgtaaccacttttaccgtgattcaagatattgcgcaaaatgtggcaggcaatgcagcaacagtggaatctattaccaaaccaggtgctgaaattcacgaatatgaaccaacgccaaaagacattgtaaaagcacaatctgccgatttaattttatggaacggcttaaatttggaacgttggtttgagcgtttcttccaaaatgttaaagataaacctgctgtggtagtaacagaaggtattcaaccattatctatttatgaaggcccgtataaagatgcgcctaatccacacgcttggatgtcgccatctaatgctttaatttatattgaaaatattaagaatgcgttagtgaaatacgatccacaaaatgcagctgtgtatgaaaaaaatgccgctgactatgctcaaaaaattaaacaacttgatgaaccgcttcgtgcaaaattagcacaaattccagaagcgcaacgctggcttgtaacaagtgaaggtgctttcagttatttggcgaaagattacaacttaaaagaaggttatttatggccaatcaatgcagaacaacaaggcacaccacaacaagtgcgtaaagtgattgatttagttcgtaaaaacaatattccagttgtgtttagtgaaagtacaatttcagcgaaacctgcacaacaagtagctaaagaaagtggtgcaaaatacggtggcgtattgtacgttgattcactttctgcgaaaaacggccctgtgccaacttatattgatttgcttaacgtcactgtatcaaccattgttaaaggattcggaaaa

SEQ ID NO: 2366 - protein, 293 aa, Haemophilus influenzae
  Name: NTH1311
MRNSFKIMTALALGLFAMQANAKFKVVTTFTVIQDIAQNVAGNAATVESITKPGAEIHEYEPTPKDIVKAQSADLILWNGLNLERWFERFFQNVKDKPAVVVTEGIQPLSIYEGPYKDAPNPHAWMSPSNALIYIENIKNALVKYDPQNAAVYEKNAADYAQKIKQLDEPLRAKLAQIPEAQRWLVTSEGAFSYLAKDYNLKEGYLWPINAEQQGTPQQVRKVIDLVRKNNIPVVFSESTISAKPAQQVAKESGAKYGGVLYVDSLSAKNGPVPTYIDLLNVTVSTIVKGFGK

SEQ ID NO: 2367 - DNA, 462 bp, Haemophilus influenzae
  Name: NTH1313
atgaaaaaagcattttggttagtattaagttcagcaatagtcttggctgcttgtgatgataaacctaaaatgacggagcaaactaaaacaactgaccaagcgaaaatggctgcagaacaacctgatcaaaagcccgtattgatcaattataaacaaattgccttagacaaatcccagcaagcgattgatacagcgaaagtcgctcaagacaaatcagttcaagctaatgaagccgtgaaagtagcaatgcaaaaacaacaagaggctgaaattgcgctaagtcaaggtggcgaagaggctgaaaaattgtctaaacaaaaaatggacgaatctaatgcagctgcagaattagctttaaaattgtcggaagaatccaaagctgcttctgcactttcaatccaactttccaaagaagcggaagatgcggctaataaggcgaatcaacaagctcaagctgagaaa

SEQ ID NO: 2368 - protein, 154 aa, Haemophilus influenzae
  Name: NTH1313
MKKAFWLVLSSAIVLAACDDKPKMTEQTKTTDQAKMAAEQPDQKPVLINYKQIALDKSQQAIDTAKVAQDKSVQANEAVKVAMQKQQEAEIALSQGGEEAEKLSKQKMDESNAAAELALKLSEESKAASALSIQLSKEAEDAANKANQQAQAEK

SEQ ID NO: 2369 - DNA, 759 bp, Haemophilus influenzae
  n 3: n is any nucleotide
  Name: NTH1314
atncagcctattgcctctgtaacaaaattaatgacggctaatgtatttttagagaataataaaaatcctaattgtcgaatcgcaatcacaaaagaggatacggatcgaattaaaggtacaggaacaaaattacctaaaaatattcctatctcttgtaacgaattattgaaagcaatgcttgtccattctgataactatgctgcccacgcgctttctcgtgcagcgggaataagtcgtcgccaatttattaataaaatgaacgaaaaagcccatcaacttggtatgtattctactcgttttcacgatagttcagggttatctagctacaatatttccagcccgatggatttggttaaactcgctaaatattcattaaataaatcggacattaaacttttatctaatcttagtgcaacttatattcaagctgggaaacataaactttatattaaaaatactaataagttagtgcgtgatgaaatctttgatgcggcagtgaataaaacgggctacattcgagaatctggttataatctcgttttcattaataaacacctatgcaaaaatgcaactattggcgtaattagtttaaataacacttcctctgcgtatcgttctagttttactaaaagcaaattagaaaaattcggctgcacagcattaaatggaagaacaattcgtgatgtagctggagaagctcaatatgaagatggctatgatgaagtgggatttaatacgctaattcagaaattatcaaga

SEQ ID NO: 2370 - protein, 253 aa, Haemophilus influenzae
  Xaa 1: Xaa is any amino acid
  Name: NTH1314
XQPIASVTKLMTANVFLENNKNPNCRIAITKEDTDRIKGTGTKLPKNIPISCNELLKAMLVHSDNYAAHALSRAAGISRRQFINKMNEKAHQLGMYSTRFHDSSGLSSYNISSPMDLVKLAKYSLNKSDIKLLSNLSATYIQAGKHKLYIKNTNKLVRDEIFDAAVNKTGYIRESGYNLVFINKHLCKNATIGVISLNNTSSAYRSSFTKSKLEKFGCTALNGRTIRDVAGEAQYEDGYDEVGFNTLIQKLSR

SEQ ID NO: 2371 - DNA, 240 bp, Haemophilus influenzae
  n 13, 29, 30, 35, 45, 48, 50, 53, 54, 56, 57, 58, 59, 60, 61, 62, 63, 64, 65, 66, 67, 68, 69, 70, 71, 104, 120,121, 122, 123, 124, 125, 126, 168, 172, 173, 174, 175, 189, 190, 191, 192, 200, 207, 218, 223, 224, 226, 230, 235, 236, 237, 238, 239: n is any nucleotide
  Name: NTH1315
gtgggggaaaaanaccccccccacccccnnggggnaaggagaganaananaannannnnnnnnnnnnnnnntgtgttttttgggggggagaagccccccccccnaaaatggagggttttnnnnnnnggggggcccccccccccccctggtggggttgttttttttttncggnnnngggggggggggggnnnnaaccaagnnnnatnnnnnnngnggnntgttnntncttntgggnnnnnt

SEQ ID NO: 2372 - protein, 80 aa, Haemophilus influenzae
  Xaa 5, 10, 12, 15, 16, 17, 18, 19, 20, 21, 22, 23, 24, 35, 40, 41, 42, 56, 58, 59, 64, 67, 68, 69, 70, 71, 72, 73,75, 76, 77, 79, 80: Xaa is any amino acid
  Name: NTH1315
VGEKXPPHPXGXRRXXXXXXXXXXVFFGGEKPPPXKWRVXXXGGPPPPPGGVVFFXRXXGGGGXNQXXXXXXXVXXXGXX

SEQ ID NO: 2373 - DNA, 420 bp, Haemophilus influenzae
  n 12, 36, 37, 38, 39, 40, 41, 42, 64, 65, 66, 67, 68, 69, 77, 78, 79, 80, 81, 82, 83, 84, 85, 297, 299, 326, 350, 351, 372, 373, 375, 385: n is any nucleotide
  Name: NTH1316
gtggggggggtntttttcccccacccccccccccgnnnnnnnccctctaccgccaactatcttnnnnnntttttttnnnnnnnnnttttccccccccctaatttaatgggggggggtttaaacccccggggggattttctccccccccccttttgggggattaaaggcacaaaaaattttttcccccccccccggcgcgcgaaaaaaaaagcgcgggggaaaaaagggggccccccctttttaaaggggtcccaaaaatgtttaaaaagcctttttaatttatcttgtgtccttctntntgcggcacagtcttatggttggtggtntggattttaccccataatcgagtnnattggaaagctaatgcgcctnngnatagtatatncagcctattgcctctgtaacaaaattaatgacggc

SEQ ID NO: 2374 - protein, 140 aa, Haemophilus influenzae
  Xaa 13, 14, 22, 23, 26, 27, 28, 29, 100, 109, 117, 125, 129: Xaa is any amino acid
  Name: NTH1316
VGGVFFPHPPPRXXPSTANYLXXFFXXXXFPPPNLMGGGLNPRGDFLPPPFWGIKGTKNFFPPPRRAKKKARGKKGGPPFLKGSQKCLKSLFNLSCVLLXAAQSYGWWXGFYPIIEXIGKLMRLXIVYXAYCLCNKINDG

SEQ ID NO: 2375 - DNA, 123 bp, Haemophilus influenzae
  Name: NTH1318
atgaataaccaaatttccagacttaatcttgataaacctattgagccttttgaattaggtatttgcacccaaaaaagaaatctcgaacagcccctagtccgtgcattttgggcgatgttagaa

SEQ ID NO: 2376 - protein, 41 aa, Haemophilus influenzae
  Name: NTH1318
MNNQISRLNLDKPIEPFELGICTQKRNLEQPLVRAFWAMLE

SEQ ID NO: 2377 - DNA, 876 bp, Haemophilus influenzae
  Name: NTH1319
atgtttaaaggtattctcgtttcattattagcctcgtttttatttggctatatgtattatttttctacgttactaaaacctttgagtggcacagatattttcggttatcggatgatatttacttttccttttgtcctgttgtccgtcacattatttaaacaaaaagcagctttaattgaacgtttaaaacgcattcaaaaacgaccgcacttagcattgtcatatttactttgcggattattaatgggttttcaaatgtggctttttctttgggcaccgaataatggcagttcattaagtgtatcttttggttatttacttttaccaattgtaatggtggcggcaggtcgcgtgttttttaaagaacgcatttcaacattcaaatttattgccgttatcattgcaacattaggcgtaatttctaatattgtgctaaaaggcggtctttcttgggaagccattgttatctgtttaggttacaccgcatatttttctatccgaaaagcattaaaaaataccgatcttgcctccttttgtttagaaatgttaagccttatgcctgtcagtatttattttgctttacaaacagatttcgcgacagtacaacaaaccaatccgtttatttgggggctgcttgtattactaggattaatcagcggtactgcgttaattgcctatgtaatagccagtaatatgcttcctatgaatttactcggtctgcttggttatgttgaaactattatgatgctatgcgtatcatttttgatcggagaacaaattgatagcggaagctacccactttttatttgtttagttatcgcgatgattcttgttatggttgatggcgtttacaaacaacacgcaaaaggaagttta

SEQ ID NO: 2378 - protein, 292 aa, Haemophilus influenzae
  Name: NTH1319
MFKGILVSLLASFLFGYMYYFSTLLKPLSGTDIFGYRMIFTFPFVLLSVTLFKQKAALIERLKRIQKRPHLALSYLLCGLLMGFQMWLFLWAPNNGSSLSVSFGYLLLPIVMVAAGRVFFKERISTFKFIAVIIATLGVISNIVLKGGLSWEAIVICLGYTAYFSIRKALKNTDLASFCLEMLSLMPVSIYFALQTDFATVQQTNPFIWGLLVLLGLISGTALIAYVIASNMLPMNLLGLLGYVETIMMLCVSFLIGEQIDSGSYPLFICLVIAMILVMVDGVYKQHAKGSL

SEQ ID NO: 2379 - DNA, 315 bp, Haemophilus influenzae
  Name: NTH1320
atgtcatttaaagaaataactccacagcaagcttgggaaatgatgcaacaaggcgcaatattagtcgatattcgagataatatgcgctttgcttattcacatcctaaaggtgcttttcatttaacaaaccaaagttttttgcaatttgaagaactagcagattttgattcgcctattattgtgagttgttatcacggcgtgagcagtcgaaatgtagcgacttttctcgtggaacaaggctataaaaatgtatttagtatgattggcggatttgatggatggtgcagagcagaattgccgattgataccacttac

SEQ ID NO: 2380 - protein, 105 aa, Haemophilus influenzae
  Name: NTH1320
MSFKEITPQQAWEMMQQGAILVDIRDNMRFAYSHPKGAFHLTNQSFLQFEELADFDSPIIVSCYHGVSSRNVATFLVEQGYKNVFSMIGGFDGWCRAELPIDTTY

SEQ ID NO: 2381 - DNA, 789 bp, Haemophilus influenzae
  Name: NTH1321
atggcacgtcgtcctttagttatgggtaactggaaattaaacggtagcaaagcattcacgaaagaattaatcgagggattaaaagcggaattacatgatgtaacaggttgtgatgtagcaattgccccccccgttatgtatttaggtacggctgaagcagcactttctggttgtggttgcagctgtggcggtaaaagtgtgattcaattaggtgcacaaaacgtagatatcaatgtgaaaggtgcatttactggtgatatttctagcgaaatgttaaaagatttcggtgcaaaatatatcattattggccactctgaacgccgcacttatcataaagaaagcgacgaatttgtggcgaaaaaatttggtgcattaaaagaagctggtttagtgccagtattatgtattggtgaatctgaagcagaaaacgaagcaggcaaaacagaagaagtatgtgcgcgtcaaattgatgcagtcatcaatgcattaggcgtagaagcattcaacggtgcagtgatcgcatacgaaccaatctgggcaattggcacgggtaaatctgcaactccagcacaagcacaagccgttcatgcatttatccgtggtcacatcgcagcgaaatcacaagccgtggcagagcaagtaattattcaatacggcggttctgtaaatgatgcaaatgccgctgaattatttactcagccagacatcgatggtgcattagtgggtggcgcatcattaaaagcccctgcatttgcagtaattgttaaagcagcagctgcagcgaaaaac

SEQ ID NO: 2382 - protein, 263 aa, Haemophilus influenzae
  Name: NTH1321
MARRPLVMGNWKLNGSKAFTKELIEGLKAELHDVTGCDVAIAPPVMYLGTAEAALSGCGCSCGGKSVIQLGAQNVDINVKGAFTGDISSEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 2383 - DNA, 438 bp, Haemophilus influenzae
  Name: NTH1322
atgaaacttttcaaagctgaacaatggaatattgaagtgcttcttcctctttttgaagcctatcgccaagcctatgggcaagcagagaatccagaacgtaccttagcttttttaactaatcgtatgcgttttaatgaaagcctgttttttattgcggtggatgaaaatgaaaaggctattggctttgtgcagcttttccctcgcctttcttctttacaattgcaacgttattggcaaatcaccgatatttttgtgttggaacatgcgcaacaaacagaaatttatgcggcgttgatttctaaagcaaaagactttgtgcatttcacgcaatccaatcgtttagtggcagaattagcgcaaaatcaatattcaatgttggaatcggaagggtttaaattgaacccaaaagaacgtttatttgaattgagtttgtcatgc

SEQ ID NO: 2384 - protein, 146 aa, Haemophilus influenzae
  Name: NTH1322
MKLFKAEQWNIEVLLPLFEAYRQAYGQAENPERTLAFLTNRMRFNESLFFIAVDENEKAIGFVQLFPRLSSLQLQRYWQITDIFVLEHAQQTEIYAALISKAKDFVHFTQSNRLVAELAQNQYSMLESEGFKLNPKERLFELSLSC

SEQ ID NO: 2385 - DNA, 321 bp, Haemophilus influenzae
  n 316, 317, 318, 319, 320: n is any nucleotide
  Name: NTH1323
atgctaacagcgttaaatcgttattgggattatttgcggattgaacgccaaatgagtcctcacacaatcactaattatcaacatcagcttgatgccaccatcaaaatcttatcgcaccaagatattcattcttggacacaagtgacgcctagcgtggtgcgctttattttaccggaaagcaaaaacaagcttaaaagacaaaacttggtttgtgttaatccgcatacgtcaattttcagtttttatggcaccaggcgaattaataggaattctgcccaggcatttctgcccctaaacaggttgttttttacctacnnnnnt

SEQ ID NO: 2386 - protein, 107 aa, Haemophilus influenzae
  Xaa 106, 107: Xaa is any amino acid
  Name: NTH1323
MLTALNRYWDYLRIERQMSPHTITNYQHQLDATIKILSHQDIHSWTQVTPSVVRFILPESKNKLKRQNLVCVNPHTSIFSFYGTRRINRNSAQAFLPLNRLFFTYXX

SEQ ID NO: 2387 - DNA, 300 bp, Haemophilus influenzae
  Name: NTH1324
gtggaagaagcttctcgcaccgttgcacatatgcaggatgaagtaaccaatttccccgatcctgcagaccgagcaactcaagaagaggaatttagtctagaattacgtaatcgagatcgcgaacgtaaactaatgaaaaaaatcgaagcaaccttgaagaaacttgataccgatgattttggttactgcgattgttgtggtgaagaaatcggcattcgccgtttagaagcgcgcccaacagcagatctttgcattgattgcaaaactttagctgaaatccgcgaaaaacaagtcgctggt

SEQ ID NO: 2388 - protein, 100 aa, Haemophilus influenzae
  Name: NTH1324
VEEASRTVAHMQDEVTNFPDPADRATQEEEFSLELRNRDRERKLMKKIEATLKKLDTDDFGYCDCCGEEIGIRRLEARPTADLCIDCKTLAEIREKQVAG

SEQ ID NO: 2389 - DNA, 141 bp, Haemophilus influenzae
  Name: NTH1325
ttgcctttttctttacaagaaaagagccaagtcatttatttccaacaacaaaacggagtaaattattcttacttatatcaaaaatttgtttggcaagaagacaaaaaaatcaaaagaggttgccaaaacaagtgctcattc

SEQ ID NO: 2390 - protein, 47 aa, Haemophilus influenzae
  Name: NTH1325
LPFSLQEKSQVIYFQQQNGVNYSYLYQKFVWQEDKKIKRGCQNKCSF

SEQ ID NO: 2391 - DNA, 174 bp, Haemophilus influenzae
  Name: NTH1326
atgccaaaagcgcgagcaaaaaaatcggaacaaacacgtcgctatgataaaaatgtgattaaagcggctcaatttgatatttctccgagtgattttagccgtaatgctctcaatgtagtggaaaaactgcaacgtcaaggtttcgaggcttatatcgttcggtggatgtatccg

SEQ ID NO: 2392 - protein, 58 aa, Haemophilus influenzae
  Name: NTH1326
MPKARAKKSEQTRRYDKNVIKAAQFDISPSDFSRNALNVVEKLQRQGFEAYIVRWMYP

SEQ ID NO: 2393 - DNA, 1350 bp, Haemophilus influenzae
  Name: NTH1327
ttgatagcttggcgattacttggtgtttatatcgccactatcgttgggcttgtgcttaaaccttatggcgagcccgttatcttattggctgcaattgcggtttctggcgttatcatcggtaatactgaaggggcgaaagaattggttaaagtcggcaatatgttggatggttataaatctggcacaacatggcttatttttaccgcattcactttgagttcagcatttgtaatcacaggtctaggtaaacgtatcgcctatcatatgatcggcgcaatgggtagcacaaccctacgcttaggttatgttaccatgttcttagaccttttactctcgccagcaacgccctctaacaccgcgcgttcaggtgggattatctttccaatcattaatagcgtagtggttgctcttggttcagatccagaaaaaagcccgaaaaaagcagggcgttatttgatgatgaacgtatatatggtggttaaaactacctcttatattttcttaaccgcaatggctcctaatgccttagctctttcattaatggcaccaattcttggttttgaaaccacttggatcaaatggttcttagctgcatccgtacccggcttactctgcttattcttaattccgttaatttgttattgggtatctccaccagaattgaaaaaagtggataataaagccattgcgaaaaaaggcttagaagaattaggtccaatgtcttttcgtgaaaaagcactcagcgtgttattcgtaattgcattattcggctggattttctctaattcacttcatatcaatgctaccattgttgcaatcattgtaatggtgctttgtattgtattaagtatcgtcacctgggacgatatcttaaaaagcaaaggcgcatggaataccctagtatggtatggtggtatcatcggcatgtctggcttgcttgaaaaatctggctttttcaaatggttagcaaacaccttaagtaccatacttcagtttgagggacatggtatgatggcgttaatagtgattcttaccttaagtgtctctgtacgttatttatttgcatcaggcggtgcatatgtagctgcaatggtacccgtatttgcaacagtcggacatgtaacaggtgctcctactgaattgcttgctctaggcttagtctttgctaattcttatggtggttcagtaactcactacggaggcggaccaggtccaattgcattcggtgcaggttataatgatataaaatcttggtggattactggtgcgatcattgcttttggtagtttaattatccatctaactatcggtatggcatggtggaaattattaatgagtttaggctggtta

SEQ ID NO: 2394 - protein, 450 aa, Haemophilus influenzae
  Name: NTH1327
LIAWRLLGVYIATIVGLVLKPYGEPVILLAAIAVSGVIIGNTEGAKELVKVGNMLDGYKSGTTWLIFTAFTLSSAFVITGLGKRIAYHMIGAMGSTTLRLGYVTMFLDLLLSPATPSNTARSGGIIFPIINSVVVALGSDPEKSPKKAGRYLMMNVYMVVKTTSYIFLTAMAPNALALSLMAPILGFETTWIKWFLAASVPGLLCLFLIPLICYWVSPPELKKVDNKAIAKKGLEELGPMSFREKALSVLFVIALFGWIFSNSLHINATIVAIIVMVLCIVLSIVTWDDILKSKGAWNTLVWYGGIIGMSGLLEKSGFFKWLANTLSTILQFEGHGMMALIVILTLSVSVRYLFASGGAYVAAMVPVFATVGHVTGAPTELLALGLVFANSYGGSVTHYGGGPGPIAFGAGYNDIKSWWITGAIIAFGSLIIHLTIGMAWWKLLMSLGWL

SEQ ID NO: 2395 - DNA, 1422 bp, Haemophilus influenzae
  Name: NTH1328
atgactcaaaaattacatattaaaacttggggctgtcagatgaatgaatatgattcatctaaaatggccgatcttttattaagcactcacggattagaactcacggaagcacctgaagaagcagacgtattattattgaatacctgttctattcgtgaaaaagcacaagaaaaagtgtttcatcaacttgggcgttggaaagaattaaagaaaaataatccaaatttagtgattggcgtgggcggctgtgtggcttctcaagaaggggagcatattcgtcatcgcgcgccttatgtggatattatttttggcccacaaactttgcatcgtctgcctgaaatgattaatcaaattcgtggtggtaaaagttctgtggttgatgtgagtttccctgaaattgagaaatttgaccgcttacctgaacctcgcgcagaaggcccaactgcatttgtttccattatggaaggctgtaataaatactgtactttctgtgttgtgccttatactcgtggggaagaagttagtcgtcctgtagatgatgtgttatttgaaattgcgcaacttgcggaacaaggtgtgcgagaggttaatttgcttggtcaaaacgtgaatgcctatcgtgggccaacgcacgatggtcaaatttgtagctttgctgaactgcttcgtcttgtcgcatcaattgatggtattgaccgtttacgtttcacaaccagtcatccaatagaatttacaaatgatatcattgatgtgtatcgtgacacgcctgaattagtgagtttcttgcatcttccagtgcaagcaggatctgaccgtgtattaacgatgatgaaacgtggtcataccgcattagaatataaatctattattcgtaaacttcgtgcagtgcgtccagatattcaaatcagctctgactttattgttggtttcccaggggaaactgcggaagattttgagcagactatgaatttgattgcacaagtgaactttgatatgagcttcagttttgtgtattctgcccgaccaggtacgcctgctgcagatatgccagatgatgtgacggaagatgaaaagaaacagcgtctttatgtgctacaagagcgtattaatcaacaagccgcacaatttagtcgtcgtatgcttggcacagagcagcgcgtgttagttgaagggccatcgaagaaggatattatggaattaacaggacgcactgaaacaaatcgtattgttaatttccaaggttctccagaaatgatcggtaagtttgtggatgtaaaaattactgatgtttatactaattcgttacgtggcgaagtggtgcgtactgaagatgaaatgggattacgtattgcacaatcgccacaagaagtgatgaatcgcacacgtaaagaagatgaattaggcgtagggcgttatcacggc

SEQ ID NO: 2396 - protein, 474 aa, Haemophilus influenzae
  Name: NTH1328
MTQKLHIKTWGCQMNEYDSSKMADLLLSTHGLELTEAPEEADVLLLNTCSIREKAQEKVFHQLGRWKELKKNNPNLVIGVGGCVASQEGEHIRHRAPYVDIIFGPQTLHRLPEMINQIRGGKSSVVDVSFPEIEKFDRLPEPRAEGPTAFVSIMEGCNKYCTFCVVPYTRGEEVSRPVDDVLFEIAQLAEQGVREVNLLGQNVNAYRGPTHDGQICSFAELLRLVASIDGIDRLRFTTSHPIEFTNDIIDVYRDTPELVSFLHLPVQAGSDRVLTMMKRGHTALEYKSIIRKLRAVRPDIQISSDFIVGFPGETAEDFEQTMNLIAQVNFDMSFSFVYSARPGTPAADMPDDVTEDEKKQRLYVLQERINQQAAQFSRRMLGTEQRVLVEGPSKKDIMELTGRTETNRIVNFQGSPEMIGKFVDVKITDVYTNSLRGEVVRTEDEMGLRIAQSPQEVMNRTRKEDELGVGRYHG

SEQ ID NO: 2397 - DNA, 174 bp, Haemophilus influenzae
  Name: NTH1330
gtgcggttattttttagagatatatggtttagatttgccaatcaattggtttcattccattactttccaaatatgaatttgttttggaaaaatgatgacagccaaaaaaacctcgatgggctgaaagtggggaagggtgcggagccgttaaaacaaggtgacgagtgcggtcaa

SEQ ID NO: 2398 - protein, 58 aa, Haemophilus influenzae
  Name: NTH1330
VRLFFRDIWFRFANQLVSFHYFPNMNLFWKNDDSQKNLDGLKVGKGAEPLKQGDECGQ

SEQ ID NO: 2399 - DNA, 393 bp, Haemophilus influenzae
  Name: NTH1331
atgtataaagaactcacacaaaatatttcgggatttcaaatgccatcaaatggttatttagtcaaatgggcagagcaaggggtattgctacttaacacagtgcttaccgtggaacgaggtatggcacattcacacgccaatttaggttgggaaaggtttacagataaagttattgcagtgcttaatgaacatcgtgaaaaactggtgtttttactttggggcagtcacgcacaaaaaaaaggacaaattattgaccgcactcgtcaccttgttttaacggctccgcacccttccccactttcagcccatcgaggtttttttggctgtcatcatttttccaaaacaaattcatatttggaaagtaatggaatgaaaccaattgattggcaaatc

SEQ ID NO: 2400 - protein, 131 aa, Haemophilus influenzae
  Name: NTH1331
MYKELTQNISGFQMPSNGYLVKWAEQGVLLLNTVLTVERGMAHSHANLGWERFTDKVIAVLNEHREKLVFLLWGSHAQKKGQIIDRTRHLVLTAPHPSPLSAHRGFFGCHHFSKTNSYLESNGMKPIDWQI

SEQ ID NO: 2401 - DNA, 372 bp, Haemophilus influenzae
  Name: NTH1332
gtgggtgcagaaacaatgttacggatagccctcgcaattcaattcctttctggaatgtggctaattttgaccgcacttttagatcttggtttttggccaatggcaattggcgtcgcctttttcgtcggtccaaacccagtgatttcatcaaatgcaatggcatcagctttagaaaaatgtcctcaaatggcgggaacaacaaattctttgattggtagcgtacgttttgcagtgggtgcaattatgggaagtttagtcgcgtcaatgaaaatggatactgccgcaccaatgctctttactatgggggcatgtgtcgtgatttccgtgttggcgtattactttctaaccagccgaaatcttaaaagccgtggg

SEQ ID NO: 2402 - protein, 124 aa, Haemophilus influenzae
  Name: NTH1332
VGAETMLRIALAIQFLSGMWLILTALLDLGFWPMAIGVAFFVGPNPVISSNAMASALEKCPQMAGTTNSLIGSVRFAVGAIMGSLVASMKMDTAAPMLFTMGACVVISVLAYYFLTSRNLKSRG

SEQ ID NO: 2403 - DNA, 99 bp, Haemophilus influenzae
  Name: NTH1333
ttgctgtttgcttgccgttatggatggtttttgtttaataaagaaaacaatcattgcgccgtggggaatttacccacggcttttaagatttcggctggt

SEQ ID NO: 2404 - protein, 33 aa, Haemophilus influenzae
  Name: NTH1333
LLFACRYGWFLFNKENNHCAVGNLPTAFKISAG

SEQ ID NO: 2405 - DNA, 798 bp, Haemophilus influenzae
  Name: NTH1334
atgtcagaacaatcttctaaatatatcgcagcattgcttgcggtattatcgatctcaatggtgcttggcatcgatctatttattttttctttgcaatctgaaaagcaaacaatgcctcatttaggtgtaggcgtgttggttgcacagttaatttcgttgttggtgttttatcgcggcgaaatttgcccaggacaacgtggtcgtttaatcaaagtgaatatgacttttgctatttattgggcagtgtggttgctgataagcctattacaaaataatcacacgcttactaacgtaatgagcgtatgtggtctttctgtcgtgtattttatttggaaacaacccaaaactgaaaaaattcgtaacagctttttattgatggctgcattaattgcgggtttaggttgcttgagttatttaatgatttttaccgtgcttcctgcgagtgattttgctgaatataacccttttgcaccaattttatctggcgtgattttagcaaatcttgcgcttgttattgcacgaaatcgtttacaaggttttatagcattgttgcccttagcaatgattatattgcttgctctaaatgctttggcaatgtttttatttttacttttaaatggtatggaaagtgcggttaattctgacagtgtttttgcctacatcatttattttgtttgccattttgtgattgcggctattctgattctgcatagtttccaaaagtggatattatctaccaatagtttatttatcctattatttattgctgtttgcttgccgttatggatggtttttgtt

SEQ ID NO: 2406 - protein, 266 aa, Haemophilus influenzae
  Name: NTH1334
MSEQSSKYIAALLAVLSISMVLGIDLFIFSLQSEKQTMPHLGVGVLVAQLISLLVFYRGEICPGQRGRLIKVNMTFAIYWAVWLLISLLQNNHTLTNVMSVCGLSVVYFIWKQPKTEKIRNSFLLMAALIAGLGCLSYLMIFTVLPASDFAEYNPFAPILSGVILANLALVIARNRLQGFIALLPLAMIILLALNALAMFLFLLLNGMESAVNSDSVFAYIIYFVCHFVIAAILILHSFQKWILSTNSLFILLFIAVCLPLWMVFV

SEQ ID NO: 2407 - DNA, 606 bp, Haemophilus influenzae
  Name: NTH1336
atgttacttagtattttatatatcatcggtatcaccgctgaaggaatgacaggcgcacttgcggcaggtcgtgagaaaatggatatttttggcgtgatcattatcgcatctgtgactgccattggtggcggctctgtgcgtgatgtactgctcggacattaccctctcggctgggttaagcacccagaatattttttaatggtggcaagtgcggcggtaattaccgtatatgttgcaccatttatcaatcattttatgcgctactttcgcactattttcttggtgcttgatgcgatgggcttagtggtgtattccattattggcgcacaaattgcaatggatatgggacatagccttaccattgtttgtattgcaggctgtattactggtgcctttggcggggttctacgcgatatgctatgcaatcgaattcctctcgtgttccaaaaagaactctatgccagcattgcgctatttgccacgctgacttattacgcattaagtacacttcaagtagaacatacacttgccgtgttactcacacttattagcagctttactttacgccttttagctattcatttcgaatgggggttgcccggtgtt

SEQ ID NO: 2408 - protein, 202 aa, Haemophilus influenzae
  Name: NTH1336
MLLSILYIIGITAEGMTGALAAGREKMDIFGVIIIASVTAIGGGSVRDVLLGHYPLGWVKHPEYFLMVASAAVITVYVAPFINHFMRYFRTIFLVLDAMGLVVYSIIGAQIAMDMGHSLTIVCIAGCITGAFGGVLRDMLCNRIPLVFQKELYASIALFATLTYYALSTLQVEHTLAVLLTLISSFTLRLLAIHFEWGLPGV

SEQ ID NO: 2409 - DNA, 90 bp, Haemophilus influenzae
  Name: NTH1337
ttggcttgtttacccatttgttctaacatagttattccctttatggaatttattcctttttatttggcagcttatcttgttcttccgatg

SEQ ID NO: 2410 - protein, 30 aa, Haemophilus influenzae
  Name: NTH1337
LACLPICSNIVIPFMEFIPFYLAAYLVLPM

SEQ ID NO: 2411 - DNA, 150 bp, Haemophilus influenzae
  Name: NTH1338
atgttagaacaaatgggtaaacaagccaaagatgctgcattatcttggctcacttcaccactgctgaaaaaaattgtgcattatccattattgcagaaccacttccaacaacaagcaccgcttatcttagccgaaaacgcaaaaagatat

SEQ ID NO: 2412 - protein, 50 aa, Haemophilus influenzae
  Name: NTH1338
MLEQMGKQAKDAALSWLTSPLLKKIVHYPLLQNHFQQQAPLILAENAKRY

SEQ ID NO: 2413 - DNA, 141 bp, Haemophilus influenzae
  Name: NTH1339
ttggctcacttcaccactgctgaaaaaaattgtgcattatccattattgcagaaccacttccaacaacaagcaccgcttatcttagccgaaaacgcaaaaagatattgaacttgctaaacaaaatggattatcggatgcct

SEQ ID NO: 2414 - protein, 47 aa, Haemophilus influenzae
  Name: NTH1339
LAHFTTAEKNCALSIIAEPLPTTSTAYLSRKRKKILNLLNKMDYRMP

SEQ ID NO: 2415 - DNA, 117 bp, Haemophilus influenzae
  Name: NTH1340
ttgattgatcgcttactgctcacacaagaacgtttacaaagcattgctaatgatgtacgccacgttatttctctagcagatccccgtggggaaaatcatagacggcggtacattgga

SEQ ID NO: 2416 - protein, 39 aa, Haemophilus influenzae
  Name: NTH1340
LIDRLLLTQERLQSIANDVRHVISLADPRGENHRRRYIG

SEQ ID NO: 2417 - DNA, 957 bp, Haemophilus influenzae
  Name: NTH1341
ttggatagcggacttaaaattgaacgcgtacgcactccgctcggcgtcattggtacaatttatgaagctcgcccaaatgtgaccattgatgtggcaagtctttgccttaaaactggcaatgcggtgattttacgcggcggtaaagaaacacaattttctaacaagattttaatcgaagttgtacaaaatgctttagagcaagcaggcttaccaaaatttgcggtgcaagccattaccgatccaaaccgtgaactcgttatgcaattattaaaactggatcgctatgtggatatgattattcctcgtggtggttcgggtttacatgaattgtgtaaacaacattcgactattcctgttattgtgggtggtgtgggtgtttgtcatactttcgttgaaaaaagtgcggatcaaaataaagcgatttttgttattgataacgccaaaacccaacgtccaagcacctgtaacacattggaaacattgttagttcaacattctattgctgaagaatttttaccaaaactcgtctctcacctcgctaccaaaaacgtaaaatatcacgcaaaatccaccgcacttaatatattgaaacaagcaggtgcgaatgtctgcgaagtgacagaaaaagaattgcgaaaagaatggggatcattggatttgaatgtggttgttgtggaagatattcatgccgctattgagcatattcgccaatatggtacgcaacattctgaaagtattttaacttcctcacaaaacctagcacgtcaatttatcaatcaagttgatgcggcagccgtttatgtgaatgcaagtacacgctttactgatggcggacaatttggattaggcgcagaagttgccgtgagtacccaaaaacttcatgctcgtggccctatggggttagaagcattaacaagttataaatgggtttgtgaaggcgaatacaccgttcgcaaa

SEQ ID NO: 2418 - protein, 319 aa, Haemophilus influenzae
  Name: NTH1341
LDSGLKIERVRTPLGVIGTIYEARPNVTIDVASLCLKTGNAVILRGGKETQFSNKILIEVVQNALEQAGLPKFAVQAITDPNRELVMQLLKLDRYVDMIIPRGGSGLHELCKQHSTIPVIVGGVGVCHTFVEKSADQNKAIFVIDNAKTQRPSTCNTLETLLVQHSIAEEFLPKLVSHLATKNVKYHAKSTALNILKQAGANVCEVTEKELRKEWGSLDLNVVVVEDIHAAIEHIRQYGTQHSESILTSSQNLARQFINQVDAAAVYVNASTRFTDGGQFGLGAEVAVSTQKLHARGPMGLEALTSYKWVCEGEYTVRK

SEQ ID NO: 2419 - DNA, 297 bp, Haemophilus influenzae
  Name: NTH1342
gtgaaggcgaatacaccgttcgcaaataaaacccaaagtgcggtaatttttagaagagattatttgcatataaaaaagtccgcgaaatgcggactttttcattatctttatttgtcagatttacccaagttatcaaagaattttttcacaccgtctaaaaatcctgaagattttggtgcgtgtttacttaaatctttaccttgtaaactttcctcaagtttgtggagtaattctttttgttcgctggttaaattaacgggcgtttctaccacgatacggcaaattaaatcgcccgca

SEQ ID NO: 2420 - protein, 99 aa, Haemophilus influenzae
  Name: NTH1342
VKANTPFANKTQSAVIFRRDYLHIKKSAKCGLFHYLYLSDLPKLSKNFFTPSKNPEDFGACLLKSLPCKLSSSLWSNSFCSLVKLTGVSTTIRQIKSPA

SEQ ID NO: 2421 - DNA, 294 bp, Haemophilus influenzae
  Name: NTH1343
gtgccgaccttagatggcagagtgaaacttaaaatccctgctgaaacgcaaacaggaaaattattccgcatgcgaggaaaaggtgttgcttctacacgtagtggttatgcgggcgatttaatttgccgtatcgtggtagaaacgcccgttaatttaaccagcgaacaaaaagaattactccacaaacttgaggaaagtttacaaggtaaagatttaagtaaacacgcaccaaaatcttcaggatttttagacggtgtgaaaaaattctttgataacttgggtaaatctgacaaa

SEQ ID NO: 2422 - protein, 98 aa, Haemophilus influenzae
  Name: NTH1343
VPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 2423 - DNA, 399 bp, Haemophilus influenzae
  Name: NTH1344
gtgcaagaagaggaaggcacagtacgtattagccgtgccacaccagtcgttgctccagcagccgttcaatatgctgctgcaccagtagtagcaccgactcctgccgctgcgccagctcaagcaccagcagctgcgacaccagcaccagccgcatccgatgaattatcaggtcatcttgtacgttctccaatggtgggaacgttctatcgcagtccaagtcctgaagcaaaagcatttgttgaagtgggtcagtctgtgaaagttggcgacgcgctttgtatcgttgaagcaatgaaaatgatgaatcgcattgaagcggacaaggctggcgtagtaaaagcaattcttatcaacgacggtgacgctgttgaatttgacgaaccattaatcgttattgaa

SEQ ID NO: 2424 - protein, 133 aa, Haemophilus influenzae
  Name: NTH1344
VQEEEGTVRISRATPVVAPAAVQYAAAPVVAPTPAAAPAQAPAAATPAPAASDELSGHLVRSPMVGTFYRSPSPEAKAFVEVGQSVKVGDALCIVEAMKMMNRIEADKAGVVKAILINDGDAVEFDEPLIVIE

SEQ ID NO: 2425 - DNA, 1329 bp, Haemophilus influenzae
  Name: NTH1345
gtgattgctaatcgtggtgaaattgcactacgcattttacgtgcttgtaaagaattaggtattaaaactgtggcggttcactctaccgctgatcgtgatttaaaacacgttttacttgctgatgaaaccgtttgtatcggtccagcaccttccgcaaaaagttatttaaatattccagctatcattgctgccgccgaagtcacaggtgcggatgcaattcatccaggatatggttttttatctgaaaatgctgattttgctgaacaagttgaacgttcaggtttcactttcattggcccaacagcagatgtcatccgtttaatgggtgataaagtttcagctattaaagcgatgaaaaaagcaggcgtgccttgtgtacctggttctgatggccctgtaggtaatgatattgctaaaaataaagaaatcgccaaacgtattggctatccaatcatcatcaaagcatctggcggtggtggtggccgaggtatgcgtgttgtacgtagcgaagacgcattagaagaatctattgcgatgacaaaagcagaagcgaaagctgcattcaacaatgatatggtctatatggaaaaatacttagaaaacccacgtcacgtggaaattcaagtgttatcagatactcacggtaatgcagtttatttggctgaacgtgactgctcaatgcagcgtcgtcaccaaaaagtggtggaagaagcaccagctccaggtattacagaagaagtacgccgtgatattggctcacgctgtgcaaaagcttgcgtagaaatcggctctcgtggagctggaacctttgaattcttatatgaaaatggtgaattctatttcattgaaatgaatacgcgtatccaagtagaacaccctgtaactgaaatgattacaggtgtagatttagtgaaagagcaattacgtattgcagcaggcttaccgatttcctttaaacaagaagacatcaaagttaagggacacgcaatggaatgccgtattaacgcagaagatccaaaaacattcttaccgtctccaggtaaaataaatcacttacattctccgggtggtttgggcgttcgttgggattctcacgtgtacggtggttatactgtgcctccacattacgactctatgatcgcaaaacttatcacttatggcgatacgcgtgaaattgcaatccgtcgtatgcaaaatgccttatctgaaacaattattgatggtataaaaaccaatatcccacttcatgaattaattcttgaagatgaaaatttccaaaaaggcggaacaaacatccactatttggagaaaaaattaggtatgaatgaa

SEQ ID NO: 2426 - protein, 443 aa, Haemophilus influenzae
  Name: NTH1345
VIANRGEIALRILRACKELGIKTVAVHSTADRDLKHVLLADETVCIGPAPSAKSYLNIPAIIAAAEVTGADAIHPGYGFLSENADFAEQVERSGFTFIGPTADVIRLMGDKVSAIKAMKKAGVPCVPGSDGPVGNDIAKNKEIAKRIGYPIIIKASGGGGGRGMRVVRSEDALEESIAMTKAEAKAAFNNDMVYMEKYLENPRHVEIQVLSDTHGNAVYLAERDCSMQRRHQKVVEEAPAPGITEEVRRDIGSRCAKACVEIGSRGAGTFEFLYENGEFYFIEMNTRIQVEHPVTEMITGVDLVKEQLRIAAGLPISFKQEDIKVKGHAMECRINAEDPKTFLPSPGKINHLHSPGGLGVRWDSHVYGGYTVPPHYDSMIAKLITYGDTREIAIRRMQNALSETIIDGIKTNIPLHELILEDENFQKGGTNIHYLEKKLGMNE

SEQ ID NO: 2427 - DNA, 255 bp, Haemophilus influenzae
  Name: NTH1346
atgacattaaagcaacgttatcaacaagctggtaaagaagccagttgggcattaggcctatctattttatatgtgataggttggtgcttatgtgcttatttacccaaagaaacccaagggccgattggtttccctctctggtttgaactttcttgtatttacttacctattttattcatcgtgattggttattggattatcaaaattatttttcaggatatttctcttgaaattaacgatcaggagagtcagaaa

SEQ ID NO: 2428 - protein, 85 aa, Haemophilus influenzae
  Name: NTH1346
MTLKQRYQQAGKEASWALGLSILYVIGWCLCAYLPKETQGPIGFPLWFELSCIYLPILFIVIGYWIIKIIFQDISLEINDQESQK

SEQ ID NO: 2429 - DNA, 960 bp, Haemophilus influenzae
  Name: NTH1348
ttgggcggtgcgcgtttattagaaacaaccatcggcatttcttatactcaagcattactcttatttgctttaacggtaggtatctatacatttatcgggggcttccgtgctgtcgtactgacggataccattcaaggtaccgttatgatttttggaactataattctccttgttggcacgatttatgccctcggtggtgtagaaagtgcggtcaataaattgactgaaattgatcctgacttagtcacgccttacgggccaaatggaatgttagattttcaatttatggcttctttctggatactcgtttgtttcggggtggttggtcttccacataccgcagttcgatgtatggcatttaaagacagtaaagccttacatcgcggcatgctgattggaacaattgtactttctataattatgttaggtatgcatttagctggtgcgcttggcagagcggttattccaaatttaacggtatcggatcaagtaattccaactttaatgttaaaagtattgccgcctattgttgcagggattttcttagctgcgccgatgtctgcaattatgtctacaattgatgcgcaacttattcaatcatcttctatttttgtaaaagatttatacctttctacgaaaccagaagccgcaaaaaatgagaaaaaagtgagttatttttcatcaattattacgctaattttgaccgcacttttaatctttgccgcactcaatccaccagatatgattatttggttaaacctatttgcctttggcggactggaagccgcatttttgtgggtaattgtgcttggtatttactgggataaagcaaatgcttatggtgcgttaagctcaatgattatcggcttgggaagttatatcttactcactcaacttggcgtcaaattatttaacttccatcaaatcgtaccatcattagcatttggattgatcgctttt

SEQ ID NO: 2430 - protein, 320 aa, Haemophilus influenzae
  Name: NTH1348
LGGARLLETTIGISYTQALLLFALTVGIYTFIGGFRAVVLTDTIQGTVMIFGTIILLVGTIYALGGVESAVNKLTEIDPDLVTPYGPNGMLDFQFMASFWILVCFGVVGLPHTAVRCMAFKDSKALHRGMLIGTIVLSIIMLGMHLAGALGRAVIPNLTVSDQVIPTLMLKVLPPIVAGIFLAAPMSAIMSTIDAQLIQSSSIFVKDLYLSTKPEAAKNEKKVSYFSSIITLILTALLIFAALNPPDMIIWLNLFAFGGLEAAFLWVIVLGIYWDKANAYGALSSMIIGLGSYILLTQLGVKLFNFHQIVPSLAFGLIAF

SEQ ID NO: 2431 - DNA, 1479 bp, Haemophilus influenzae
  n 1479: n is any nucleotide
  Name: NTH1349
atgttctttggtaaaagccgagccaaaatgttgaatcaagatcagattaaggtgacttttgcggatgtggctggttgcgatgaagcaaaagaagaagtgggcgaaatcgttgatttcttgcgtgatccgaataaattccaaaatttgggcggtaaaattccaaaaggtattttgatggtagggcctccaggtactggtaaaactttacttgctcgtgcgattgcgggagaggcaaaagttccattcttcactatttctggctctgatttcgtagaaatgtttgtaggtgttggcgcatcacgtgtacgtgatatgtttgaacaggctaagaaaaatgcaccttgcttaatcttcattgatgaaatcgatgcagtgggtcgccaacgtggtgcgggcttaggcggcggacacgatgagcgtgaacaaaccttaaaccaaatgctagttgaaatggatggctttagcggtaatgacggcgtaattgttattgcggcaactaaccgtccagatgtacttgatccagctttaactcgtccaggccgttttgaccggcaagtagttgttggcttacctgatgtgaaaggtcgtgagcaaatcttaaaagtgcatatgcgtaaagtgtctgttgcacaagatgttgatgcaatgacgttagcgcgtggtacgccgggctattctggtgcagatttagcaaatttagtcaatgaggcggctttgtttgctgctcgagtgaataaacgtacggtaaccatgcttgagtttgaaaaagcgaaagataaaatcaatatggggccagagcgtcgcactatgattatgacggataagcaaaaagaatccactgcttatcatgaagctggtcatgcgattgtggggtatttagtacctgagcatgatcctgtacataaagtgacgattattcctcgaggacgtgcgttgggtgtgacattcttcttacctgaaggtgatcaaattagtattagccaaaaacaattagaaagtaagctttctaccttgtatgcagggcgtttagcggaagatttgatttatggtgaagaaaatatctcaacaggtgcatcaaatgatattaaagtcgcaactaatatcgcgcgtaatatggtgacgcaatggggattctctgaaaagttaggtccgattctttatacagaagatgagggcgaggttttcttaggtcgttcaatggcgaaagcgaaacatatgtcagatgaaaccgctcatgcaattgatgaagaagtgcgtgcaattgtaaatcgcaactatgcgagagcaagagagattttgatcgacaatatggatattcttcatgcgatgaaagatgcattagtcaaatatgaaactattgaagaagaacaaattaaacaattgatgaatcgcgaacctgtcacaccgccatcaggttggggagagccgaaaactcagcaggctgcttatgcaaattcaacaacgaatgatacaaagccn

SEQ ID NO: 2432 - protein, 493 aa, Haemophilus influenzae
  Name: NTH1349
MFFGKSRAKMLNQDQIKVTFADVAGCDEAKEEVGEIVDFLRDPNKFQNLGGKIPKGILMVGPPGTGKTLLARAIAGEAKVPFFTISGSDFVEMFVGVGASRVRDMFEQAKKNAPCLIFIDEIDAVGRQRGAGLGGGHDEREQTLNQMLVEMDGFSGNDGVIVIAATNRPDVLDPALTRPGRFDRQVVVGLPDVKGREQILKVHMRKVSVAQDVDAMTLARGTPGYSGADLANLVNEAALFAARVNKRTVTMLEFEKAKDKINMGPERRTMIMTDKQKESTAYHEAGHAIVGYLVPEHDPVHKVTIIPRGRALGVTFFLPEGDQISISQKQLESKLSTLYAGRLAEDLIYGEENISTGASNDIKVATNIARNMVTQWGFSEKLGPILYTEDEGEVFLGRSMAKAKHMSDETAHAIDEEVRAIVNRNYARAREILIDNMDILHAMKDALVKYETIEEEQIKQLMNREPVTPPSGWGEPKTQQAAYANSTTNDTKP

SEQ ID NO: 2433 - DNA, 603 bp, Haemophilus influenzae
  Name: NTH1351
ttgcatcgtgttgtgccagtagtgaaggcggtgcgaagccgttttgattgctggatttctgtcgattcttcaaaagcagttgtgatgcgtgaagcagcaagtgttggaatggatttgattaatgatattcgtgctttgcaagagccaaatgcgttagaaaccgcagtaaaactagctttacctgtttgtatcatgcatatgcaagggcaacctagaacgatgcaggcaaatcctcattatgagaatgtcgtacaagatgtattcgcttttttacagaaacgtactaatgaatgtctttctgctggtgttaaaaaagaaaacttaatttgggacatgggattttgttttggtaagtctgtacagcataattatcaattattacaaaatctgaatgaattttgtcatagtggatatcctgtgttagcgggattatctcgcaaatcaatgattggtgcggtgcttgataaacccgtcgatcagagagtgataggtagtgcggcaggtgcgcttattgcagcgcaaaaaggtgcaaaaattttacgcgtacatgatgttgctgcaacatcagatatgctcaaagtttggcaggcaacagaaaatgcc

SEQ ID NO: 2434 - protein, 201 aa, Haemophilus influenzae
  Name: NTH1351
LHRVVPVVKAVRSRFDCWISVDSSKAVVMREAASVGMDLINDIRALQEPNALETAVKLALPVCIMHMQGQPRTMQANPHYENVVQDVFAFLQKRTNECLSAGVKKENLIWDMGFCFGKSVQHNYQLLQNLNEFCHSGYPVLAGLSRKSMIGAVLDKPVDQRVIGSAAGALIAAQKGAKILRVHDVAATSDMLKVWQATENA

SEQ ID NO: 2435 - DNA, 1335 bp, Haemophilus influenzae
  Name: NTH1352
atggcaaatcgtaaatattttggaacagatggtgtacgtggaaaagtaggtagttatccaattacaccagatttcgcattaaaattaggctgggctgcgggaaaagtattggcttctcaaggttctaaaatggttttaatcggtaaagacacccgaatttctggatatatgttggaatcagcccttgaagcaggtttggctgctgcgggtttatctgctgcatttactggccctatgcctacacctgctattgcttatttgaccagaacttttcgtgctgaagcgggtatcgtgatctcagcctctcataatccttattatgataatggcattaaattcttttcagcaaaaggcactaaattgcctgatgaaattgaagaagccattgaagcgatgttagagcaaccgatggattgtgtggaatctgccgaattaggtaaagcaagccgtattaatgacgcagcaggacgctacattgagttttgtaaaggtacatttccagcacacttaggcttggaaggttataagatcgtggtagattgtgcaaatggggcgacttatcatattgcacctaacgtattgagagagcttggtgcggaagtcattgaaattggtacagatccaaatggtttgaatattaatgaaaaatgtggtgcaactgatgtgacagcattgcaagctaaagtagttgaaacgaaagctgatgttggtttggcttatgatggcgatggtgaccgcattatgatggtcgatcatttaggaaataaagtcgatggcgaccaaattctctttattattgcacgtgaagcattgcgctcaggtcaattaaaaggcggtgtcgttggcaccttaatgagtaatatgagcttagagattgcgttgaaaatgcttggtgttcccttcttacgtgcaaatgtgggagaccgttatgtattggaaaaaatgcttgaaaatgattggacgcttgggggggagaattctggacatattatcattgcggataagaatacaactggcgatggcattgttgcgtcattggctgtattggcggcgatggcacagcataaattatcattaaatgaattagcaagtgcggttaaattattccctcaagtgttaatcaatgtacgttttgcgggtggggaaaatccacttgaaagtgatgctgtaaaatctgttgccgcagaggttgaaaaacgtttagaaggtaaaggtcgtattttattgcgtaaatcgggtacggaaccacttattcgtgttatggtggaatgccaagatgctgaacttgcacaacaatgtgcagaagaaattgcagaagccgtgaaaaaaattaat

SEQ ID NO: 2436 - protein, 445 aa, Haemophilus influenzae
  Name: NTH1352
MANRKYFGTDGVRGKVGSYPITPDFALKLGWAAGKVLASQGSKMVLIGKDTRISGYMLESALEAGLAAAGLSAAFTGPMPTPAIAYLTRTFRAEAGIVISASHNPYYDNGIKFFSAKGTKLPDEIEEAIEAMLEQPMDCVESAELGKASRINDAAGRYIEFCKGTFPAHLGLEGYKIVVDCANGATYHIAPNVLRELGAEVIEIGTDPNGLNINEKCGATDVTALQAKVVETKADVGLAYDGDGDRIMMVDHLGNKVDGDQILFIIAREALRSGQLKGGVVGTLMSNMSLEIALKMLGVPFLRANVGDRYVLEKMLENDWTLGGENSGHIIIADKNTTGDGIVASLAVLAAMAQHKLSLNELASAVKLFPQVLINVRFAGGENPLESDAVKSVAAEVEKRLEGKGRILLRKSGTEPLIRVMVECQDAELAQQCAEEIAEAVKKIN

SEQ ID NO: 2437 - DNA, 99 bp, Haemophilus influenzae
  Name: NTH1353
ttgaccgcacttagtaaagtgcggtttatttttataaagtttttaggaaagcaaaatgaacatttttattatgcgtcacggcgaatcggaagtaatggc

SEQ ID NO: 2438 - protein, 33 aa, Haemophilus influenzae
  Name: NTH1353
LTALSKVRFIFIKFLGKQNEHFYYASRRIGSNG

SEQ ID NO: 2439 - DNA, 465 bp, Haemophilus influenzae
  n 423: n is any nucleotide
  Name: NTH1354
atgcgtcacggcgaatcggaagtaatggctaatagtgataaagctcgtcgcttaactgcttatggtattaaacaagctttttctcaaggagaatggttaaaacagcatttaagcacgctagtaattaattcactagaccgtattttagtgagcccttatgtcagagctcaagaaacctttcatcaagttaatcaagcgtttgatttggagttagaaaataaatttgaaatttgggagggaataaccccttatggccatgcacattccgtcattgattatttagaagtgctaaaagacgagggcgttaaatctgtattgattgtttcccatttgcccttagtgggagaaattgttgctgaactgtttgcaaaacgaaatccatatcattttatcctgcactattgctcattattatgggatgtnataaatcagaatattgatgcatcaagctctcctgtatttatt

SEQ ID NO: 2440 - protein, 155 aa, Haemophilus influenzae
  Name: NTH1354
MRHGESEVMANSDKARRLTAYGIKQAFSQGEWLKQHLSTLVINSLDRILVSPYVRAQETFHQVNQAFDLELENKFEIWEGITPYGHAHSVIDYLEVLKDEGVKSVLIVSHLPLVGEIVAELFAKRNPYHFILHYCSLLWDVINQNIDASSSPVFI

SEQ ID NO: 2441 - DNA, 1314 bp, Haemophilus influenzae
  Name: NTH1355
gtgaaagacttagttaagtttttaaaagcacaatcaaaaaccagtgaagattttgatgtgattaaaattgggttagcttccccagatatgatccgttcttggtcatttggtgaagtgaagaaacctgaaaccattaactaccgtacgttcaaacctgaacgtgatggtcttttctgtgcgcgtatcttcgggcctgtaaaagattacgaatgtttatgtggtaaatataaacgtttaaaacaccgtggtgtgatttgtgaaaaatgtggtgttgaagtcactcaaactaaagttcgtcgtgaacgtatgggtcatattgaacttgcatcgccagttgcacatatttggttcttaaaatcattgccgtctcgtatcggtttacttttagatatgccattgcgcgatatcgaacgtgtactttattttgaaatgtacatcgtgaccgaaccaggtatgacggacttagagcgcggtcaattattaacagaagaacaataccttgacgctgaagatcgctggcaagatgaatttgaagcgaaaatgggtgccgaagcgattcaagatctcttaaaaggtatggatcttgaagctgaatgtgaaaaattacgtgaagaattacaagaaactaactctgaaactaaacgtaaaaaaatcactaaacgcttaaaattattagaagcatttgttcaatctggtaataaaccagaatggatggtgatgacggtattgccagttcttccaccagatttacgcccattagtaccacttgatggcggtcgttttgcgacttcagatctgaacgatttatatcgtcgtgtaatcaaccgtaacaatcgtttaaaacgtttattagatttaattgcgccagatattattgtgcgcaacgaaaaacgtatgttacaagaatctgttgatgccttattagataatggtcgtcgcggtcgtgcaattacgggttctaaccgtcgtccattaaaatcattagcggatatgatcaaaggtaaacaaggtcgtttccgtcaaaatttattaggtaaacgtgttgattactctggtcgttctgtaatcactgttggcccatacttgcacttacaccaatgtggtttaccgaagaaaatggcattggaattattccgtccgtttatctatgcgaaattagaaagccgtggttatgctacgacaatcaaagcggctaagaaaatggttgagcgtgaagaggcgatcgtttgggatattcttgcagaagttattcgtgaacacccaattctattgaaccgtgcgccaacacttcaccgtttgggtatccaagcgttt

SEQ ID NO: 2442 - protein, 438 aa, Haemophilus influenzae
  Name: NTH1355
VKDLVKFLKAQSKTSEDFDVIKIGLASPDMIRSWSFGEVKKPETINYRTFKPERDGLFCARIFGPVKDYECLCGKYKRLKHRGVICEKCGVEVTQTKVRRERMGHIELASPVAHIWFLKSLPSRIGLLLDMPLRDIERVLYFEMYIVTEPGMTDLERGQLLTEEQYLDAEDRWQDEFEAKMGAEAIQDLLKGMDLEAECEKLREELQETNSETKRKKITKRLKLLEAFVQSGNKPEWMVMTVLPVLPPDLRPLVPLDGGRFATSDLNDLYRRVINRNNRLKRLLDLIAPDIIVRNEKRMLQESVDALLDNGRRGRAITGSNRRPLKSLADMIKGKQGRFRQNLLGKRVDYSGRSVITVGPYLHLHQCGLPKKMALELFRPFIYAKLESRGYATTIKAAKKMVEREEAIVWDILAEVIREHPILLNRAPTLHRLGIQAF

SEQ ID NO: 2443 - DNA, 516 bp, Haemophilus influenzae
  Name: NTH1357
atggaagataaaatccctttttggttgcgtgtttggcaacgtttgcatattgatttttggctgtttatcggacttcttgcaataacggcttatggtatgctggtgttatatagtgcatcaggtgccagtgaaatgatgtttaataaccgaattattcaggttttacttggatttattgttatgttgttaatggctcaatttccaccaagattttaccaacgcatcgcaccttatctttatttaattggttttgtgttgttgatcttagtagatgctattggcacgacaagtaaaggtgcgcagcgttggcttgatctgggatttattcgttttcaaccctctgaaattgtaaaacttgctgtgccattaatggtggcggtgtatttaggtaatcgtccgcttccacataaattaagtgaaacatttatagcgattgcaatgattctactgccaacaaattcctcccctcagcctgcggcagctccccccgtaaacagggggagcgaagagaaaaaa

SEQ ID NO: 2444 - protein, 172 aa, Haemophilus influenzae
  Name: NTH1357
MEDKIPFWLRVWQRLHIDFWLFIGLLAITAYGMLVLYSASGASEMMFNNRIIQVLLGFIVMLLMAQFPPRFYQRIAPYLYLIGFVLLILVDAIGTTSKGAQRWLDLGFIRFQPSEIVKLAVPLMVAVYLGNRPLPHKLSETFIAIAMILLPTNSSPQPAAAPPVNRGSEEKK

SEQ ID NO: 2445 - DNA, 1863 bp, Haemophilus influenzae
  Name: NTH1359
gtggcttttttggggattttgctactaacaggtgttttattcaccaatatttatcagctacagattgttaatttcgatacttaccgaacgcgttctaatggtaaccgaattaaattattacctttaccgccaacgcgtggcttaatctatgatcgttacggtaaattattagccgaaaatcttactttttttggtttatacattgtgccggaaaaaactgaaaatttagaccgcactttagatgaattacgctacattgtgggattgacggataacgatattgaacattttaaaaaagaacgtctccgcggaacgcgttatacaccgattttattaaagccgaatttaacagaagaacaaatttcacgctttgcggtaaatggctaccaatacccgagtttagaggtacgtccttatttcaaacgccattatttatatggcgaaacaatggcgcatattttgggctatgtaggtaaaatgaatgataaagatgtagaacgtttgaaacgagaggataaatttgcgaattatgcggggacgaacgatattggaaaattgggtattgaacgttattacgaggatatactgcaaggtaccacgggttttgaagaagtagaaattaataatcgcggcaaagtaatccgtactttgcgtagccgacctgctgtggcgggaaaaagtattcatttaactattgatttagcattacagcgttatattactgaacttttatcgggactaaaaggtgctgtagttgtgcttgatcctaaagatagtagtgtattagcgatggtatctacaccaagttatgacaataatttatttgttgatggtatttcctccgaagattataaacgtttattaaatgatcctgctcgtccgctttatagtcgtgcgacacaaggtgcgtatccgcccgcttcaacagtcaaaccttttattgcagtagccgcacaaactgaaaatgtgattacaccaaacacaacgatttttgatccgggatattgggtattacctaactccacaaaacgttttcgtgattggaaaaaaacaggccacggagatacggatttgaataaagcgattactgaatcctctgatacttatttttatcaagtggcttataatatgggtattgatcgtctttctaattggatgaaggattttggttttggtatgccaacggggattgaaattcaagaagaaacggctgccaatatgccaactcgagaatggaaacaaaaacgctataaacgcccttgggtacaaggcgatacgatttcggttgggattggtcaaggttattggacggcaacaccactacaagtagcaaaagcaacgacgatattggtcaataatggcaaagtaaatacgccgcatttgatgaaagcaattgagggggcagttctagagccttatgaagatccgttaatttatcctgatattagtacacctaaagtgacggcttgggaggcagcgaaacgcggtatgtacaatgttgttaatgctgcaaatggaactgggcgaaaagcctttgcagatgccaattatcgtgttgcaggaaaatctggtactgctcaagtgtttagtttaaaagaaaatgaaaaatacaatgcggtgggattgaaaaaagaattgcatgatcacgcatggtttaccgcatatgcgccttatgaaaaccctagattggttgtgacagtgattttagaaaatgcaggtggtggttcaagtaatgccgcaccgttagcgcgtaaagtgatggattactatttaaatcagcgtttaccacaagttgaaaaatataatgtacctattcagcaaaaaaaagatttgtcacaagagagcgaacaaataaatggaaga

SEQ ID NO: 2446 - protein, 621 aa, Haemophilus influenzae
  Name: NTH1359
VAFLGILLLTGVLFTNIYQLQIVNFDTYRTRSNGNRIKLLPLPPTRGLIYDRYGKLLAENLTFFGLYIVPEKTENLDRTLDELRYIVGLTDNDIEHFKKERLRGTRYTPILLKPNLTEEQISRFAVNGYQYPSLEVRPYFKRHYLYGETMAHILGYVGKMNDKDVERLKREDKFANYAGTNDIGKLGIERYYEDILQGTTGFEEVEINNRGKVIRTLRSRPAVAGKSIHLTIDLALQRYITELLSGLKGAVVVLDPKDSSVLAMVSTPSYDNNLFVDGISSEDYKRLLNDPARPLYSRATQGAYPPASTVKPFIAVAAQTENVITPNTTIFDPGYWVLPNSTKRFRDWKKTGHGDTDLNKAITESSDTYFYQVAYNMGIDRLSNWMKDFGFGMPTGIEIQEETAANMPTREWKQKRYKRPWVQGDTISVGIGQGYWTATPLQVAKATTILVNNGKVNTPHLMKAIEGAVLEPYEDPLIYPDISTPKVTAWEAAKRGMYNVVNAANGTGRKAFADANYRVAGKSGTAQVFSLKENEKYNAVGLKKELHDHAWFTAYAPYENPRLVVTVILENAGGGSSNAAPLARKVMDYYLNQRLPQVEKYNVPIQQKKDLSQESEQINGR

SEQ ID NO: 2447 - DNA, 96 bp, Haemophilus influenzae
  Name: NTH1360
ttgaacattaccttccccccacttgttcgtgttgtagtggctgaaagtttgtatcgcgagtggtcgctcactactaatcatccttatcatcgagaa

SEQ ID NO: 2448 - protein, 32 aa, Haemophilus influenzae
  Name: NTH1360
LNITFPPLVRVVVAESLYREWSLTTNHPYHRE

SEQ ID NO: 2449 - DNA, 579 bp, Haemophilus influenzae
  n 566, 567, 568, 569, 570: n is any nucleotide
  Name: NTH1361
atgaaactaatatctctattctcaggttgtgggggaatggatatcggatttgaaggtagtttctcttgtctaaaaaaatctattaatgaggagctccaccctgaatggatcagctccacagaaaatgaatgggttaccgtttcgcccacttcttttgagacaatttttgctaatgatattaaacctgatgctaaagcagcatgggtttcttatttcttagaccaaaaagcgaatgcaaacgaaatctaccacttagaaagcattgttgatcttgtaaaaaaagaacgggaaactcacaatattttcccaaaagacattgatatattaacaggtggatttccttgtcaagatttttctgtagctggaaaacgattaggatttgattctcacaaaaatcatcatggaaaaatatcaaatatagatgaaccctcaattgaaaatagaggacaattatacatgtggatgagagaagtaatatctataactcaacccaaattattcatagctgaaaatgtaaaaggattaacgaacctaaagggtaccgagtccgatattcgtataccagnnnnnttaattaat

SEQ ID NO: 2450 - protein, 193 aa, Haemophilus influenzae
  Xaa 189, 190: Xaa is any amino acid
  Name: NTH1361
MKLISLFSGCGGMDIGFEGSFSCLKKSINEELHPEWISSTENEWVTVSPTSFETIFANDIKPDAKAAWVSYFLDQKANANEIYHLESIVDLVKKERETHNIFPKDIDILTGGFPCQDFSVAGKRLGFDSHKNHHGKISNIDEPSIENRGQLYMWMREVISITQPKLFIAENVKGLTNLKGTESDIRIPXXLIN

SEQ ID NO: 2451 - DNA, 1296 bp, Haemophilus influenzae
  Name: NTH1363
atggaaaaaattactcttgcaccaataagtgcggttgaaggaacaattaatttaccaggttctaaaagtttatcgaatcgcgcattacttttagccgccttagctaaaggaacaacaaaagtaaccaatttattagatagcgatgatattcgacatatgcttaacgcactgaaagcattaggcgtacgctatcaactgtctgatgataaaactatttgtgaagtagaaggattaggtggaacattcaatatacaggacaatctttcactctttcttggcaatgctgggactgcaatgcgtccattaaccgcagcactttgcttaaaaggaaaaaccgaaagcgaaatcatcttaacgggtgaacctcgtatgaaagagcggccaattctccatttagtcgatgctttacgccaagcgggtgcagatattcgctacttagagaatgagggttatcctccgctcgcaattcgcaacaaagggataaaaggtggaaaagtcaaaattgatggttcaatttcatctcaatttttgaccgcacttttaatgtctgcgccacttgcagaaaatgacacagaaatagaaattatcggtgaactagtctctaaaccctatattgacattacccttgcaatgatgcgagattttggtgttaaggttgaaaatcatcactaccaaaaatttcaagttaagggaaatcaatcctatatttcgcctaataaatacttggtagaaggcgatgcatcatcagcctcttactttcttgcagctggcgccattaaaggaaaagtgaaagtaacaggcattggcaaaaactcaattcaaggcgatcgtttatttgctgatgtattagagaaaatgggggcaaaaatcacttggggagaggattttatccaagccgaacacgctgaattaaatggtattgatatggatatgaaccacattccagatgccgcaatgacgattgcgaccaccgcacttttttccaacggcgaaaccgtcattcgcaatatttataactggcgtgtgaaagaaacagatcgtttaacggctatggcaactgaactccgtaaagtcggtgcagaagtcgaagaaggtgaagattttattcatattcaaccgcttccactcaatcaatttaaacacgccaatattgagacctataacgatcaccgtatagcaatgtgtttttctctaatcgcactatcaaacacacctgtgacgattttagatcccaaatgtactgccaaaacctttcctacattctttagtgaatttgagaaaatttgcttaagagat

SEQ ID NO: 2452 - protein, 432 aa, Haemophilus influenzae
  Name: NTH1363
MEKITLAPISAVEGTINLPGSKSLSNRALLLAALAKGTTKVTNLLDSDDIRHMLNALKALGVRYQLSDDKTICEVEGLGGTFNIQDNLSLFLGNAGTAMRPLTAALCLKGKTESEIILTGEPRMKERPILHLVDALRQAGADIRYLENEGYPPLAIRNKGIKGGKVKIDGSISSQFLTALLMSAPLAENDTEIEIIGELVSKPYIDITLAMMRDFGVKVENHHYQKFQVKGNQSYISPNKYLVEGDASSASYFLAAGAIKGKVKVTGIGKNSIQGDRLFADVLEKMGAKITWGEDFIQAEHAELNGIDMDMNHIPDAAMTIATTALFSNGETVIRNIYNWRVKETDRLTAMATELRKVGAEVEEGEDFIHIQPLPLNQFKHANIETYNDHRIAMCFSLIALSNTPVTILDPKCTAKTFPTFFSEFEKICLRD

SEQ ID NO: 2453 - DNA, 894 bp, Haemophilus influenzae
  Name: NTH1365
ttgaaactagaacctattttatgggttctatttttttatctaaacatagcacacaacattatgatcgaaaaaaaaatattactcactgattgccctgatgataaaggcttaatcgcaaaaataactaatatttgttacaaacatcaactaaatattcttcataataatgaatttgtagattttgaaaccaaacatttctttatgcgcacagaattggaaggtatttttaacgaagctactttattagaagatctaaaatatagcttacccgaagaaacgaattgtcgattaattggcacccaacgtaagcgaattgtaattttagtcaccaaagaagctcactgcctcggcgatattttaatgaaaaattattatggtgcgcttgatgtagaaattgcagccgtaatcggcaatcacgataatttacgtgaacttgttgaacgttttaatattccatttcatttagttagccacgaaaacttaacccgtgtagaacacgacaaattactggcagaaaaaattgatgaatatacgccagattatattgttctcgctaaatatatgcgtgtgctaaaccctgaatttgtcgcacgttatccaaatcgagtgattaatatccatcattcattcttgcctgcttttattggtgccaagccttatcaacaagcctatgaacgcggtgtaaaaattattggcgcaacggcacattttattaataacgaattagatcaaggcccaatcattatgcaaaatgtgattaatgtggatcatacttataatgcagaagcgatgatgcgtgctggccgtgatgtggaaaaaaccgtgttaagtcgcgcccttgatctcgctttacacgatagaatttttgtttataaaaataaaacggtggtgttg

SEQ ID NO: 2454 - protein, 298 aa, Haemophilus influenzae
  Name: NTH1365
LKLEPILWVLFFYLNIAHNIMIEKKILLTDCPDDKGLIAKITNICYKHQLNILHNNEFVDFETKHFFMRTELEGIFNEATLLEDLKYSLPEETNCRLIGTQRKRIVILVTKEAHCLGDILMKNYYGALDVEIAAVIGNHDNLRELVERFNIPFHLVSHENLTRVEHDKLLAEKIDEYTPDYIVLAKYMRVLNPEFVARYPNRVINIHHSFLPAFIGAKPYQQAYERGVKIIGATAHFINNELDQGPIIMQNVINVDHTYNAEAMMRAGRDVEKTVLSRALDLALHDRIFVYKNKTVVL

SEQ ID NO: 2455 - DNA, 414 bp, Haemophilus influenzae
  Name: NTH1366
ttgaggtttattatgaacgaattagtaagaggtttaacaaatcttcgtagtttacgtgcagctgtacgtgaattaacgttagaacaagcagaaaatgccctagaaaaattacaaacagctatcgaagaaaaacgtgctaatgaagcagaattaattaaagcagagacagagcgaaaagagcgtttagctaaatataaagaattaatggaaaaagaaggtattacacctgaagaattacacgaaatttttggcacaaaaactgtatcaattcgagcaaaacgtgctccacgccctgcaaaatatgcgtttattgatgaaaatggcgagcataaaacttggacgggtcaaggtcgcacaccacgcccaattcaaaatgcgttgaacaaaggtaaatcattatctgatttcgaaatt

SEQ ID NO: 2456 - protein, 138 aa, Haemophilus influenzae
  Name: NTH1366
LRFIMNELVRGLTNLRSLRAAVRELTLEQAENALEKLQTAIEEKRANEAELIKAETERKERLAKYKELMEKEGITPEELHEIFGTKTVSIRAKRAPRPAKYAFIDENGEHKTWTGQGRTPRPIQNALNKGKSLSDFEI

SEQ ID NO: 2457 - DNA, 102 bp, Haemophilus influenzae
  Name: NTH1367
atgacagtgtcgcccctttcgagcacgccaccaaccaaacaaaacgacttttatttgatttcggcaactattcctttcttttttcttcttcgttatccactc

SEQ ID NO: 2458 - protein, 34 aa, Haemophilus influenzae
  Name: NTH1367
MTVSPLSSTPPTKQNDFYLISATIPFFFLLRYPL

SEQ ID NO: 2459 - DNA, 231 bp, Haemophilus influenzae
  n 172, 179, 180, 191, 195, 198, 226, 227, 228, 229, 230: n is any nucleotide
  Name: NTH1368
atgctttccgttctctccattaattataggtattatttaatggaacttattgatttttcatcatctgtttggtcaatcgtccctgctttgttggcgataattttggcgatagcaactcgccgtgttttggtttcccttagtgcggggattattattggatccattaatgttnaaggggnnatccccctagnagtncgnacctgccaggccagccaaggtctaggcnnnnnt

SEQ ID NO: 2460 - protein, 77 aa, Haemophilus influenzae
  Xaa 58, 60, 64, 76, 77: Xaa is any amino acid
  Name: NTH1368
MLSVLSINYRYYLMELIDFSSSVWSIVPALLAIILAIATRRVLVSLSAGIIIGSINVXGXIPLXVRTCQASQGLGXX

SEQ ID NO: 2461 - DNA, 198 bp, Haemophilus influenzae
  Name: NTH1369
ttggtcgcaactaatgatgtgatgtttttgaatgcagaggattttgaagcccacgaaattcgcgtagcgattcacgatggctatactttagacgatcctaaacgtccgaaatgttatacctcacagcaatattttcgtagtgaagaagatatgtgtaagctgtttgcagacattccttccgctctcgaaataccttat

SEQ ID NO: 2462 - protein, 66 aa, Haemophilus influenzae
  Name: NTH1369
LVATNDVMFLNAEDFEAHEIRVAIHDGYTLDDPKRPKCYTSQQYFRSEEDMCKLFADIPSALEIPY

SEQ ID NO: 2463 - DNA, 105 bp, Haemophilus influenzae
  n 37: n is any nucleotide
  Name: NTH1370
gtgactttgcgccttggtcaatatttcttacctcaanttccaactggcgatttaagtacagaagatttcttagtgcaaaaatccaaagaggcttggaagaacgtt

SEQ ID NO: 2464 - protein, 35 aa, Haemophilus influenzae
  Xaa 13: Xaa is any amino acid
  Name: NTH1370
VTLRLGQYFLPQXPTGDLSTEDFLVQKSKEAWKNV

SEQ ID NO: 2465 - DNA, 2541 bp, Haemophilus influenzae
  Name: NTH1371
gtgcggttagaaaaacgaccaaaatatgatgaacgcttgcaagttgagctagatgtaattaaccaaatggggttcccaggttatttcttgatcgtaatggaatttattcaatggtctaaggataacgatattccagtagggccaggtcgtggttctggtgcgggttcattagtggcttatgcattaaaaatcactgatttagatccgttagagtttgatttgctatttgaacgtttcttaaatccagaacgtgtgtctatgcccgatttcgacgtggatttctgtatggatggtcgcgatcgcgtgattgagcacgttgcagaaacctatggtcgtggcgcggtatcacaaattattacctttggcacaatggcggcgaaagcggttattcgagatgtagggcgagtgctggggcatccttatggtttcgttgatcgtatttctaaattgattccgccagatccaggtatgacgcttgccaaagcgtttgagaccgagccgcaattacagactgcctacgatagcgatgaagaagtgcgagcattgattaacatggcgcgcaagctgaaaggtgtgacacgtaatgcaggtaaacatgcaggtggcgtggtcatttcgccaaccttaattactgatttcgcaccactctattgtgataatgaaggcttacatccggttactcactttgataaaaatgatgtggaatatgcagggcttgtgaaatttgacttcctaggcttgcgtactctcactatcattaaatgggcattggatataattaatgttcgtatggtgcgtgaaggcaagcctcgagtagatattgccgccattccacttgatgatcctgaatcttttgaattacttaaacgttccgaaaccaccgctgtgttccagttggaatcacgaggtatgaaagatttgatcaaacgcctgcaacctgactgttttgaagatattatcgcattggtagcattgttccgtccgggtccgttacaatcgggtatggtagataactttatcgaccgtaaacacgggagagaagaagtatcttaccctgacgcagaatatcaacatgcaagtttgaaacctattcttgagccgacttacggcattattttgtatcaagaacaagtgatgcaaattgcgcaggtgttggctggctatacgctgggtggggctgacttattgcgtcgagcaatgggtaaaaagaaaccagaagaaatggcaaaacagcgtttagtgtttaaagagggggctgagaaaaacggtgttgatggcgagctatctatgaagattttcgacttggtggaaaaatttgctggctatggttttaataaatctcactccgctgcttatgccttggtgtcttaccaaactctttggcttaaaactcatttccctgcagaatttatggctgcagtgatgacatctgaaatggataatacggataaaatcgtaggtttgtacgacgaatgtttgcgtatgggcttaaaagtgacgccaccagatattaatatcggaaaacaccattttagtgtcaatgaacaaggcgaaattgtgtatgggattggcgcgattaaaggcgtgggggaaggcccgattgaagcacttgtggcggcaagaaatgaaggggggattttcaaagatttattcgatttatgcgctcgtgtagatttgaaaaaaattaaccgccgtacttttgaaagcctaattatgtcgggtgcctttgataaattaggcccacatcgcgccgcactttctaagaatttggaagatgcacttagagcttccgatcagcatgcgaaagatgaagcaatgggacaaacggatatgttcggtgtgctgactgaaacccatgaagacgtggaaaatgcctatgctaatacaccaccttacactgaaaaacaaatccttgatggcgaacgagaaaccttggggctttatttaagtagccatcctgttagccgttatttgaaagaactttctcattacacatcaacgcggttgaaagatctcgcaccaaatcgccgtggacaaattagcactgtggcggggctagtcgtggcatcgagaattgcgatgacgaaaaaaggcaatcgtctaggtattgcaacattggacgatcgttcaggtcgcttagatttaacattatttggtgaaagcctagaacaatttggtgagaaattacaaaaagatacagtgattgttgcttcagggcaggtgagctttgatgatttctctggtggcttgaaaatgacggtgcgcgagttaatgaccttagatgaggcacgttctcgttatgtcaaatccttggctattagtctttctgagcatcaaattacaccaagtttcattaaacaatttaaagcattacttgagccagtgagtggtggaacattgcctattaacgtgtattatcaaagtccgaaaggtcgtgcgttgttacgtttaggcgtgcaatggtcgatcattccaacagatgaaattctgacggaattggtgaatttactcggcgaaagtgcggtggaattagagtttgaa

SEQ ID NO: 2466 - protein, 847 aa, Haemophilus influenzae
  Name: NTH1371
VRLEKRPKYDERLQVELDVINQMGFPGYFLIVMEFIQWSKDNDIPVGPGRGSGAGSLVAYALKITDLDPLEFDLLFERFLNPERVSMPDFDVDFCMDGRDRVIEHVAETYGRGAVSQIITFGTMAAKAVIRDVGRVLGHPYGFVDRISKLIPPDPGMTLAKAFETEPQLQTAYDSDEEVRALINMARKLKGVTRNAGKHAGGVVISPTLITDFAPLYCDNEGLHPVTHFDKNDVEYAGLVKFDFLGLRTLTIIKWALDIINVRMVREGKPRVDIAAIPLDDPESFELLKRSETTAVFQLESRGMKDLIKRLQPDCFEDIIALVALFRPGPLQSGMVDNFIDRKHGREEVSYPDAEYQHASLKPILEPTYGIILYQEQVMQIAQVLAGYTLGGADLLRRAMGKKKPEEMAKQRLVFKEGAEKNGVDGELSMKIFDLVEKFAGYGFNKSHSAAYALVSYQTLWLKTHFPAEFMAAVMTSEMDNTDKIVGLYDECLRMGLKVTPPDINIGKHHFSVNEQGEIVYGIGAIKGVGEGPIEALVAARNEGGIFKDLFDLCARVDLKKINRRTFESLIMSGAFDKLGPHRAALSKNLEDALRASDQHAKDEAMGQTDMFGVLTETHEDVENAYANTPPYTEKQILDGERETLGLYLSSHPVSRYLKELSHYTSTRLKDLAPNRRGQISTVAGLVVASRIAMTKKGNRLGIATLDDRSGRLDLTLFGESLEQFGEKLQKDTVIVASGQVSFDDFSGGLKMTVRELMTLDEARSRYVKSLAISLSEHQITPSFIKQFKALLEPVSGGTLPINVYYQSPKGRALLRLGVQWSIIPTDEILTELVNLLGESAVELEFE

SEQ ID NO: 2467 - DNA, 354 bp, Haemophilus influenzae
  Name: NTH1373
ttgcagacctcacgaaaaaatggttttgatgttgaggatatgtctgatgatgatattgcgaaaacgcatgttcgatatttaatgggtggtcgagcatcgaatgataacgaacgtttatataccttcgaattcccagagcaaaaaggtgccttattaaaattcttggaaaccttgcaaaatcgttggaatatttcattatttcactatcgtgcccacggtgcggactatggaaatatccttgctgggttccaaattgaagaacgcgaacaagcagaatttgaacaggcacttgcccaactcaattatgtttttgaagatgtaacagaaagcaaatcttatcgttatttcttacgt

SEQ ID NO: 2468 - protein, 118 aa, Haemophilus influenzae
  Name: NTH1373
LQTSRKNGFDVEDMSDDDIAKTHVRYLMGGRASNDNERLYTFEFPEQKGALLKFLETLQNRWNISLFHYRAHGADYGNILAGFQIEEREQAEFEQALAQLNYVFEDVTESKSYRYFLR

SEQ ID NO: 2469 - DNA, 369 bp, Haemophilus influenzae
  Name: NTH1374
gtgcctgttcaaattctgcttgttcgcgttcttcaatttggaacccagcaaggatatttccatagtccgcaccgtgggcacgatagtgaaataatgaaatattccaacgattttgcaaggtttccaagaattttaataaggcacctttttgctctgggaattcgaaggtatataaacgttcgttatcattcgatgctcgaccacccattaaatatcgaacatgcgttttcgcaatatcatcatcagacatatcctcaacatcaaaaccattttttcgtgaggtctgcaataatatccgctttttcttgcttatttggcgttcctaccccacaaacacgcaagcacgtttatcatccgcttaacgataac

SEQ ID NO: 2470 - protein, 123 aa, Haemophilus influenzae
  Name: NTH1374
VPVQILLVRVLQFGTQQGYFHSPHRGHDSEIMKYSNDFARFPRILIRHLFALGIRRYINVRYHSMLDHPLNIEHAFSQYHHQTYPQHQNHFFVRSAIISAFSCLFGVPTPQTRKHVYHPLNDN

SEQ ID NO: 2471 - DNA, 126 bp, Haemophilus influenzae
  n 1, 44: n is any nucleotide
  Name: NTH1375
ntgaaaatagggaagcgtttttatggaaaaactgaatttccccnctacattaagtttttaaaagtgggaattggtaaaatagaagggtttatgaggggtaaccggactgaacaacaagtaatttct

SEQ ID NO: 2472 - protein, 42 aa, Haemophilus influenzae
  Xaa 1, 15: Xaa is any amino acid
  Name: NTH1375
XKIGKRFYGKTEFPXYIKFLKVGIGKIEGFMRGNRTEQQVIS

SEQ ID NO: 2473 - DNA, 381 bp, Haemophilus influenzae
  Name: NTH1376
atgttcacttttattcttctttgtttacttgttggtgcattagcgggttttcttgcaggattatttggtatcggcggagggttagtaattgtgccaaccttagtgtatttactgcccattgtagatgtaccagaatctttgttgatgtctaccgcacttggcacatcatttgctaccattgtgattactggcattggatcggcacaacgtcatcataaattatgtaacatagtctggcaggcagttcgcattttagctccggttattatgctttctgtctttatttgtggttcatttattggaagacttgatcgtgaaatttctgccaaaatttttgtttgcttagtggtatatttagccacacaaatggtacttttcgat

SEQ ID NO: 2474 - protein, 127 aa, Haemophilus influenzae
  Name: NTH1376
MFTFILLCLLVGALAGFLAGLFGIGGGLVIVPTLVYLLPIVDVPESLLMSTALGTSFATIVITGIGSAQRHHKLCNIVWQAVRILAPVIMLSVFICGSFIGRLDREISAKIFVCLVVYLATQMVLFD

SEQ ID NO: 2475 - DNA, 588 bp, Haemophilus influenzae
  Name: NTH1378
gtgatcgattttgatggctaccgtccaaatgtgggtattgtgatttgtaatcgcaaagggcaagtgctttgggcgaagcgttgtgggcaaaattcgtggcagtttccgcaaggtggcattaatgataatgaaagtgccgagcaagcgatgtatcgcgaactacacgaggaagttggtttacaacctaaagatgtgcgtttgttatatgtttctaaacattggttgcgttataaattgccaaagcgtttattgcgttatgatagcaagccgatgtgtattgggcagaaacaacgctggtttttgctacagcttgttggcgatgaaaaaaatatcaatatgaaaacgaccaaatcgccagaatttgatgggtggcgttgggtaagtttttggtatcctgttcgtcaagttgtgtcttttaagcgagatgtttatcgaaaggtaatgaaagagtttgcttcggtattatttacggataatccaccaatattttccgcatctcgtgaagcaaattcacagtctaattcggcaaataaaaaatattctcagacaaaatacacaaaacgccatttttacaaatcaaaaggtcaa

SEQ ID NO: 2476 - protein, 196 aa, Haemophilus influenzae
  Name: NTH1378
VIDFDGYRPNVGIVICNRKGQVLWAKRCGQNSWQFPQGGINDNESAEQAMYRELHEEVGLQPKDVRLLYVSKHWLRYKLPKRLLRYDSKPMCIGQKQRWFLLQLVGDEKNINMKTTKSPEFDGWRWVSFWYPVRQVVSFKRDVYRKVMKEFASVLFTDNPPIFSASREANSQSNSANKKYSQTKYTKRHFYKSKGQ

SEQ ID NO: 2477 - DNA, 1146 bp, Haemophilus influenzae
  Name: NTH1379
gtgataacgttaatgtcaattttaagaacgttggaaaggactatgaacaaaaaaacaatcgttgtgaaattcggtactagcacgctaactcagggttcgccaaaattgaattcgccacatatgatggaaatcgttcgtcaaattgcacaactgcataatgatggatttcgtatagtaatcgtgacttctggtgctattgcagcgggtcgccattatttaaatcatcctcaattaccacccactattgcctcaaagcaactgcttgcagcggttggtcagagccaattaattcaggcttgggaaaaattatttgctatttatgatattcatatcgggcaacttttattaactcgtgctgatattgaagatcgcgaacgttttttaaatgcacgagatactttacatgcacttttagataaccacattattcctgtgattaatgaaaatgatgcggtggcgactgcggaaataaaagtaggagacaatgacaatttatctgcactagtcgctattcttgtgcaagcggaacaactttatttattgactgatcaacaaggtttatttgatagtgatccgcgtaaaaatcctgaagcaaaattaattccagttgtagaacaaatcactgatcacattcgatcaattgcaggaggaagtggtacaaatcttggcacaggtggaatgatgactaaaatcattgctgccgatgttgccactcgctctggaattgaaacaattattgcaccaggtaatcgtccaaatgtaattgcagatcttgcttatgaacaaaatattggtacaaaatttattgcacaccaatctgatcgattagaaagtcgcaaacaatggcttttcgccgcgccatcggcaggcattatcactattgatgatggagcgaaaaatgccattcttgaacaaaataaatctttattacccgctggtattattaacgtggaagggcgtttttcgcgtggtgaagtagtcaaaatatgcactcaatctggtaaagacattgtactaggtatgccacgctataacagcgatgctctacaattaattaagggcagaaaatcagcagatattgaaaatgttttaggctatgaatatggtgcggtggcaatgcatcgtgatgatatgattattttgtca

SEQ ID NO: 2478 - protein, 382 aa, Haemophilus influenzae
  Name: NTH1379
VITLMSILRTLERTMNKKTIVVKFGTSTLTQGSPKLNSPHMMEIVRQIAQLHNDGFRIVIVTSGAIAAGRHYLNHPQLPPTIASKQLLAAVGQSQLIQAWEKLFAIYDIHIGQLLLTRADIEDRERFLNARDTLHALLDNHIIPVINENDAVATAEIKVGDNDNLSALVAILVQAEQLYLLTDQQGLFDSDPRKNPEAKLIPVVEQITDHIRSIAGGSGTNLGTGGMMTKIIAADVATRSGIETIIAPGNRPNVIADLAYEQNIGTKFIAHQSDRLESRKQWLFAAPSAGIITIDDGAKNAILEQNKSLLPAGIINVEGRFSRGEVVKICTQSGKDIVLGMPRYNSDALQLIKGRKSADIENVLGYEYGAVAMHRDDMIILS

SEQ ID NO: 2479 - DNA, 384 bp, Haemophilus influenzae
  Name: NTH1380
atgacatttagtttaattgtggcgataacattaaataatgtgattggtaaagataatcaaatgccttggcacttgcctgcagatttagcttggtttcgtcagaaaaccactggtaaacctgtcattatggggcgtaaaacctttgaaagtattggtcgtccactacctaaacgtaccaatatcgtactttctcgccagctttttgaacacgaaggtgtgatatggaaagatagctttgaaagtgcggtcaattttgtcagagattttgatgaaattatgttgattggtgggggcgagttattcaaacaatatttacccaaagcagataagttataccttactcaaattcaaacagaactagatggcgatagtttttccctcaat

SEQ ID NO: 2480 - protein, 128 aa, Haemophilus influenzae
  Name: NTH1380
MTFSLIVAITLNNVIGKDNQMPWHLPADLAWFRQKTTGKPVIMGRKTFESIGRPLPKRTNIVLSRQLFEHEGVIWKDSFESAVNFVRDFDEIMLIGGGELFKQYLPKADKLYLTQIQTELDGDSFSLN

SEQ ID NO: 2481 - DNA, 138 bp, Haemophilus influenzae
  n 112: n is any nucleotide
  Name: NTH1381
ttgaattgggaggagtgggaaattgaatttgatgaatatcgtaaggcagatgccaaaatcgctatgatgccgatttttattttttacccgaaaataaatcaaataaatgaancaatacttctagaacattcattaatc

SEQ ID NO: 2482 - protein, 46 aa, Haemophilus influenzae
  Xaa 38: Xaa is any amino acid
  Name: NTH1381
LNWEEWEIEFDEYRKADAKIAMMPIFIFYPKINQINEXILLEHSLI

SEQ ID NO: 2483 - DNA, 111 bp, Haemophilus influenzae
  Name: NTH1382
atgtttaaaaatgggatatttaaaactatcaaaaataaaatgaaaggtcattatgaaactttaaaaaggggaactcaaggggaaattatcatctctttgtttttgctagat

SEQ ID NO: 2484 - protein, 37 aa, Haemophilus influenzae
  Name: NTH1382
MFKNGIFKTIKNKMKGHYETLKRGTQGEIIISLFLLD

SEQ ID NO: 2485 - DNA, 1176 bp, Haemophilus influenzae
  n 1139, 1142, 1171, 1172, 1173, 1174, 1175: n is any nucleotide
  Name: NTH1383
atgacgaaaactgcaattgaaactccatcaaataaatctgtatcaaataaaactaaccgtaaaaaaggcttaagcatttttattcttctcctgcttattattggtattgcttgtgctttgtattggtttttcttcttgaaggattttgaagaaacagaagatgcttatgtgggtggaaatcaagtaatggtatcatcacaagttgcaggtaatgtagcgaagattaatgcagacaatatggataaagtccatgcaggtgatattctagttgaattggatgataccaatgcgaaacttagttttgaacaggccaaaagcaatctcgccaatgctgtacgtcaggtagaacaactgggtttcactgtgcagcaattgcaatcagctgtgcacgccaatgaaatttctttagctcaagctcaaggcaatttggcgcgccgagttcaacttgaaaaaatgggtgcgattgataaagaatctttccaacacgcaaaagaagctgtcgagcttgccaaagcaaatttaaatgcctctaaaaatcaattggctgctaatcaggctttattgcgtaacgttccattacgtgaacaaccgcaaatacagaatgcgataaactcgcttaaacaggcttggttaaatttgcaacgtacaaaaattagaagtccaattgatggctatgtggcgcgtcgtaatgttcaagttgggcaagccgtttcagtgggtggcgcgttaatggcggtggtatctaatgaacaaatgtggttagaagctaacttcaaagaaacccaattaacgaatatgcgcattggtcagccagtaaaaatccattttgatttatacggtaaaaataaagaatttgatggcgtgataaatggcattgaaatggggactggcaatgcgttttctcttttaccttcgcaaaatgctacgggtaactggattaaagtggtacaacgtgtaccctgtgcgaataaattagatccacaacaatttacagaaacgccattgagaattggtctttctgcaacggcaaaagtaagaatttcagattcatcaggcgcaatgctacgagaaaaaacagaaccgaaaacgttttttctactgatacacttaaatatgagaaagtgcgtagaaaaggggtnctntagagtcgactgcaggcagcaagctgtcnnnnnt

SEQ ID NO: 2486 - protein, 392 aa, Haemophilus influenzae
  Xaa 380, 381, 391, 392: Xaa is any amino acid
  Name: NTH1383
MTKTAIETPSNKSVSNKTNRKKGLSIFILLLLIIGIACALYWFFFLKDFEETEDAYVGGNQVMVSSQVAGNVAKINADNMDKVHAGDILVELDDTNAKLSFEQAKSNLANAVRQVEQLGFTVQQLQSAVHANEISLAQAQGNLARRVQLEKMGAIDKESFQHAKEAVELAKANLNASKNQLAANQALLRNVPLREQPQIQNAINSLKQAWLNLQRTKIRSPIDGYVARRNVQVGQAVSVGGALMAVVSNEQMWLEANFKETQLTNMRIGQPVKIHFDLYGKNKEFDGVINGIEMGTGNAFSLLPSQNATGNWIKVVQRVPCANKLDPQQFTETPLRIGLSATAKVRISDSSGAMLREKTEPKTFFLLIHLNMRKCVEKGXXRVDCRQQAVXX

SEQ ID NO: 2487 - DNA, 1029 bp, Haemophilus influenzae
  Name: NTH1384
gtgggtcgccgtttccgcttagcacatattatgtttggtcgagatattattgaagtcgccactttccgtgctaatcacagtgatgctcgcaatgaaaatcaagcgaaacagagcaatgaaggcatgttactgcgcgataatgtttacggtacgatcgaacaagatgcagcacgccgtgattttacggtcaatgcactgtattacaatccgcaagataatacgttacgagattatttcgagggcattaaggatctcaaagcaggcaagctacgcttaattggcgatcctgttacacgttatcaagaagatcctgtgcgcatgctacgctcaattcgttttatggcaaaacttgatatgttccttgaaaaaccaagtgaacagccaattcgtgaacttgcacctttattaaaaaatattccaccagctcgcttatttgacgaaagtttaaaattattgcaggcaggacaaggggtaaaaacctatcggttattacgccaatatagtttatttgaacaacttttccctgcattaagcgcatattttacagagaaagaagatagctttgcagaacgtatgatcgttaccgcccttagttcgacagatgaacgtgttgcggataaacttcgtattaatcctgcattcttatttgcagcatttttctggtatccattgcgcgaaaaagtggaaattttaaaaaatgaaggtggtttaaataatcatgatgcttatgctttagcaggcaatgaagttttagacttattctgccgtgctttggctgcaccacgtcgtcatactgcggtcattcgtgacatttggttcttacaattgcaattattaaaacgtactggctcagcaccaatgcgtaccatggaacatccaaaattccgtgctggctttgatttactggctatgcgtgcagaaattgaaggtggcgaaaccattgaattagccaaatggtggcacgaatatcaatttagtaatggtgaacagcgcgaacagtttgatacacgagcaacaacgcttacatcc

SEQ ID NO: 2488 - protein, 343 aa, Haemophilus influenzae
  Name: NTH1384
VGRRFRLAHIMFGRDIIEVATFRANHSDARNENQAKQSNEGMLLRDNVYGTIEQDAARRDFTVNALYYNPQDNTLRDYFEGIKDLKAGKLRLIGDPVTRYQEDPVRMLRSIRFMAKLDMFLEKPSEQPIRELAPLLKNIPPARLFDESLKLLQAGQGVKTYRLLRQYSLFEQLFPALSAYFTEKEDSFAERMIVTALSSTDERVADKLRINPAFLFAAFFWYPLREKVEILKNEGGLNNHDAYALAGNEVLDLFCRALAAPRRHTAVIRDIWFLQLQLLKRTGSAPMRTMEHPKFRAGFDLLAMRAEIEGGETIELAKWWHEYQFSNGEQREQFDTRATTLTS

SEQ ID NO: 2489 - DNA, 318 bp, Haemophilus influenzae
  Name: NTH1386
gtgaatgccgttgcaaaaattgaaaccgaacttagtccgctcaagctattagatgaattacaacgtattgaaaacgagcaaggtcgagtgcgtttacgtcgctggggcgaacgcacgttagatttagatattttgctctacggcaatgaaattattcaaaacgaacgcttaataattccccattatgatatgcataaccgtgagtttgtcattgtgccgttgtttgaaatcgcatcggatttagttttaccaaatagtcaaatcataacagagctggtcaagcaatttgctgaccacaaaatgataaaattaaatccc

SEQ ID NO: 2490 - protein, 106 aa, Haemophilus influenzae
  Name: NTH1386
VNAVAKIETELSPLKLLDELQRIENEQGRVRLRRWGERTLDLDILLYGNEIIQNERLIIPHYDMHNREFVIVPLFEIASDLVLPNSQIITELVKQFADHKMIKLNP

SEQ ID NO: 2491 - DNA, 435 bp, Haemophilus influenzae
  Name: NTH1387
atgcttcgcttcggcaaaaaattcgcagaaattcttttaaaattgcataccgaaaaagcaattatggtttatcttaacggtgatcttggggcaggaaaaacaacgctaacgcgcggaatgttgcaaggcatcggtcatcaaggtaatgtaaaaagcccaacttatacgctggttgaagaatacaatattgcaggcaaaatgatttatcattttgatttatatcgtctagcagatcctgaagagctcgaatttatgggcattagagattattttaatacagatagcatctgcttaattgaatggtcagaaaaaggtcaaggcatattgccagaagctgatattttagtgaatattgattattacgatgatgcacgaaatattgaattaatcgcacaaacaaatttgggtaaaaatattataagcgcattttctaat

SEQ ID NO: 2492 - protein, 145 aa, Haemophilus influenzae
  Name: NTH1387
MLRFGKKFAEILLKLHTEKAIMVYLNGDLGAGKTTLTRGMLQGIGHQGNVKSPTYTLVEEYNIAGKMIYHFDLYRLADPEELEFMGIRDYFNTDSICLIEWSEKGQGILPEADILVNIDYYDDARNIELIAQTNLGKNIISAFSN

SEQ ID NO: 2493 - DNA, 1296 bp, Haemophilus influenzae
  Name: NTH1388
atgaaaactaaaattttattttttctttttttctcgacatttagcttttctatttttgcagcacctattacgattgcgattgacccaggtcatgggggaaaagatcctggtgcaatcagccgaaatttaggtatttatgaaaaaaatgttaccctttcaattgcaaaagaattaaaagccttattagataaagatccacattttcgtggcgtattaacacgtaaaagtgattattatatttccgtgcctgaacgttcagaaatcgcacgtaaatttaaagcgaattatcttatttccattcatgcggattcatctgaatcgcctgatcgtcgcggggcttctgtttgggtattgtcaaaccgtcgagccaatgatgaaatgggtcaatggctagaagacgatgaaaaacgctcggaattacttggtggcgcgggaaaggtgctttcacacaataatgacaaatatcttgaccagactgtacttgatctgcaattcggacatagccaacgtactggctatgtgttaggcgaacatattttgcaccattttgcgaaaataacaaccttgagtcgtagtacaccacaacatgcaagtctgggtgttctacgttcgccagatattccttctgtgttggtagaaactggatttctttccaattcagaagaagaaaaaaaacttaattcccaaacttatcgtcgccgcattgcttatatgatttatgaaggcttagttgcattccgtagcggtaaaaccaacactttagttaaagacaatttagtgcaaaacatcaaacaaaacgatataaaaaaatcagggaaaaataaccgcacttcagaacaaaatataaatgaagataatattaaagacagtggcattcgccatattgtaaaaaaaggagaaagtttaggtagcttatcaaataaatatcacgtaaaagtctctgatattattaaattaaatcaattaaagagaaaaacactttggctaaatgaaagtattaaaatccctgataatgtcgagataaaaaataaatcattaacaattaaagaaaatgattttcataaaaaacaaaatagctcagtaaataatactaataaagatttaaaaaaagagaaaaatacacaaactaataatcaaaaaaatataattccgctctatcataaagtaacaaaaaaccaaacactttatgctatttcgagggaatataacattccagtaaatatactattgagcctaaatccacatttaaaaaatggcaaagttattacaggacaaaaaataaaattaagagaaaaa

SEQ ID NO: 2494 - protein, 432 aa, Haemophilus influenzae
  Name: NTH1388
MKTKILFFLFFSTFSFSIFAAPITIAIDPGHGGKDPGAISRNLGIYEKNVTLSIAKELKALLDKDPHFRGVLTRKSDYYISVPERSEIARKFKANYLISIHADSSESPDRRGASVWVLSNRRANDEMGQWLEDDEKRSELLGGAGKVLSHNNDKYLDQTVLDLQFGHSQRTGYVLGEHILHHFAKITTLSRSTPQHASLGVLRSPDIPSVLVETGFLSNSEEEKKLNSQTYRRRIAYMIYEGLVAFRSGKTNTLVKDNLVQNIKQNDIKKSGKNNRTSEQNINEDNIKDSGIRHIVKKGESLGSLSNKYHVKVSDIIKLNQLKRKTLWLNESIKIPDNVEIKNKSLTIKENDFHKKQNSSVNNTNKDLKKEKNTQTNNQKNIIPLYHKVTKNQTLYAISREYNIPVNILLSLNPHLKNGKVITGQKIKLREK

SEQ ID NO: 2495 - DNA, 681 bp, Haemophilus influenzae
  n 676, 677, 678, 679, 680: n is any nucleotide
  Name: NTH1389
atgcctattaaaattctttccccacaacttgctaaccaaattgctgctggagaagtggtagaacgccctgcatcagtggtaaaagaattagtggaaaatagccttgatgcaggtgcaaataaaatccaaattgatatcgaaaatggtggggcaaatttaatccgcattcgtgacaatggctgtggtattccaaaagaagaattaagcctcgctttagcacgacatgctacgagtaaaatagccgatcttgacgatctcgaagcgattttaagtttaggttttcgtggcgaggcattagctagtatcagttccgtatcacgcctaacccttacttctcgtaccgaagaacaaactgaagcgtggcaagtttatgcgcaaggtcgtgatatggaaaccacaatcaaaccagcatcacatcctgtcggcacaacagttgaagttgccaatctttttttcaacacgccagcccgccgaaaatttttgcgcacagataaaacagaatttgctcatattgatgaagtcattcgtcgcattgctttaacaaaattcaatacggcatttacattaacgcataatgggaaaattatccgtcaataccgtcctgccgaagcaatcaatcaacaactaaaacgtgtcgccgcgattgtggggtaccgagtccgaattcgaatacagnnnnnt

SEQ ID NO: 2496 - protein, 227 aa, Haemophilus influenzae
  Xaa 226, 227: Xaa is any amino acid
  Name: NTH1389
MPIKILSPQLANQIAAGEVVERPASVVKELVENSLDAGANKIQIDIENGGANLIRIRDNGCGIPKEELSLALARHATSKIADLDDLEAILSLGFRGEALASISSVSRLTLTSRTEEQTEAWQVYAQGRDMETTIKPASHPVGTTVEVANLFFNTPARRKFLRTDKTEFAHIDEVIRRIALTKFNTAFTLTHNGKIIRQYRPAEAINQQLKRVAAIVGYRVRIRIQXX

SEQ ID NO: 2497 - DNA, 189 bp, Haemophilus influenzae
  Name: NTH1390
atggaagagtccctagaattagaaaaattgccacgaatcattactgatgtattgaaaattgtgctttgtacagcgttgattgcgctagcgattgtgcttattattgcccttgtaaaaataacttatactttatctatgatggtgcttaacacttcgtctgttgtaccttatgatgttgctgaacagcag

SEQ ID NO: 2498 - protein, 63 aa, Haemophilus influenzae
  Name: NTH1390
MEESLELEKLPRIITDVLKIVLCTALIALAIVLIIALVKITYTLSMMVLNTSSVVPYDVAEQQ

SEQ ID NO: 2499 - DNA, 225 bp, Haemophilus influenzae
  Name: NTH1391
atgtttttcttatatttcgggtttattggtttgattgtgcagtattttaaaagcggatatcacttccctttacgctattttatttatgctgggatcactgcgatgttgcgtttaatcattgttaatcatgaaagctcggtggataccatcttatttgcaggcgcaattttgattatggtgatcgcactctgtttggtgttatattctaataaactgaaaaatata

SEQ ID NO: 2500 - protein, 75 aa, Haemophilus influenzae
  Name: NTH1391
MFFLYFGFIGLIVQYFKSGYHFPLRYFIYAGITAMLRLIIVNHESSVDTILFAGAILIMVIALCLVLYSNKLKNI

SEQ ID NO: 2501 - DNA, 741 bp, Haemophilus influenzae
  Name: NTH1392
atggctcgtcgcaataaagaagtattaaaactcgcggtagaaatttatcttcgctctaaagcctatcaagctctagataaaattttagacaatgttgcgaatagcggtttattcaatgatgaagaattcaaagatcttcgatctaaaaccgaaaatggtttactcgacgagaaaatgaacgaagaaggaattgatggcttactaacttggtggaatcagcaacctcgtcatcgccgtaacaatattgaacttaaaattagccttattcaacgtttaattgactgtaatgatcatgaatcagctactgaattgacatttgaaatactgaaaaaactcggtgacaatacagcaatcagtttacctctttgtactcaaattacacgtttacaaccagaagataacagtaaacttctcaagctaatagaaaaacgtgcaaaacgtgtggatgaaaaacaaaaatgctgtatcaatcgtgctttgggttatttatatgttcgtaacaatgaatttattaaagcagcagatgtattcaaaaacgtgatcgcttgccctgaacaattagaacaaaatgatttgatgatggcatcttatgtatttgaacaagcgggcgataaagcattagctgaacaagttcgccaagagagtttgaaatcagtgatggcaattcaggatgtcattccagaaagtgcggaagaaaaaacagaagaaaattcaaccgcacttttagaaagcaaatctgag

SEQ ID NO: 2502 - protein, 247 aa, Haemophilus influenzae
  Name: NTH1392
MARRNKEVLKLAVEIYLRSKAYQALDKILDNVANSGLFNDEEFKDLRSKTENGLLDEKMNEEGIDGLLTWWNQQPRHRRNNIELKISLIQRLIDCNDHESATELTFEILKKLGDNTAISLPLCTQITRLQPEDNSKLLKLIEKRAKRVDEKQKCCINRALGYLYVRNNEFIKAADVFKNVIACPEQLEQNDLMMASYVFEQAGDKALAEQVRQESLKSVMAIQDVIPESAEEKTEENSTALLESKSE

SEQ ID NO: 2503 - DNA, 525 bp, Haemophilus influenzae
  Name: NTH1393
atgtttagagtgctctttttaatgctgacattgcttgtaggacttgtagcagggccttatatttctggtcagcaaggttatgtgcgcattgagacagcaaatcgtattatagaaatgtccatcactaccttagtgatttttttcattatttctttagcaataatttatgcttttgaatggggcatcactcgtttctttcgtttaagtcgtagctcttatcaatggttttctaatcgcaaacgtgtaaaagcgcaaaaacaaacccttgaaggcttggtaaaaatgaatgaaggggattacgctaaagcagaaaaattaattggcaaaaatgctaaacattctgctgaacctgtactaaatctcatcaaagcagcagaagctgctcaacaacgtggcgacgaatttagtgcaaatcgctatttaattgaagcgacagaattagccggctctgataatttgctcgtggaaattgcccgtactcgcattttattgcaacaaacaagttacctgcagcacgcagttctg

SEQ ID NO: 2504 - protein, 175 aa, Haemophilus influenzae
  Name: NTH1393
MFRVLFLMLTLLVGLVAGPYISGQQGYVRIETANRIIEMSITTLVIFFIISLAIIYAFEWGITRFFRLSRSSYQWFSNRKRVKAQKQTLEGLVKMNEGDYAKAEKLIGKNAKHSAEPVLNLIKAAEAAQQRGDEFSANRYLIEATELAGSDNLLVEIARTRILLQQTSYLQHAVL

SEQ ID NO: 2505 - DNA, 1131 bp, Haemophilus influenzae
  Name: NTH1394
atgcagtctgttccgcaaactattgtgaaaaaaacgggtacagcattgagtttattagcaatacttgttgcgctaggtattggtggagctggatactattttggtcagcaacaaatagctgaaattcaacagaaattaaccgcacttgaaaatcaaacgggagcaaatctttcctcaaataacaccaataacaataaacgacttacacaattagaacagagtttaaaaactgcacaagaaaatatagctcaactggaacaattaattgtaagcaaaacaggggaaataacatccttacaaactcaaatgaaacaagtaagtcagcttgccatcgcacaacaaccaagcgattggttattttccgaagctgattttttactaaataatgccctgcgtaaacttgttttagataacgatgttgatacagcggtttctttattaaaattagctgatgaaaccctcgtcaaggttaataattcacaagcaaatgaaattcgtagtgcaatcaatcaagatttaaaacaacttctttcgctttcaagtgtggatcaaaatgcgataatgcaaaaactgtcacagcttgcaaacacagtcgatgaattacaggctttgaatgtaaattttgatgaaacatctaaaaataatgataaattatccaacaacattactgactggcaacaaaatattgaaaaaagtgcaacctctttcctaaatcattttattcgtatttcgccaaaacaaaattcaaataaaaaagaattacttgcaccaaatcaagatatttatcttcgtgagaacattcgtctacgtttacagcttgcgattatggcagttcctcgtcagcaaaatgaactttataagcaatctctagaagctgtttcttcttgggttcgtagctattttgatacaaacgctgaagtaacacaaaatttcttaaaattagtagatggattgactgatacttctatttatgtagatgtaccagagcaattaaaaagtttaacattacttgacaaatatcttaatcgtacagctttagatctacaaaaagtggaaattgaagcagacaaggcgattgatacaatgcctaaagtagaagctgttaaaccaacacaatctgaatcacaacaa

SEQ ID NO: 2506 - protein, 377 aa, Haemophilus influenzae
  Name: NTH1394
MQSVPQTIVKKTGTALSLLAILVALGIGGAGYYFGQQQIAEIQQKLTALENQTGANLSSNNTNNNKRLTQLEQSLKTAQENIAQLEQLIVSKTGEITSLQTQMKQVSQLAIAQQPSDWLFSEADFLLNNALRKLVLDNDVDTAVSLLKLADETLVKVNNSQANEIRSAINQDLKQLLSLSSVDQNAIMQKLSQLANTVDELQALNVNFDETSKNNDKLSNNITDWQQNIEKSATSFLNHFIRISPKQNSNKKELLAPNQDIYLRENIRLRLQLAIMAVPRQQNELYKQSLEAVSSWVRSYFDTNAEVTQNFLKLVDGLTDTSIYVDVPEQLKSLTLLDKYLNRTALDLQKVEIEADKAIDTMPKVEAVKPTQSESQQ

SEQ ID NO: 2507 - DNA, 210 bp, Haemophilus influenzae
  n 205, 206, 207, 208, 209: n is any nucleotide
  Name: NTH1395
ttgcattattcttccctagtggaaatttgtccccaattttgttgttctggaggggccccccctggaattgatttatcccaaccaaacaatgggttagcgccttggatccccccccgttttggccgccttctcaaggtcagcgaatcttccacccccttaagcgatgcgccttttattttacccttaaacaatcgaaaattccgcnnnnnt

SEQ ID NO: 2508 - protein, 70 aa, Haemophilus influenzae
  Xaa 69, 70: Xaa is any amino acid
  Name: NTH1395
LHYSSLVEICPQFCCSGGAPPGIDLSQPNNGLAPWIPPRFGRLLKVSESSTPLSDAPFILPLNNRKFRXX

SEQ ID NO: 2509 - DNA, 108 bp, Haemophilus influenzae
  Name: NTH1396
atggatatccgccgatatgtaaaatggtttgatggctttcccaaatcttattgcgcttattggattgcgaaaagtgatcatgaagaaacaaaagattattttcaacgt

SEQ ID NO: 2510 - protein, 36 aa, Haemophilus influenzae
  Name: NTH1396
MDIRRYVKWFDGFPKSYCAYWIAKSDHEETKDYFQR

SEQ ID NO: 2511 - DNA, 591 bp, Haemophilus influenzae
  Name: NTH1397
ttgcattcttgttgtgcgccttgctctggcgaagtgatggaagcaattcttgcatcaggcattgaatttacgatttatttttacaatccaaacattcatccactcaaagaatatttgattcgtaaagaagaaaatatccgttttgcaaaaaaatttggtattccatttattgatgctgattacgatcgtcaaaattggtttgatcgtgctaagggtatggaatgggagcctgagagaggtattcgctgcacaatgtgttttgatatgcgctttgaaaaagctgctgaatatgctcatgaacatggtttccctgtatttactagttgcttgggaatttctcgctggaaggatatgaatcaaatcaatggctgtgggcatcgagctgcggaaaaatatgatgatgtagtttattgggattataactggcgcaaggaaggtggttcacagcgtatgattgaaattagtaagcgtgagcggttttatcaacaggaatattgcggttgtgtgtattctttacgtgatagtaataaatggcgagaagagacgggtcgtcaaaaaattgaaatcggaaaattatattatagtgctgat

SEQ ID NO: 2512 - protein, 197 aa, Haemophilus influenzae
  Name: NTH1397
LHSCCAPCSGEVMEAILASGIEFTIYFYNPNIHPLKEYLIRKEENIRFAKKFGIPFIDADYDRQNWFDRAKGMEWEPERGIRCTMCFDMRFEKAAEYAHEHGFPVFTSCLGISRWKDMNQINGCGHRAAEKYDDVVYWDYNWRKEGGSQRMIEISKRERFYQQEYCGCVYSLRDSNKWREETGRQKIEIGKLYYSAD

SEQ ID NO: 2513 - DNA, 582 bp, Haemophilus influenzae
  n 577, 578, 579, 580, 581: n is any nucleotide
  Name: NTH1398
gtgttttctttttgcctacttttgctttgcatgagcaaagaaaaagtaggtcgccatcggcgaaacccgaaattaaataaaataaaagaagaaattatggaatttaccgacctacaaatattcatccacctcagtgatacaaaaaacttcgccaaaactgccacccaaaaccacatgtctccctctaccctttcccgtcaaattcaacgattggaagacgagttagggaagacactttttatccgtgataatcgccaagtcaaacttactgaatatggcgagaaatttttgcaatttgctaaaacagaatggcaaaactggcaacaatttaaacaacaactgaaagataaatccgatgaattttgcggtgaaattaaacttttttgttctgtaaccgcatcttatagccatcttcctcacgtacttaaagaatttcgccagcgttatcctaaagtggaaattcaactgactacgggtgatccagcgttagcactagaattaattcaagcgcaacaagtcgtatcgcgctgcggggaaaccaaaaatcgggtaccgaggctgatattcgtataccagnnnnnt

SEQ ID NO: 2514 - protein, 194 aa, Haemophilus influenzae
  Xaa 193, 194: Xaa is any amino acid
  Name: NTH1398
VFSFCLLLLCMSKEKVGRHRRNPKLNKIKEEIMEFTDLQIFIHLSDTKNFAKTATQNHMSPSTLSRQIQRLEDELGKTLFIRDNRQVKLTEYGEKFLQFAKTEWQNWQQFKQQLKDKSDEFCGEIKLFCSVTASYSHLPHVLKEFRQRYPKVEIQLTTGDPALALELIQAQQVVSRCGETKNRVPRLIFVYQXX

SEQ ID NO: 2515 - DNA, 207 bp, Haemophilus influenzae
  Name: NTH1399
atgttgcgatttgtgcaattatgttggttttttggggattgcatcgtatttcgctcgatgagcgacctactttattttactcgtgtaaaagaagtaggcaaagaaaacacgccccaattaaatcgcagctctttgctttgtttcaattttcttaacggcaatttgctgaactcgctacgctcaaacaaacgcaaattgcctgaaaat

SEQ ID NO: 2516 - protein, 69 aa, Haemophilus influenzae
  Name: NTH1399
MLRFVQLCWFFGDCIVFRSMSDLLYFTRVKEVGKENTPQLNRSSLLCFNFLNGNLLNSLRSNKRKLPEN

SEQ ID NO: 2517 - DNA, 1476 bp, Haemophilus influenzae
  Name: NTH1400
atggctaactatttcaacacattaaatttacgtcaaaaattagaccaattaggtcgttgtcgttttatggatcgcgaagaatttgcagatgaagcaaacttcttaaaaggcaaaaaaatcgttatcgtgggctgtggtgcgcaaggtttaaaccaaggtttgaatatgcgtgattctggcttagatattagctatgccttacgtcctgaagcaattgctgaaaaacgtgcgtcattccaacgtgcaactgaaaatggttttaaagtgggtacttatgaagaattgatcccaactgcagatttagtcgtaaacttaacaccagacaaacaacactctaaagtggttgctgatgtgatgcctttaatgaaaaaagactctgcatttggttattcacacggtttcaacattgttgaagttggcgaagaaatccgtaaagacattacggttgtgatggttgcaccaaaatgcccgggtactgaagtacgtgaagaatacaaacgtggtttcggtgtgccaacattaattgcggttcatcctgaaaatgacccgaaaggcgaaggcttggcgatcgcgaaagcttgggctgctgcaacaggcggtcataaagcaggtgttttagaatcttcattcgtggcagaagtaaaatctgacttaatgggtgagcaaactatcctttgcggtatgttacaagcaggttctatcgtatgttatgacaaattagtggctgacggtaaagatcctgcatacgcaggtaaattaatccaatacggttgggaaaccattaccgaagcgttaaaacaaggtggtatcacattaatgatggatcgcctatcaaacagcgcaaaattacgtgcatttgaacttgctgaacaaattaaagaaagccttggtttcttatattacaaacacatggatgacatcatcagcggtcacttctctgcaaccatgatggcagactgggcaaatggcgataaagatttattcgcatggcgtgaagcaacaggtaaaacagcctttgaaaatgcaccaaaatatgatggcaaaattagcgaacaagaatactttgataacggtgtattaatgattgcaatggttaaagctggtgtagaattagcctttgatgcgatggttgcaagcggtatttatgaagaatcagcttactatgaatcacttcatgaattaccattaattgcgaacaccatcgcacgtaaacgcttatacgaaatgaacgtagtaatttcagataccgcagaatatggtaactacttattctctaacgtagcaaccccaattcttgcaaaagaaattatacccaaccttcaaaaaggtgacttgggcgagcctactccagcagtggaaatcgataacatcaccttacgcgatgtaaacgatgcaattcgtaaccaccctgttgaattaatcggtcaagaattacgtggttatatgacagatatgaaacgtattgctgttgcaggt

SEQ ID NO: 2518 - protein, 492 aa, Haemophilus influenzae
  Name: NTH1400
MANYFNTLNLRQKLDQLGRCRFMDREEFADEANFLKGKKIVIVGCGAQGLNQGLNMRDSGLDISYALRPEAIAEKRASFQRATENGFKVGTYEELIPTADLVVNLTPDKQHSKVVADVMPLMKKDSAFGYSHGFNIVEVGEEIRKDITVVMVAPKCPGTEVREEYKRGFGVPTLIAVHPENDPKGEGLAIAKAWAAATGGHKAGVLESSFVAEVKSDLMGEQTILCGMLQAGSIVCYDKLVADGKDPAYAGKLIQYGWETITEALKQGGITLMMDRLSNSAKLRAFELAEQIKESLGFLYYKHMDDIISGHFSATMMADWANGDKDLFAWREATGKTAFENAPKYDGKISEQEYFDNGVLMIAMVKAGVELAFDAMVASGIYEESAYYESLHELPLIANTIARKRLYEMNVVISDTAEYGNYLFSNVATPILAKEIIPNLQKGDLGEPTPAVEIDNITLRDVNDAIRNHPVELIGQELRGYMTDMKRIAVAG

SEQ ID NO: 2519 - DNA, 1278 bp, Haemophilus influenzae
  Name: NTH1401
atggataataatattcaacgactcattgatagtgcaaaacaatcccttaattcgcctgaaagccataaatatatcgacgaaagttttgaaagctgtattaaatgtacggcttgtactgctgtttgtccggtttcacgcaacaatccgctttatcctggtccaaaacaatcagggcctgatggcgagcgtttacgcttaaaatcagcagaactttatgatgaagcacttaaatattgcaccaactgtaaacgttgtgaagtggcttgtccgtctgatgtgaaaattggcgatttaattgtacgtgcgcgtaataatcacttagcgcagtctaaaaaaccgttaatgaataaattgcgtgatgcgattttaagtaacacagatgttatgggtaaaattaatacgccattagcaccgattgtaaacaccatcacaagcctaaaagccaccaaatttatgttggaaaaaacgcttaaaatcagtaaagaacgtactttacctaaatatgcgtttggcacgttccgtagttggtatatgaaaaatgcgttacaagaccaacaaaaatttgagcgaaaagtagcatatttccacggttgttatgttaattataataatccacagcttggcaaagaatttcttaaagtgttcaatgcaatgaatattggggtaatgttattagaaaaagaaaaatgctgtggcttaccattaatggtaaacggttttcctaatcgcgctcgtaatattgcacaattcaataccgattacattggaaaaatggtagatgaaaatggaatagatgtgattagtgaggcatcaagttgctcgcttaatttacgcgacgaataccatcatattttaggtatcgacaacgccaaagtccgtccgcatatccatatggtaaccccatttttatatcagcttttcaaagaaggtaaaacattaccgttgaaaccacttaaacttcgagtggcttatcacaccgcttgtcacgtagataaagctggttgggcaccttatactttggaagtattgaaaaaaattccgggtttagaaatcattatgttaccaagccaatgttgtggtattgcggggacttacggttttaaatcagaaaactatgaaatttcacaatctattggtaaaaatctattcgataatattaacgagggtggatttgattacgttatatctgaatgtcaaacctgtaaatggcaaattgatatgtcatctaacgtaacttgtattcatccattaactttactttgtatgtcgatggatgct

SEQ ID NO: 2520 - protein, 426 aa, Haemophilus influenzae
  Name: NTH1401
MDNNIQRLIDSAKQSLNSPESHKYIDESFESCIKCTACTAVCPVSRNNPLYPGPKQSGPDGERLRLKSAELYDEALKYCTNCKRCEVACPSDVKIGDLIVRARNNHLAQSKKPLMNKLRDAILSNTDVMGKINTPLAPIVNTITSLKATKFMLEKTLKISKERTLPKYAFGTFRSWYMKNALQDQQKFERKVAYFHGCYVNYNNPQLGKEFLKVFNAMNIGVMLLEKEKCCGLPLMVNGFPNRARNIAQFNTDYIGKMVDENGIDVISEASSCSLNLRDEYHHILGIDNAKVRPHIHMVTPFLYQLFKEGKTLPLKPLKLRVAYHTACHVDKAGWAPYTLEVLKKIPGLEIIMLPSQCCGIAGTYGFKSENYEISQSIGKNLFDNINEGGFDYVISECQTCKWQIDMSSNVTCIHPLTLLCMSMDA

SEQ ID NO: 2521 - DNA, 90 bp, Haemophilus influenzae
  Name: NTH1402
atgtggataggggtaatttcattattccccgaaatgtttaaagcgattacggaatttggggttacaggtagagccgtaaaacatatcttc

SEQ ID NO: 2522 - protein, 30 aa, Haemophilus influenzae
  Name: NTH1402
MWIGVISLFPEMFKAITEFGVTGRAVKHIF

SEQ ID NO: 2523 - DNA, 177 bp, Haemophilus influenzae
  Name: NTH1403
atgggaacagtaacagaaatgatggaaacgggttctaatgatgtattagtggttaaagccaataccaaagatgcttttggaaaacaagagcggttaattccgtttttgtatgaacaagtagttaaaagagtcgatctcaccacaaaaacaattgaagtggattgggacgctggtttc

SEQ ID NO: 2524 - protein, 59 aa, Haemophilus influenzae
  Name: NTH1403
MGTVTEMMETGSNDVLVVKANTKDAFGKQERLIPFLYEQVVKRVDLTTKTIEVDWDAGF

SEQ ID NO: 2525 - DNA, 243 bp, Haemophilus influenzae
  Name: NTH1404
gtgaaaaatatggaacaacaacatattgaagttgtgggcaaattaggctcaacctacggtattcgtgggtggttgcgtatttattcatcaacagaacaagctgaaagcatttttgattatcaaccttggtttttaaaaatcaaaggtgaatggcaatcaattgaattagaaaactggcgttatcataatcacgaaatcatcgttaaattaaaaggcgttgatgaccgtgaaactgcacaattt

SEQ ID NO: 2526 - protein, 81 aa, Haemophilus influenzae
  Name: NTH1404
VKNMEQQHIEVVGKLGSTYGIRGWLRIYSSTEQAESIFDYQPWFLKIKGEWQSIELENWRYHNHEIIVKLKGVDDRETAQF

SEQ ID NO: 2527 - DNA, 246 bp, Haemophilus influenzae
  Name: NTH1405
atggtaaccattcgtttatctcgtggcggagctaaaaaacgcccattttatcaaatcgtagtcgctgacagtcgttcacctcgtgacggtcgcttcattgaacgtgtaggtttcttcaatccaattgcacaaggtaatgcagaacgtcttcgcattaatcttgagcgtgtaaatcactgggttgctcaaggtgcttcactttctgatcgtgttgcgagcttggtaaaagaagcacaaaaagcagca

SEQ ID NO: 2528 - protein, 82 aa, Haemophilus influenzae
  Name: NTH1405
MVTIRLSRGGAKKRPFYQIVVADSRSPRDGRFIERVGFFNPIAQGNAERLRINLERVNHWVAQGASLSDRVASLVKEAQKAA

SEQ ID NO: 2529 - DNA, 783 bp, Haemophilus influenzae
  Name: NTH1406
atgaggtttattatgaaaattagttttcattctgtgttaattggattagcatcatttattggtgttcaacaaggtgtaatagctagtccatcttctcatcaatcaatatccactgaatcagctgaggctttgaagcaacaattttcaatggctttagctaaacaagacaaacaacaaattacaaatttacaaaaaaaacttaccgcacttttttctttacctccccaatttcttgataatcagatccaaataagcgaaaaaatcctcactcgcatttttaaaacagataaaaatctcacgcctaaatttcttgattacttatactttgagccaataaatactgttgatgctaatttaattcaggaaatgaagaaaaacttactggtgtcttttttagcaaatgatcaggcaaaaatttatattcgtcaaacagataattcagagcaatttgttcagactttaatggagcggggagcaaaagcagatcaaattatattactgtctttgaatgccaaaggtatatttcaaaaaattattgaacaaatacgtcaagattttccgaatcagactattttttcgattactgaaaatcgtattagtttgattactccttcttcagaaattaagtctcgccttgctttagcaaatatgatgttcaatcgccaatttaaaggtgtggaagttgatgatttctcgtatttagatcaacctcgagaaaatttacagcacaataatgatgcaattcgttacaaaacctttcaagcaatgctagaaggtttaaat

SEQ ID NO: 2530 - protein, 261 aa, Haemophilus influenzae
  Name: NTH1406
MRFIMKISFHSVLIGLASFIGVQQGVIASPSSHQSISTESAEALKQQFSMALAKQDKQQITNLQKKLTALFSLPPQFLDNQIQISEKILTRIFKTDKNLTPKFLDYLYFEPINTVDANLIQEMKKNLLVSFLANDQAKIYIRQTDNSEQFVQTLMERGAKADQIILLSLNAKGIFQKIIEQIRQDFPNQTIFSITENRISLITPSSEIKSRLALANMMFNRQFKGVEVDDFSYLDQPRENLQHNNDAIRYKTFQAMLEGLN

SEQ ID NO: 2531 - DNA, 1809 bp, Haemophilus influenzae
  Name: NTH1407
atgcttttatccaaaaaatcagctacctttgcactcagtgcatttgcgatgcttttcactagtgtagctcttgccaaagaggcaccacaagctcacaaagctgtggaattaagtattttgcacatcaatgatcaccattcttatttagaaccgcacgaaacacggattaatttaaatggtcagcaaaccaaagtggatattggtggtttttctgctgtcaatgcaaaacttaacaaattgcgtaaaaaatacaaaaatccattggtactgcatgcaggcgatgccattactggtacgctttacttcacgctgtttggtggttctgcagatgcagctgtgatgaacgcaggtaattttcattattttactttaggtaatcatgaatttgacgcaggtaatgaagggttattaaaactgcttgaaccattaaaaatccctgtgctttcagctaatgtgattcctgataaaagttcaattttgtataacaaatggaaaccttacgatattttcactgtggatggagaaaaaattgccattatcggtttagataccgtgaataaaacagtgaattcctcttctccgggtaaggatgtgaagttttatgatgaaattgctactgcacaaattatggcaaatgcgctaaaacagcaaggaattaataaaattatcctactttcacacgcaggtagtgaaaaaaatatcgaaattgctcaaaaagtaaatgatattgatgtgatcgttactggcgattcacattatttatacggaaatgatgaattacgtagtttaaaacttccagtaatctatgaatatccacttgaatttaaaaatccaaatggagagcctgtatttgtaatggaaggctgggcttattctgccgtggtgggggatttaggtgttaaattcagtcctgaaggtatagcgtctattactcgtaaaattcctcacgtgttaatgagttctcataaacttcaagtgaaaaattcggaaggtaaatgggctgaattaactggcgatgaacgtaaaaaagcacttgatactttaaaatcaatgaaaagtatttcacttgatgatcacgatgcaaaaaccgataagcttattgctaaatataaaagtgaaaaagatcgcttagcacaagaaattgtgggcgttatcactggttctgcaatgccaggtggttcagcaaaccgtatcccaaataaagcaggatctaatccagaaggttctattgcaacgcgttttattgcagaaacaatgtataacgaactcaaaacagtggatttaactattcaaaatgctggcggtgtacgcgcagatattttaccgggcaatgtaacctttaacgatgcttatactttcttacctttcgggaatacgttatatacctataaaatggaaggttcgttagtgaaacaagtgcttgaagatgcgatgcaatttgctttggttgatggctctacaggcgcattcccttatggtgcaggtattcgttatgaagcgaatgaaacaccaaatgcggaaggtaaacgtttagtgagtgttgaagtcttgaataaacaaacccaacaatgggaaccgattgatgataacaaacgttatcttgtcggaacaaatgcttatgttgcaggcggtaaagacggttataaaacctttggtaaattatttaacgatccaaaatatgaaggcgttgatacctacttgcctgatgcagaaagtttcataaaatttatgaaaaaacatccgcactttgaggcttacacttcatcaaatgtgaaatttaatgcttcaactgatgcattacctaaaaaa

SEQ ID NO: 2532 - protein, 603 aa, Haemophilus influenzae
  Name: NTH1407
MLLSKKSATFALSAFAMLFTSVALAKEAPQAHKAVELSILHINDHHSYLEPHETRINLNGQQTKVDIGGFSAVNAKLNKLRKKYKNPLVLHAGDAITGTLYFTLFGGSADAAVMNAGNFHYFTLGNHEFDAGNEGLLKLLEPLKIPVLSANVIPDKSSILYNKWKPYDIFTVDGEKIAIIGLDTVNKTVNSSSPGKDVKFYDEIATAQIMANALKQQGINKIILLSHAGSEKNIEIAQKVNDIDVIVTGDSHYLYGNDELRSLKLPVIYEYPLEFKNPNGEPVFVMEGWAYSAVVGDLGVKFSPEGIASITRKIPHVLMSSHKLQVKNSEGKWAELTGDERKKALDTLKSMKSISLDDHDAKTDKLIAKYKSEKDRLAQEIVGVITGSAMPGGSANRIPNKAGSNPEGSIATRFIAETMYNELKTVDLTIQNAGGVRADILPGNVTFNDAYTFLPFGNTLYTYKMEGSLVKQVLEDAMQFALVDGSTGAFPYGAGIRYEANETPNAEGKRLVSVEVLNKQTQQWEPIDDNKRYLVGTNAYVAGGKDGYKTFGKLFNDPKYEGVDTYLPDAESFIKFMKKHPHFEAYTSSNVKFNASTDALPKK

SEQ ID NO: 2533 - DNA, 384 bp, Haemophilus influenzae
  n 379, 380, 381, 382, 383: n is any nucleotide
  Name: NTH1408
atggcggaaaaacgtaatatttttttagtaggaccaatgggtgcaggtaaaagtactatcggtcgtcaattagcacaacagcttaatatggattttattgattccgatgcagtgattgaagaacgtacgggcgcggatattagctggatttttgatttggaaggcgaagacggcttccgaaaacgtgaagaacgcattattaacgaactcacacaaatgcaaggtattgtactttcaactgggggggggagcgcgtcttctatggatacccgtccctattattcccccctgggcattgattttctcctacacccaccgccgcaaaatctcctccctgcccgctccgtttttattcccgcccttgtccctgccgcccgcnnnnnt

SEQ ID NO: 2534 - protein, 128 aa, Haemophilus influenzae
  Xaa 127, 128: Xaa is any amino acid
  Name: NTH1408
MAEKRNIFLVGPMGAGKSTIGRQLAQQLNMDFIDSDAVIEERTGADISWIFDLEGEDGFRKREERIINELTQMQGIVLSTGGGSASSMDTRPYYSPLGIDFLLHPPPQNLLPARSVFIPALVPAARXX

SEQ ID NO: 2535 - DNA, 579 bp, Haemophilus influenzae
  Name: NTH1409
gtgcggttagatttgtggcaaattttggtttccaaaattttttacggaacaacgttttggcgggaaggtcataacctcacgcaagcattgcgttgggctcaaggggaaatcaaggtaaaagatcgcaaaaaacgcagtttttatctttccgccgcgcgcagtgaaatttttaatctggttgtggctgcgcgtattgcaaagggcgcaacaaatcaagttttaccaaatgatattgtgcaattagcaggttcgcacagttggttcaaagcggatgaaaaagaagacttaactgtcttgcaagtgcggttagaaaatcaagatattttactcactgctcctttaattggcgaagatattttagcagcaagcgatattgaaaatgaaatcgtaaatcaacattcagctttcgattctttaatgaaacaagaaagaatgaaagcagtgcgtcgcccattgttaatgaaagcaaaagggttttcttgggcatttgagccagaaggcttgcgtttaaaattttatttgccagcaggcagttatgccacggcattagttcgtgagttagtaaattacacagaagaa

SEQ ID NO: 2536 - protein, 193 aa, Haemophilus influenzae
  Name: NTH1409
VRLDLWQILVSKIFYGTTFWREGHNLTQALRWAQGEIKVKDRKKRSFYLSAARSEIFNLVVAARIAKGATNQVLPNDIVQLAGSHSWFKADEKEDLTVLQVRLENQDILLTAPLIGEDILAASDIENEIVNQHSAFDSLMKQERMKAVRRPLLMKAKGFSWAFEPEGLRLKFYLPAGSYATALVRELVNYTEE

SEQ ID NO: 2537 - DNA, 747 bp, Haemophilus influenzae
  Name: NTH1410
atgcgaattttagttagtaatgatgatggttttcatgcggaaggcattcaagttttagcaatggaattaagaaaaattgcagaagtcattattgttgcacccgatcgtaatcgaagtgcagcatcaagctcgctcacattggttgagccattgcgcccacgccatttagataatggcgattattgtgtaaatggcacacctgcagattgtgtacatttagcgttaaatggatttttatctggccaagtagatttagtggtatcgggcattaatgcgggttgtaatatgggcgatgatacgatttattcaggcacattagctgcagcccttgagggtcgtcatttaggtttgcccgctattgcagtttcgttagatggtcgtcagcattatgaaacagcagcacgagtggtatgtgatctcattccaaaattacatcatcaattattaaaccctcgtgaaattattaatatcaatgtgcctgatttgctttttgaagaattaaaaggctacaaagtttgtcgcttgggttaccgtgcatcttcagcagaagtgattaagcaaaaagatccgcgtgatgaaaccatttattggattggcccttcagcattacccgaagatgaaagcgaaggaacagatttttatgccgtgaagaatggttatgtgtctatcacaccaattcaagcggatcttaccgcatatcattcattgctttctttgcaaaattggttagagcaggaatttaccaaa

SEQ ID NO: 2538 - protein, 249 aa, Haemophilus influenzae
  Name: NTH1410
MRILVSNDDGFHAEGIQVLAMELRKIAEVIIVAPDRNRSAASSSLTLVEPLRPRHLDNGDYCVNGTPADCVHLALNGFLSGQVDLVVSGINAGCNMGDDTIYSGTLAAALEGRHLGLPAIAVSLDGRQHYETAARVVCDLIPKLHHQLLNPREIININVPDLLFEELKGYKVCRLGYRASSAEVIKQKDPRDETIYWIGPSALPEDESEGTDFYAVKNGYVSITPIQADLTAYHSLLSLQNWLEQEFTK

SEQ ID NO: 2539 - DNA, 384 bp, Haemophilus influenzae
  Name: NTH1411
ttggttagagcaggaatttaccaaatagagaaaaatatgaaaattttcggcacgatgtacgataaaacgatggaatggtcaaaacatcgttttgctgttttttggctctcttttgtaagttttatcgaggcgatattttttcctattccgcccgatgtgatgctgatcccaatgtctatgtcaaagccaaaaagtgcggtgaaatttgcattttatacggcaattgcgtctgtaatcggcggaattatcggttatgctattggtttttatgcaacgggctgggtggaaaacattgtgcaacaatggggatatgctgcgcattgggcaaaagccgtcagttggtttgagcaatggggcgtattagttgggtttgtggcggggttt

SEQ ID NO: 2540 - protein, 128 aa, Haemophilus influenzae
  Name: NTH1411
LVRAGIYQIEKNMKIFGTMYDKTMEWSKHRFAVFWLSFVSFIEAIFFPIPPDVMLIPMSMSKPKSAVKFAFYTAIASVIGGIIGYAIGFYATGWVENIVQQWGYAAHWAKAVSWFEQWGVLVGFVAGF

SEQ ID NO: 2541 - DNA, 222 bp, Haemophilus influenzae
  Name: NTH1412
ttgggtttgtggcggggttttagcccaattccttacaaggggtttacgctctgcgctggagtaatgcaaatggcatttttcccttttgttatcaccgcattttgtttcacgtttagcacgtttcttgctagtagcaaattagctgatggggggcggggaaaattccagcaaaattggcgaaatctattgagattattggctggtcagtggttgtactggcta

SEQ ID NO: 2542 - protein, 74 aa, Haemophilus influenzae
  Name: NTH1412
LGLWRGFSPIPYKGFTLCAGVMQMAFFPFVITAFCFTFSTFLASSKLADGGRGKFQQNWRNLLRLLAGQWLYWL

SEQ ID NO: 2543 - DNA, 183 bp, Haemophilus influenzae
  Name: NTH1413
atgaacaaattaagtcttgttttagtagctggatatcttttggttggatgtgcatcagaaccagttaaagatccagatgcattaccaaatggcattatgcaaccagtagaaggcacaggtgccgttgctggcggtagttttatgccagaaattcaaaaaaatacgataccaacacaaatgaaa

SEQ ID NO: 2544 - protein, 61 aa, Haemophilus influenzae
  Name: NTH1413
MNKLSLVLVAGYLLVGCASEPVKDPDALPNGIMQPVEGTGAVAGGSFMPEIQKNTIPTQMK

SEQ ID NO: 2545 - DNA, 126 bp, Haemophilus influenzae
  Name: NTH1414
gtgacggctggtttagctggcattgctgttgatgccgtgactgcaggttgttttacagaaaccgttgtagtaaccgtttttgtgccacaattagaaatctttaaaacttgccctaaacttaaatta

SEQ ID NO: 2546 - protein, 42 aa, Haemophilus influenzae
  Name: NTH1414
VTAGLAGIAVDAVTAGCFTETVVVTVFVPQLEIFKTCPKLKL

SEQ ID NO: 2547 - DNA, 120 bp, Haemophilus influenzae
  Name: NTH1415
gtgctattcgcattatttacagatgatgtaacctgtgttgatgaagttgccacagatacactagacgatatgccagcctctgatttaatggggccaataatagtaccgtcagatcctatt

SEQ ID NO: 2548 - protein, 40 aa, Haemophilus influenzae
  Name: NTH1415
VLFALFTDDVTCVDEVATDTLDDMPASDLMGPIIVPSDPI

SEQ ID NO: 2549 - DNA, 1062 bp, Haemophilus influenzae
  Name: NTH1416
atgaacaaatcgtttctcttactccctttaagtcttgttgtattatcggcttgtacctctaattctcctgcacctatttctgatgcagatggaaatctttcccctagtgtagtgcaatctgtaaatggcagtaatgtaggtggtgcttggcaacctgaaattcaaaaaaattcattacctacaatgggaaatatggtcacaccacaaccaaattttcaaccgattaatcaacaaccagcaatgccaactaaacctgcacaacctgcatttcaaccctctccgaaaacggtagttagcgcaccgacagtacaaacaaaaacagttaccaaaacaattgctgattgtgtagatggacagcatattaatatcccacgtaatccaaataccaatgcgccagattacagcaaaatttcaaaaggctcttacaaaggcaatacctataaagtaaacaaaggcgatacaatgttcttgattgcttacttagcaggaattgatgtaaaagaattggcagcgttgaataacctatccgaaccttataatttaagtttagggcaagttttaaagatttctaattgtggcacaaaaacggttactacaacggtttctgtaaaacaacctgcagtcacggcatcaacagcaatgccagctaaaccagccgtcacttatactccgggcgcaaacggtactcaaataggatctgacggtactattattggccccattaaatcagaggctggcatatcgtctagtgtatctgtggcaacttcatcaacacaggttacatcatctgtaaataatgcgaatagcacaccgattaatgcaaatgtcgttgcaccaatcgcctcaaatgttgcgtggcaatggccgacttcaggtaatattattcaaggtttctcaagcacagatggcggtaacaaagggattgatattagcggttcacgaggacaagctgtaaaagcggctgcagcagggcgaatagtgtatgctggcaatgcttttacgtggtacggtaatttaatcatcatcaaacataatgatgatttcctaagtgcttatggcgca

SEQ ID NO: 2550 - protein, 354 aa, Haemophilus influenzae
  Name: NTH1416
MNKSFLLLPLSLVVLSACTSNSPAPISDADGNLSPSVVQSVNGSNVGGAWQPEIQKNSLPTMGNMVTPQPNFQPINQQPAMPTKPAQPAFQPSPKTVVSAPTVQTKTVTKTIADCVDGQHINIPRNPNTNAPDYSKISKGSYKGNTYKVNKGDTMFLIAYLAGIDVKELAALNNLSEPYNLSLGQVLKISNCGTKTVTTTVSVKQPAVTASTAMPAKPAVTYTPGANGTQIGSDGTIIGPIKSEAGISSSVSVATSSTQVTSSVNNANSTPINANVVAPIASNVAWQWPTSGNIIQGFSSTDGGNKGIDISGSRGQAVKAAAAGRIVYAGNAFTWYGNLIIIKHNDDFLSAYGA

SEQ ID NO: 2551 - DNA, 168 bp, Haemophilus influenzae
  Name: NTH1417
gtgcttatggcgcataacgacaaaattcttgttgctgatcaacaagaagtcaaagctggtcaagacatcgccaaaatgggtagctctggtacaaataccgtgaaactccactttgaaattcgctacaaaggcaaatcagtagatccagtgcgttatctaccaaaacgt

SEQ ID NO: 2552 - protein, 56 aa, Haemophilus influenzae
  Name: NTH1417
VLMAHNDKILVADQQEVKAGQDIAKMGSSGTNTVKLHFEIRYKGKSVDPVRYLPKR

SEQ ID NO: 2553 - DNA, 120 bp, Haemophilus influenzae
  n 24, 98: n is any nucleotide
  Name: NTH1418
ttgtcatctattatttttttattntgggatactcctcacagaatatttttaataaaaaagtgcggtaaaaatttgttgagattttttaccgcactttntaaagagatcttaacgttttgg

SEQ ID NO: 2554 - protein, 40 aa, Haemophilus influenzae
  Xaa 8, 33: Xaa is any amino acid
  Name: NTH1418
LSSIIFLXWDTPHRIFLIKKCGKNLLRFFTALXKEILTFW

SEQ ID NO: 2555 - DNA, 1179 bp, Haemophilus influenzae
  Name: NTH1419
atggaaaattttaaacatttacctgaacctttccgcattcgtgttattgaaccagtaaaaagaactactcgtgagtatcgtgaacaagcgatgttaaaatcaggcatgaatccatttttattagatagtgaagatattttcattgacttacttacagatagcggtactggtgccgttacacaagatatgcaagctgcaatgttacgtggcgatgaagcctatagtggcagtcgcagttattatgcgctagctaaagcagtgaaagatatttttggttacgaatatacaatccctactcaccaaggtcgcggtgctgaacaaatttatattccagtattgattgctaaacgtgaacgtgagaaaggtttagatcgcagcaaaatggtggttttctctaactatttctttgataccacacaaggacatagccaaattaatggggcaacggttcgcaatgtttatatcaaagaggcatttgatacaacagcaaaacatccatttaagggtaatttcgatttagaaaaattagaaaaaggcattcaagaggcgggagcacataatgtaccttacattgtatgtaccattacttgtaactctgcgggtggtcagccagtttctattgcaaacttaaaaggcatgtatgaaattgcgcgtaaatacgatattccagtcatcatggattcagctcgttttgcagaaaacgcctattttgttcaacaacgtgaagaagcttataaagactggactattgaacaaattacttacgaaagctatcgctatgctgatggtttagcgatgtccgccaaaaaagatgcgatggtgccaatggggggtattttagcgtttaaagataaatcaatggaggaagtctatcacgaatgtagaacgctttgtgttgtgcaggaagggttccctacttatggaggtttagaaggtggtgcaatggaacgtttggctgttggcttgcatgatggtatgcgccaagaatggctggcttatcgtattgcgcagattgaatattcggttgcaggcttacaaaaaattggcgtgccttgccaacaaccaggtggacacacgacgctcgtagatgctgttaaattattaccacatattgcaggcgaccaatttccagcacaagcgctttgttgcgaactttatgacggtgcaggtacaagatcg

SEQ ID NO: 2556 - protein, 393 aa, Haemophilus influenzae
  Name: NTH1419
MENFKHLPEPFRIRVIEPVKRTTREYREQAMLKSGMNPFLLDSEDIFIDLLTDSGTGAVTQDMQAAMLRGDEAYSGSRSYYALAKAVKDIFGYEYTIPTHQGRGAEQIYIPVLIAKREREKGLDRSKMVVFSNYFFDTTQGHSQINGATVRNVYIKEAFDTTAKHPFKGNFDLEKLEKGIQEAGAHNVPYIVCTITCNSAGGQPVSIANLKGMYEIARKYDIPVIMDSARFAENAYFVQQREEAYKDWTIEQITYESYRYADGLAMSAKKDAMVPMGGILAFKDKSMEEVYHECRTLCVVQEGFPTYGGLEGGAMERLAVGLHDGMRQEWLAYRIAQIEYSVAGLQKIGVPCQQPGGHTTLVDAVKLLPHIAGDQFPAQALCCELYDGAGTRS

SEQ ID NO: 2557 - DNA, 186 bp, Haemophilus influenzae
  Name: NTH1420
ttgcctaattccttattttcaccttctacctcaatcgcatctgctattgctaacgaatttaatgaagcaggtggattacaaaaatctgcattgatggaattaggattacttctctttgttatcacaactatggtattgattttatcaagattaatgattacaaaaatgcaacaaacaaaagggaaa

SEQ ID NO: 2558 - protein, 62 aa, Haemophilus influenzae
  Name: NTH1420
LPNSLFSPSTSIASAIANEFNEAGGLQKSALMELGLLLFVITTMVLILSRLMITKMQQTKGK

SEQ ID NO: 2559 - DNA, 846 bp, Haemophilus influenzae
  Name: NTH1421
atgaaaactaatcaaaacttgcgtttttattggcgtaaaacacacaataaattaatgttagggctttcctatatttcagtcattatcggcttattttggttgtgttggatattattcactctaattaccaaaggcattccagctttatcaattgatttattcacacaatctacccctgcccctaatgaaaaagggggattgttaaatgcactgattggttcgttttttattgtcggtgcgggtacattgataggcacgcctataggggtattggcaggaacgtatttggcagaatatggtcgttatagccgtttcgcacaaattacccgttttcttaatgatattcttctttctgccccttctattattattggtttgtttgtttacagcttatatgtatcaaaaatcgagcatttttcagggtgggctggagcattcgcattagctttattgcttattcctatcgtggtacgcactacggacaatatgttattacttgtaccaaataatttacgtgaagcagcggcagctcttggttgctctcaatggcaagttattatgatgatttgttatcgagcagctaaatcagggattttaactggcgtgctattagcagttgcccgaatttcaggagaaactgcaccgctattatttaccgctctgtctaatcaatttctatcttggaatatgaatgaacctatcgcaaatttacctgtagttatttatcaatatgcagcaagtccttttacagattggaataatctagcttgggcaggtgcagctctaataacattatttgtgctttgcttaaacattttcactcgactcttctttcaacataaaaaa

SEQ ID NO: 2560 - protein, 282 aa, Haemophilus influenzae
  Name: NTH1421
MKTNQNLRFYWRKTHNKLMLGLSYISVIIGLFWLCWILFTLITKGIPALSIDLFTQSTPAPNEKGGLLNALIGSFFIVGAGTLIGTPIGVLAGTYLAEYGRYSRFAQITRFLNDILLSAPSIIIGLFVYSLYVSKIEHFSGWAGAFALALLLIPIVVRTTDNMLLLVPNNLREAAAALGCSQWQVIMMICYRAAKSGILTGVLLAVARISGETAPLLFTALSNQFLSWNMNEPIANLPVVIYQYAASPFTDWNNLAWAGAALITLFVLCLNIFTRLFFQHKK

SEQ ID NO: 2561 - DNA, 765 bp, Haemophilus influenzae
  Name: NTH1422
atgattagtctacaagaaaccaaaatagctgtgcaaaatctaaatttctactatgaggattttcatgcattaaaaaacattaatttacgtatcgctaagaataaagtgaccgcctttattggtccttcaggttgcggtaaatctactttattgcggagttttaatcggatgtttgaactatatccaaatcaaaaagctactggtgaaattaatttagacggtgaaaatttactcacaacaaagatggatatttctctgattcgtgctaaggttggtatggttttccaaaaaccaacgccatttccaatgtcgatttatgataatattgcattcggtgttcgtttgtttgaaaaattatcaaaagaaaagatgaatgaacgagtagaatgggcattgactaaggccgctctttggaatgaagtgaaagataaattacataaaagcggagatagtttatctggcggacaacagcaacgcttgtgcattgctcgagggattgctattaaacctagtgtgttgttgttagatgaaccttgttcggcattagatcctatttcgactatgaaaattgaagaactcattacggagttaaaacaagattatactgtggttatagtaactcataatatgcaacaagctacacgttgctccgactatacggcattcatgtatttgggtgaattagttgaatttggtcaaacacaacaaatttttgatagacccaagatacaacgtacagaagattatattcgcggtaaaatgggg

SEQ ID NO: 2562 - protein, 255 aa, Haemophilus influenzae
  Name: NTH1422
MISLQETKIAVQNLNFYYEDFHALKNINLRIAKNKVTAFIGPSGCGKSTLLRSFNRMFELYPNQKATGEINLDGENLLTTKMDISLIRAKVGMVFQKPTPFPMSIYDNIAFGVRLFEKLSKEKMNERVEWALTKAALWNEVKDKLHKSGDSLSGGQQQRLCIARGIAIKPSVLLLDEPCSALDPISTMKIEELITELKQDYTVVIVTHNMQQATRCSDYTAFMYLGELVEFGQTQQIFDRPKIQRTEDYIRGKMG

SEQ ID NO: 2563 - DNA, 462 bp, Haemophilus influenzae
  Name: NTH1423
atgacgagaaaaattctgatagttgaagatgaatgtgcaatccgtgaaatgatcgcactgtttttatctcaaaaatactatgatgtgattgaagcgagcgatttcaaaacagcgataaacaagataaaagaaaatcctaaactaatattattggattggatgctacctggtcgttcaggtatacaatttatacagtatattaaaaagcaagaaagctatgctgcgattcccattattatgcttacagctaaaagtacagaagaagattgtattgcctgtttaaatgcaggggctgatgactacatcactaaacccttttcacctcaaattttattagctcgcattgaggcagtatggaggagaatttatgaacaacaaagtcaatttatacaaatcgatgaactttccattgatgaaaatgctcagagagtgtttttccaacagcaggaaattaattttaag

SEQ ID NO: 2564 - protein, 154 aa, Haemophilus influenzae
  Name: NTH1423
MTRKILIVEDECAIREMIALFLSQKYYDVIEASDFKTAINKIKENPKLILLDWMLPGRSGIQFIQYIKKQESYAAIPIIMLTAKSTEEDCIACLNAGADDYITKPFSPQILLARIEAVWRRIYEQQSQFIQIDELSIDENAQRVFFQQQEINFK

SEQ ID NO: 2565 - DNA, 216 bp, Haemophilus influenzae
  Name: NTH1424
ttgttacatttttttatgaggcaccctgaaaaagtttattctagagaacaattgttaaatcgtatttggcataatgatctagaagttgaatatcgcactgttgatagctatattcgccgtttacgccgtaatttagctccttttcaatgtgaacattatatccaaacagttcgaggatctggttatcgattttctagttatttacgagataaacaa

SEQ ID NO: 2566 - protein, 72 aa, Haemophilus influenzae
  Name: NTH1424
LLHFFMRHPEKVYSREQLLNRIWHNDLEVEYRTVDSYIRRLRRNLAPFQCEHYIQTVRGSGYRFSSYLRDKQ

SEQ ID NO: 2567 - DNA, 1275 bp, Haemophilus influenzae
  Name: NTH1425
atgaaaaaaatattgaattttattgttgaaataaatttggcaatcattatttccttatttacttctgattttattctttggtttgcaataatacttttattaattttagcttggcatcatattaatgaatatcgtttactcaaatatctcaatttaaagcaagataataaattctctttattacaattaggaacattctctcaaactgaagcctaccatcgtcatcaaatttacaaagaaaaatgtgcaagtttacgtttgttatctcaaataaataaaaatattaagtatttaccagatgcaattattatctgtcagcataatggtaatatttcttggtgtaattcaattgcgcaacagatgtttgatttttgttggaataaaaaagtccagaaaaatatttttgatgttattttttatgaacaatttaaacattattttttcagtcaaaaaaaaagacgaccgttagtactattaacttataatcaacgttatattgaggtgcagtcgcacgcttataattctcatatgattttagttatcgctcgagatattacagatatgattcatttacttaattcacgccaaaaattcttgagtaatattaatcacgagctacgtactccattaaccgtattacaaggttacttagaaattcttgcagataataatattcagaaccctctacaaaaaaaggctatttttgcaatgcaagagcaaagccaacgaatggaacatctattacaacaatttaattttttagcaaaaatagaaacaacttcagataaggattttcgtaaatttgatatgtcagccatgataaattctttaagaaaagatacagatatattaaatacttataatcatcatattgaatttattattcagcctaatatcattatttttggaaatgaatctcaactaagaagtgccgtttcaaatttaatttataatgctattaagcattctggtaaacagtgtcatattcaaattcaatgggaaacttgtgaacagggtattaaatttaacgtgatagataatggtgttggcatatcaccacagcatattccacatttaacagaacgtttttatagagttgatgaatctcgtagccatttaactggtggaagtggtttaggactagctattgtgaagcatactttattacaatatcattctcatttaaatattgaaagtactgaaacgaaggggagtagtttttcgtttatcatacctaaacgctttgtcatatcaaaaaataataaagaaattcaa

SEQ ID NO: 2568 - protein, 425 aa, Haemophilus influenzae
  Name: NTH1425
MKKILNFIVEINLAIIISLFTSDFILWFAIILLLILAWHHINEYRLLKYLNLKQDNKFSLLQLGTFSQTEAYHRHQIYKEKCASLRLLSQINKNIKYLPDAIIICQHNGNISWCNSIAQQMFDFCWNKKVQKNIFDVIFYEQFKHYFFSQKKRRPLVLLTYNQRYIEVQSHAYNSHMILVIARDITDMIHLLNSRQKFLSNINHELRTPLTVLQGYLEILADNNIQNPLQKKAIFAMQEQSQRMEHLLQQFNFLAKIETTSDKDFRKFDMSAMINSLRKDTDILNTYNHHIEFIIQPNIIIFGNESQLRSAVSNLIYNAIKHSGKQCHIQIQWETCEQGIKFNVIDNGVGISPQHIPHLTERFYRVDESRSHLTGGSGLGLAIVKHTLLQYHSHLNIESTETKGSSFSFIIPKRFVISKNNKEIQ

SEQ ID NO: 2569 - DNA, 132 bp, Haemophilus influenzae
  n 3, 41, 115: n is any nucleotide
  Name: NTH1426
ttntggtgtaatcccaggcaacagatccgccttgcgcaatntgcgggtattcgtacagatgctgattttaatatcattggtaacccaattaagttttattgtaaacaaaccccancgattattaccggctcc

SEQ ID NO: 2570 - protein, 44 aa, Haemophilus influenzae
  Xaa 1, 14, 39: Xaa is any amino acid
  Name: NTH1426
XWCNPRQQIRLAQXAGIRTDADFNIIGNPIKFYCKQTPXIITGS

SEQ ID NO: 2571 - DNA, 1422 bp, Haemophilus influenzae
  n 13, 44, 82, 156: n is any nucleotide
  Name: NTH1427
atggcaaaagatntcagcttttttatttacgattatgaaagttntggtgtaatcccaggcaacagatccgccttgcgcaatntgcgggtattcgtacagatgctgattttaatatcattggtaacccaattaagttttattgtaaacaaaccccancgattattaccggctcctgaagccgtaatggtcacaggaattacgcctcaagaatgtaatgaaaaggggctttcagagcctgaattcgccgcaaatatcttagcagaattttcccaacccaatacttgtgtcatgggttataacaatattcgctatgatgatgaaatgacgcgttatacgttttatcgtaattttattgatccttatgaatacagctggaaaaatgggaattcacgctgggatttgttagatttagtgcgagcctgttatgccttgcgtccagaaggaattaattgggcttatgacgatgatggaatgccaagtttccgcttagaaaaactcactaaagcaaatggtattgagcatgaaaatgctcacgatgccatggcggatgtatatgcaactattgctatggcgaaattaattaaagaaaaacagcctaaattattccaatatttctttgaaaatcgcggtaaaaaagaaatcgaaaaattagttgatacaggcgcaatgacacctttagtgcatgtttctggaatgctagggaattatcgtggaaattgcacttgggttgcacctttatcttggcatccgacaaatcaaaatgcattaattgtgtgtgatttaactggcgatatcgataatttattagccaaaagtgcggatgaattacggacagatttatataccaaaaaatctgaattagaagaaagaggagtttcatccgttccgttaaaacttgtgcatattaataaatgtcctattttagcaccagctaaaactttgttaccagaaacagcaaatcgattgggtattgatcgacaattatgcttggataatcttgcaaaattacgagcatcttttgatattcgtgaaaaagtggcggatatttttaatgaagaacgtcaatttgcatcgaatgataatgtagaaactgagttatacaatggcttttttagcaatgctgataaaaataatatggctattttacgtagtttacctgcagaaaaattatctgaacatggtttagcttttgaagataaacgtatccttgaattattgttccattatcgtgctcgccacttttataaaaccctcacacgcgctgaacaaattaaatggcaaaaataccgacagaataaacttgaaaaaagtgcggtagagtttcaatcaggtttacaacgtttagccgaggaacattcagataattctgaaaaactatctttgctacaacaagtatatgaatatggtataaaattactaggt

SEQ ID NO: 2572 - protein, 474 aa, Haemophilus influenzae
  Xaa 5, 15, 28, 52: Xaa is any amino acid
  Name: NTH1427
MAKDXSFFIYDYESXGVIPGNRSALRNXRVFVQMLILISLVTQLSFIVNKPXRLLPAPEAVMVTGITPQECNEKGLSEPEFAANILAEFSQPNTCVMGYNNIRYDDEMTRYTFYRNFIDPYEYSWKNGNSRWDLLDLVRACYALRPEGINWAYDDDGMPSFRLEKLTKANGIEHENAHDAMADVYATIAMAKLIKEKQPKLFQYFFENRGKKEIEKLVDTGAMTPLVHVSGMLGNYRGNCTWVAPLSWHPTNQNALIVCDLTGDIDNLLAKSADELRTDLYTKKSELEERGVSSVPLKLVHINKCPILAPAKTLLPETANRLGIDRQLCLDNLAKLRASFDIREKVADIFNEERQFASNDNVETELYNGFFSNADKNNMAILRSLPAEKLSEHGLAFEDKRILELLFHYRARHFYKTLTRAEQIKWQKYRQNKLEKSAVEFQSGLQRLAEEHSDNSEKLSLLQQVYEYGIKLLG

SEQ ID NO: 2573 - DNA, 474 bp, Haemophilus influenzae
  Name: NTH1428
atgaatggtttaactgtagaagttcttaatactgatgcagaaggtcgattagtgctttgtgatgcacttacttatgttgagcgttttgaacctgagcttgttattgatgttgcaaccttgactggtgcttgtgtggttgcactagggcaacacaatagcggcttagtttctacagataacaatcttgccaatgcactactccaagccgcaacagaaaccactgacaaagcgtggcgtttaccattaagcgaagaatatcaagagcaacttaaatcgcctttcgccgaccttgccaacattggtggtcgctggggtggcgcaattacagcgggtgcatttttgtctaacttcacgaaaaaatatcgctgggcacatttagacatcgcaggcactgcttggttacaaggcgcaaataaaggtgcaacaggtcgccctgtttcgctattaacccaatttttgattaatcaagttaaa

SEQ ID NO: 2574 - protein, 158 aa, Haemophilus influenzae
  Name: NTH1428
MNGLTVEVLNTDAEGRLVLCDALTYVERFEPELVIDVATLTGACVVALGQHNSGLVSTDNNLANALLQAATETTDKAWRLPLSEEYQEQLKSPFADLANIGGRWGGAITAGAFLSNFTKKYRWAHLDIAGTAWLQGANKGATGRPVSLLTQFLINQVK

SEQ ID NO: 2575 - DNA, 1440 bp, Haemophilus influenzae
  Name: NTH1429
atggcattacttgccacattatttgggattattactacattaggttttggttcatcacagcttggtgcagggcttgaacaaataggttggataagtcagaacagcttttccttacaagttggcgttattgttgtggtgatgtgtttagcggtgttttctgctatttctggtattggaaaaggcgtgaaaatattaagtgaaattaacttaactttagcattttgtttacttctttttgttttaatttcaggccctacgttataccttttatctgcatttagcgacaatattggtaattatttcagcaatttagtgcaactcagttttaaaacctatgcttatgaacaagaacatactagctggtttagcggatggactgtgctttattgggcttggtggtgttcttgggctccgtttgtgggtttatttattgcgcgtatttctaaagggcgaactatccgtgaatttatttttggcgtattagttattccaagtttatttggtattttatggtttactgtttttggtaatacagcagtatggctaaatgatggcattgctgcgggcgggcttggcgaatttatttcttccccagaaattttattatttaaatttttaaattatctgcctttaccaacaataacaggctttgtgagcttattagtgatttcattgttttttatcacttcagcggattcaggtatttatgtgttaaataacattgcatctcgagataaaagtttagcttctcctgcgtggcaagccataatgtggggcactttgatgtcagttgttgcaattgtgctaatgcaatctggtggacttgctaatttgcaaacaatgacattaattgttgccttgccttttgctttattgatgttggtaatgtgttttagtttatggaaaggcttaattgcggataaaaaatatttttctactaaagtcaatccaactagtattttctggagcggcgataaatggaaatcacatttagagcaaatgatgaaccaaacgcaagagaaagatattttacgtttccttaaaaatacggcgttacccgctatgcgagaattacgtcaagaattaacaggaaaatataatttaagtgtagaaatcaacacattatttgaacaagaagagccagctttggaattggtaattcataaagaatcaatgcgagattttatgtatggtattaaatctgttgggcgagaagtgtcagagcaattaattaacgatgaaaatttaccgcacattcagcatagtgttacttacgagccttacacttatttttttgatggacgagtcggttacgatgttcaatatatggatcaagatgaattgattgccgatatgttgaaacaatatgaacgttatctaagtttgcttgatgatgtgggtcaggaactgatggcacacgagcaaaccgaactagcagag

SEQ ID NO: 2576 - protein, 480 aa, Haemophilus influenzae
  Name: NTH1429
MALLATLFGIITTLGFGSSQLGAGLEQIGWISQNSFSLQVGVIVVVMCLAVFSAISGIGKGVKILSEINLTLAFCLLLFVLISGPTLYLLSAFSDNIGNYFSNLVQLSFKTYAYEQEHTSWFSGWTVLYWAWWCSWAPFVGLFIARISKGRTIREFIFGVLVIPSLFGILWFTVFGNTAVWLNDGIAAGGLGEFISSPEILLFKFLNYLPLPTITGFVSLLVISLFFITSADSGIYVLNNIASRDKSLASPAWQAIMWGTLMSVVAIVLMQSGGLANLQTMTLIVALPFALLMLVMCFSLWKGLIADKKYFSTKVNPTSIFWSGDKWKSHLEQMMNQTQEKDILRFLKNTALPAMRELRQELTGKYNLSVEINTLFEQEEPALELVIHKESMRDFMYGIKSVGREVSEQLINDENLPHIQHSVTYEPYTYFFDGRVGYDVQYMDQDELIADMLKQYERYLSLLDDVGQELMAHEQTELAE

SEQ ID NO: 2577 - DNA, 396 bp, Haemophilus influenzae
  Name: NTH1430
ttgtctttatctcaatttatgacaaagcgaacgtcatttaatcctttggtaattggcgttacgttattttttatattgttactgatggcaatgatttttattgcgccagagcaaactcaagcattattgaatcaagctaaaagtggtatttttgctaattttagttggttttatgtactcactttttcagtgtttttaggatttttattaattttatcagtaagtagtcttggcaatataaaactagggcaagatgaagaagaacctgaatttagtttcttatcttggcttgcgatgttatttgccgctggaatgggggttgggctgatgttttttggcgtagcagaaccattaacccattatctttctgacattacagtaggttcctgcagaaca

SEQ ID NO: 2578 - protein, 132 aa, Haemophilus influenzae
  Name: NTH1430
LSLSQFMTKRTSFNPLVIGVTLFFILLLMAMIFIAPEQTQALLNQAKSGIFANFSWFYVLTFSVFLGFLLILSVSSLGNIKLGQDEEEPEFSFLSWLAMLFAAGMGVGLMFFGVAEPLTHYLSDITVGSCRT

SEQ ID NO: 2579 - DNA, 171 bp, Haemophilus influenzae
  n 42: n is any nucleotide
  Name: NTH1431
ttgaaaaaacttggacagcgtttttatcgtccagctgggcanaatgaaaagggaagtggcttgggactttctattgttatgcgaattgcggaattacacggatttaaagtgcggttagaaaatgttgtaaaagaggggagaagaattggcttaaaagcaataatatccttg

SEQ ID NO: 2580 - protein, 57 aa, Haemophilus influenzae
  Xaa 14: Xaa is any amino acid
  Name: NTH1431
LKKLGQRFYRPAGXNEKGSGLGLSIVMRIAELHGFKVRLENVVKEGRRIGLKAIISL

SEQ ID NO: 2581 - DNA, 417 bp, Haemophilus influenzae
  Name: NTH1432
atgaaaaaaacaatgttattaaatgcacaactttctcgttgtatcgcttctgttggtcacacagaaagtttgacgatttgcgatgcgggacttccaattccgttaagtgtggaacgtatcgatctcgcattaactgcgggtgtaccaagttttctacaaacgttgaatgtagtaacgaatgaaatgtatgttgaacgcgttgttattgcagaagaaattaaagaaaaaaatccagaaatattgaccgcacttttaacacaacttcaacaacttgaaagccatcagggtaatcaaatacaagtggaatttgtatcgcacgaaacttttaaaaaattcaccctcgaaagtaaagctattgttcgtactggcgaatgttcaccttatgccaatgtgattttatattctggcgtgccattt

SEQ ID NO: 2582 - protein, 139 aa, Haemophilus influenzae
  Name: NTH1432
MKKTMLLNAQLSRCIASVGHTESLTICDAGLPIPLSVERIDLALTAGVPSFLQTLNVVTNEMYVERVVIAEEIKEKNPEILTALLTQLQQLESHQGNQIQVEFVSHETFKKFTLESKAIVRTGECSPYANVILYSGVPF

SEQ ID NO: 2583 - DNA, 1479 bp, Haemophilus influenzae
  Name: NTH1433
atggaaactttactcaaaattagtggtgttgataagtcatttccaggtgtgaaagccttgaataatgcctgtttatctgtttacgctggacgcgtaatggcattgatgggggaaaatggggcgggtaaatcgactttgatgaaggtgcttactggtatttattctaaagatgcaggcacaattgagtatcttaatcgatcagttaatttcaatggacctaaagcctcacaggaagctggcattagtattattcaccaagaactgaatttggtcggtaatctcacgattgcagaaaacattttccttggtcgtgaatttaaaacctcgtggggagcgattaactggcagaaaatgcaccaagaagcagacaagctacttgcgcgtttgggggtaactcacagcagtaaacagctttgcgctgaactttctattggtgagcaacaaatggtggagatagccaaagccttaagttttgaatccaaagttatcattatggatgaaccaaccgatgcgctcacagatacggagaccgaagccctattcaatgtgattcgtgaactcaaagcagaaaatcgtggcattgtttatatctctcatcgtttaaaagaaattttccaaatttgtgatgatgtgacggttttacgcgatggtcaatttatcggtgaacgcattgtggcagaaattacagaagatgatttaattgaaatgatggttggtcgtcgtcttgatgaacaatatccgcatttatcacaagaaaaaggcgaatgtgtattggatgtgaaaaatgtgagcggaagcggtattgatgatgtttccttcaaattgcatgccggtgaaattgttggtgtctcgggcttaatgggtgcgggtagaacggaactcggcaagctactttacggtgctttgccaaaaacggcgggaaaagtgcggttaaaaaatcaagagattgagaatctcagtccgcaagatggtttggataatggtattgtatatatttctgaagatcgtaaaggtgatggcttggttttaggaatgtcagtaaaagaaaatatgtcgctcacatcgctcgatcatttttcacaaaaaggcagtattcgtcatcaagcggaaaaaatgacagtagatgactttattctgatgtttaacattaaaacacctaatcgtgatcaacaagtaggtttgctatctggtggaaatcaacaaaaagtggcaattgctcgtggattaatgactcgcccaaatgtgttgattttagatgaaccaactcgtggcgtacatgttggcgcgaagaaagaaatttgtcagttgattaacgaatttaagaaagagggcttgagtattttaatgatctcatctgatatgccagaagtgcttggtatgagcgatagagtgttggtaatgcgtgaaggtaaaattagtgcagaattttctcgcaaagacgcaactcaagaaaaattattagcagcagctattggtaaa

SEQ ID NO: 2584 - protein, 493 aa, Haemophilus influenzae
  Name: NTH1433
METLLKISGVDKSFPGVKALNNACLSVYAGRVMALMGENGAGKSTLMKVLTGIYSKDAGTIEYLNRSVNFNGPKASQEAGISIIHQELNLVGNLTIAENIFLGREFKTSWGAINWQKMHQEADKLLARLGVTHSSKQLCAELSIGEQQMVEIAKALSFESKVIIMDEPTDALTDTETEALFNVIRELKAENRGIVYISHRLKEIFQICDDVTVLRDGQFIGERIVAEITEDDLIEMMVGRRLDEQYPHLSQEKGECVLDVKNVSGSGIDDVSFKLHAGEIVGVSGLMGAGRTELGKLLYGALPKTAGKVRLKNQEIENLSPQDGLDNGIVYISEDRKGDGLVLGMSVKENMSLTSLDHFSQKGSIRHQAEKMTVDDFILMFNIKTPNRDQQVGLLSGGNQQKVAIARGLMTRPNVLILDEPTRGVHVGAKKEICQLINEFKKEGLSILMISSDMPEVLGMSDRVLVMREGKISAEFSRKDATQEKLLAAAIGK

SEQ ID NO: 2585 - DNA, 969 bp, Haemophilus influenzae
  Name: NTH1434
atgatgaaaaatgaaacatctaattttcaaataggaagatttttgattgaacagcgttcttttattgcgttgattattcttatcgcgattgtatcaatgattaatcctgatttttttagcgtagataatattttgaatattttacgccaaacttcggttaatgcgattattgcagtgggtatgactttcgttattttaattgcaggtatagatctttctgttggatctgtattggcattgacaggtgcaatcgccgcttcaatggtgagtatcgaattgcctatttttttagtcattcctgtggttttattgattggaacacttcttggtggcataagtggtgtaattgtggcaaaagggaaagttcaggcttttattgctaccttggttaccatgaccttactgcgtggtataacaatggtttatacagatggtcgtcctattacgacaggtttttcggataatgctgatctatttgctagcattggtacaggctatgttttaggtatcccagtaccaatttggattatgagtatcgtgtttgcggttgcttggtatattttaaaacacacaccaatcggtcgctatatttatgctttaggtggaaatgaggcagcgacccaactttctggtattaacgtcaataaaatcaaagtatttgtttttgcggtgagtggatttctttctgcgctggcgggtttaattgtaacttcacgtttatcttccgctcaacccactgctggcgtatcttatgaattagatgcaattgccgccgtggtagtcggtggaaccagtttgatgggggggaaaggtcgtgtaatgggaactctcatcggtgcattaatcatcggatttttaaacaatgcattaaatttattagatatttcatcttactatcaaatgatagcaaaagcgttggttattttggttgctgttttagccgataactatcttggtacaaaaaaactg

SEQ ID NO: 2586 - protein, 323 aa, Haemophilus influenzae
  Name: NTH1434
MMKNETSNFQIGRFLIEQRSFIALIILIAIVSMINPDFFSVDNILNILRQTSVNAIIAVGMTFVILIAGIDLSVGSVLALTGAIAASMVSIELPIFLVIPVVLLIGTLLGGISGVIVAKGKVQAFIATLVTMTLLRGITMVYTDGRPITTGFSDNADLFASIGTGYVLGIPVPIWIMSIVFAVAWYILKHTPIGRYIYALGGNEAATQLSGINVNKIKVFVFAVSGFLSALAGLIVTSRLSSAQPTAGVSYELDAIAAVVVGGTSLMGGKGRVMGTLIGALIIGFLNNALNLLDISSYYQMIAKALVILVAVLADNYLGTKKL

SEQ ID NO: 2587 - DNA, 159 bp, Haemophilus influenzae
  Name: NTH1435
atgaaaaaactaaccgcacttacttctgctgtattattaggtttggctgtttctggctctgcttctgcacaagacacaatcgctttggcagtatctacattagataacccattttttgtaacgttaaaagaaatggcgcacagaaaaaagcggatgaat

SEQ ID NO: 2588 - protein, 53 aa, Haemophilus influenzae
  Name: NTH1435
MKKLTALTSAVLLGLAVSGSASAQDTIALAVSTLDNPFFVTLKEMAHRKKRMN

SEQ ID NO: 2589 - DNA, 264 bp, Haemophilus influenzae
  Name: NTH1436
gtggtgcttgattcacaaaatgaccctgctaaagaattagctaatgtcgaagatttaactgtgcgtggtgcaaaaatattattgatcaatccaactgattctgaagcagttggcaacgcagtggcgattgcaaaccgtaagcatattccagtaattacattagatcgtggcgcatctaaaggaaacgtactgagccatattgcatctgacaatatcgcaggtggtaaaatggcaggcgattttatcgcacagaaattacgcgat

SEQ ID NO: 2590 - protein, 88 aa, Haemophilus influenzae
  Name: NTH1436
VVLDSQNDPAKELANVEDLTVRGAKILLINPTDSEAVGNAVAIANRKHIPVITLDRGASKGNVLSHIASDNIAGGKMAGDFIAQKLRD

SEQ ID NO: 2591 - DNA, 519 bp, Haemophilus influenzae
  n 308, 510, 511, 512, 513, 514: n is any nucleotide
  Name: NTH1437
ttgcatctgacaatatcgcaggtggtaaaatggcaggcgattttatcgcacagaaattacgcgattaatgccaaggtgattcaacttgcaggtattgcattaacatctgcgtcctcgatcgaggtgatggcttccacaagctattgttctcacaaaactatagtctttttactcttcctatatatttgtcggttcttttggtctgttgtctctttctttctttttcacttattgtttttttgctcttttttctggtttttttttttatctctccttcttcttttttgtcgttttcttctttttttttnattcccttctctcttttttctttttctttttccccctttttttttttctttcctttttttttttttttcttttctctttttcccctctttttttcctctccccttcatctctatcctccccttaattttcttattattctcgttactctccttccctcttcccctcttctcttcacatttaattctctatttctttctgttnnnnnttaat

SEQ ID NO: 2592 - protein, 173 aa, Haemophilus influenzae
  Xaa 103, 170, 171, 172: Xaa is any amino acid
  Name: NTH1437
LHLTISQVVKWQAILSHRNYAINAKVIQLAGIALTSASSIEVMASTSYCSHKTIVFLLFLYICRFFWSVVSFFLFHLLFFCSFFWFFFLSLLLLFCRFLLFFXFPSLFFLFLFPPFFFSFLFFFFSFLFFPSFFPLPFISILPLIFLLFSLLSFPLPLFSSHLILYFFLXXXN

SEQ ID NO: 2593 - DNA, 738 bp, Haemophilus influenzae
  Name: NTH1438
atgtggaagtggttacatccttatgcaaaacctgaaactcaatatcgtatctgcggtaaattgagtccgttatttgcatttttaacgcttatcttactcggtattggcattgtatggggcttagcattcgccccagcagattaccaacagggcaatagtttccgaattatgtatgtacatgtgccgacagcgatttggtcaatgggtgtgtacggttcaatggcgattgcagctgtggttgccctagtgtggcaaattaagcaagctcatctcgcaatgattgcaatggcgccaattggtgcattgtttactttcttatcgcttgttacgggggcaatttgggggaaaccaatgtggggtacttggtgggtgtgggatgctcgcttaactgcagaattgattttattctttctttatcttggtatcttagccctttattctgctttttcagatcgtaacataggtgcaaaagcggcggggattttatgcattacaacggtcgtgattttaccgattattcatttttcggtggagtggtggaacacattacatcaaggggcgagtattaccaaatttgaaaaaccatccattgcaattccaatgttggttccattaattttatgtatcttcggttttttgaccttgtatatttggcttactttagttcgttatcgcgtggaattattgaaagaagatgcaaaacgtccttgggttaaagcattagctcaaacactgaaa

SEQ ID NO: 2594 - protein, 246 aa, Haemophilus influenzae
  Name: NTH1438
MWKWLHPYAKPETQYRICGKLSPLFAFLTLILLGIGIVWGLAFAPADYQQGNSFRIMYVHVPTAIWSMGVYGSMAIAAVVALVWQIKQAHLAMIAMAPIGALFTFLSLVTGAIWGKPMWGTWWVWDARLTAELILFFLYLGILALYSAFSDRNIGAKAAGILCITTVVILPIIHFSVEWWNTLHQGASITKFEKPSIAIPMLVPLILCIFGFLTLYIWLTLVRYRVELLKEDAKRPWVKALAQTLK

SEQ ID NO: 2595 - DNA, 663 bp, Haemophilus influenzae
  Name: NTH1439
atgatttttttagagataattaaacgagaacttcaaattgcaatgcgcaaaaatgcggagattttaaatccgctatggttctttttgcttgtgattactttgtttccgcttgttattgggccagagcctaaattactttcccgtatcgcaccgggtatcgcatgggtagcagcattactttcagcattgctttcttttgaacgtttattccgtgatgattttattgatggctctcttgaacaattaatgctaactgcacagcctttgccaatgacagctttggctaaagtcgttgcacattggttgctcactggtttgccgcttattttgctatcacctattgccgctttgttgctttctcttgaggtcaatatttggtgggcattggttttgacattgttactgggcactcctgtattgagctgtatcggtgctattggcgtggctttaacggtgggattgcgaaaaggtggcgtgttgttgagtttgcttgttgttccgttgtttattcctgttttaatttttgcttcatcaatactagaagcagcaggattaaatgtgccttatgggggacaactggcgattttaggtgccatgatggttggtgcagtaacgctttcgccttttgccattgctgcagcgttgcgaattagtttagataat

SEQ ID NO: 2596 - protein, 221 aa, Haemophilus influenzae
  Name: NTH1439
MIFLEIIKRELQIAMRKNAEILNPLWFFLLVITLFPLVIGPEPKLLSRIAPGIAWVAALLSALLSFERLFRDDFIDGSLEQLMLTAQPLPMTALAKVVAHWLLTGLPLILLSPIAALLLSLEVNIWWALVLTLLLGTPVLSCIGAIGVALTVGLRKGGVLLSLLVVPLFIPVLIFASSILEAAGLNVPYGGQLAILGAMMVGAVTLSPFAIAAALRISLDN

SEQ ID NO: 2597 - DNA, 636 bp, Haemophilus influenzae
  Name: NTH1440
atgtttgagcaacacaagttatctctgcaaaatttatcctgccaacgtggtgagcgcgtactttttcgtgctttgacttgcgattttaatagcggtgattttgtacaaattgaagggcataacggcataggtaaaacgagcttgttacgtattcttgctggtttagcccaacctttagaaggcgaagtgcggtgggatgctgaagcaatttctaaacaacgtgaacagtatcatcagaatttgctttatttaggacatcttttaggcgttaaaccagagctaacggcgtgggaaaatttgcagttttatcaacgaattagtcaagctgaacaaaacaccgatatgttgtgggatttgcttgagaaagtgggattattagggcgtgaagatttgcctgccgcacaactttctgcaggacaacaaaaacgtatcgcgttaggtcgcttatggctgtctcaagcgcccttatggattttagatgagccctttactgcgattgataaaaaaggcgtggaaattctaaccgcactttttgatgagcatgctcaacgtggaggtattgtgttattgaccagccaccaagaagtgccaagttctcatctgcaaaaattgaatttagcggcttataaagcggaa

SEQ ID NO: 2598 - protein, 212 aa, Haemophilus influenzae
  Name: NTH1440
MFEQHKLSLQNLSCQRGERVLFRALTCDFNSGDFVQIEGHNGIGKTSLLRILAGLAQPLEGEVRWDAEAISKQREQYHQNLLYLGHLLGVKPELTAWENLQFYQRISQAEQNTDMLWDLLEKVGLLGREDLPAAQLSAGQQKRIALGRLWLSQAPLWILDEPFTAIDKKGVEILTALFDEHAQRGGIVLLTSHQEVPSSHLQKLNLAAYKAE

SEQ ID NO: 2599 - DNA, 105 bp, Haemophilus influenzae
  Name: NTH1441
gtgttgctcaaacataattacagagggaaaatagaaagtggtggtattctaatatttgatgaaattttcgcaactcaaacacataactctttagaagtagatcga

SEQ ID NO: 2600 - protein, 35 aa, Haemophilus influenzae
  Name: NTH1441
VLLKHNYRGKIESGGILIFDEIFATQTHNSLEVDR

SEQ ID NO: 2601 - DNA, 645 bp, Haemophilus influenzae
  Name: NTH1442
atgtcttacactctccctgaattaggctatgcctacaatgcgttagaaccacattttgatgcgcaaacaatggaaatccatcatagtaaacaccaccaagcttacgtaaacaatgcaaatgctgcattagaaggtttacctgctgaattagtagaaatgtatccgggtcatttaatttctaaccttgataaaattcctgcagaaaaacgtggagcattacgtaataatgctggaggccacacaaaccacagtttattttggaaaagtttgaaaaaaggcactactttacaaggcgcattaaaagatgcgattgaacgcgatttcggttctgtagatgcatttaaagcagagtttgaaaaagcagcagcaactcgtttcggttcaggttgggcatggttagtattaaccgctgaaggtaaattagccgttgtatcaacagcaaaccaagataacccattaatgggtaaagaagtggcaggttgtgagggtttcccacttttaggtttagacgtttgggaacacgcttactacttaaaattccaaaaccgccgtccagactacattaaagaattctggaatgtggtaaactgggatttcgttgcagaacgttttgaacaaaaaacagcacactgtaactgtgcaaaa

SEQ ID NO: 2602 - protein, 215 aa, Haemophilus influenzae
  Name: NTH1442
MSYTLPELGYAYNALEPHFDAQTMEIHHSKHHQAYVNNANAALEGLPAELVEMYPGHLISNLDKIPAEKRGALRNNAGGHTNHSLFWKSLKKGTTLQGALKDAIERDFGSVDAFKAEFEKAAATRFGSGWAWLVLTAEGKLAVVSTANQDNPLMGKEVAGCEGFPLLGLDVWEHAYYLKFQNRRPDYIKEFWNVVNWDFVAERFEQKTAHCNCAK

SEQ ID NO: 2603 - DNA, 693 bp, Haemophilus influenzae
  n 680, 681, 682, 683, 684: n is any nucleotide
  Name: NTH1443
ttgaactttttatttataaacgagattttaatgaatcaaaatctaattgaagttaagaatctcacctttaaacgcggtgatcgcgtgatttacgataacctgaatttgcaagtaaaaaagggaaaaatcactgcgatcatggggccgtcggggattggtaaaaccaccttacttaaattgataggtgggcaactaatgccagagcaaggtgaaattttgtttgatggacaagatatttgtcgtctatctaatcgtgaactgtacgaagtacgcaagcggatggggatgttattccaatcaggtgcgctttttacggatatttctacttttgataatgtcgcctttccaattcgtgaacatacgcatttgcctgaaagtttaattcgtcaaatcgtgttgatgaaattggaggcggttgggttgcgaggtgctgccgcattgatgccttcagaactttccggtggtatggctcgtcgagctgcattagcgcgcgctattgcgcttgaccctgatttaattatgtttgatgagccatttacggggcaagatccgattagtatgggcgtaattttaagcctgattaaacgattaaatgaagcgttaaatttgacttctatcgtagtgtcacacgatgggaggaagtatgagtatggggtaccgagtccgatattcggtaccannnnnttaattaat

SEQ ID NO: 2604 - protein, 231 aa, Haemophilus influenzae
  Xaa 227, 228: Xaa is any amino acid
  Name: NTH1443
LNFLFINEILMNQNLIEVKNLTFKRGDRVIYDNLNLQVKKGKITAIMGPSGIGKTTLLKLIGGQLMPEQGEILFDGQDICRLSNRELYEVRKRMGMLFQSGALFTDISTFDNVAFPIREHTHLPESLIRQIVLMKLEAVGLRGAAALMPSELSGGMARRAALARAIALDPDLIMFDEPFTGQDPISMGVILSLIKRLNEALNLTSIVVSHDGRKYEYGVPSPIFGTXXLIN

SEQ ID NO: 2605 - DNA, 537 bp, Haemophilus influenzae
  Name: NTH1444
atgcagcgagcgtggggtaaactatgttctgatatacgagctaatcaaagtagagttaaacaagatccaaattatatacgtactattgttcgtaatgatttattgccttacgtaaacttagaatatgcaggttctaaagtattaggttcatactacgaatcaacctctacagagcaacgagaaaaatttttcaagacttttggtgagttgattgagcaaaagtacgcacaaacattaacaaattattctaatcaaaaaattcaaattgaatcagaaaaagaattaggcgataacaattttgtaaatattcgcgtaagtattattcaaactaatggcgttgctccgatcctattagattttaaatggcgtaaaggcaataaaagtggggaatggaaagcctacgatatggcagcagcaggcgtaagtatgctggaagatacgataaaaaattgggttggtattttaaacaaacaaggtattgatacattaatcacaaagatgcagcaatctgcctcacaacctataattttcaatcaa

SEQ ID NO: 2606 - protein, 179 aa, Haemophilus influenzae
  Name: NTH1444
MQRAWGKLCSDIRANQSRVKQDPNYIRTIVRNDLLPYVNLEYAGSKVLGSYYESTSTEQREKFFKTFGELIEQKYAQTLTNYSNQKIQIESEKELGDNNFVNIRVSIIQTNGVAPILLDFKWRKGNKSGEWKAYDMAAAGVSMLEDTIKNWVGILNKQGIDTLITKMQQSASQPIIFNQ

SEQ ID NO: 2607 - DNA, 315 bp, Haemophilus influenzae
  Name: NTH1445
atgctaaattgggatttgcaaaaaaataatgataaaataacgctctttttgtttggggaactatctcgcagcaccttgttaccaatgtggcagcaacgtggcgtttttttgtcagaaagtacacttgataaaactattgttgaatggaatttatctggtcttcagcatattgattcagctggttttacagctctttgtgattttttacgagagtgtcaaaagattaacaaaacagtacgattagtttatccaccaaaacaattattaaccctagcagatcttgttggtttatctgattggatcgcaaattttaca

SEQ ID NO: 2608 - protein, 105 aa, Haemophilus influenzae
  Name: NTH1445
MLNWDLQKNNDKITLFLFGELSRSTLLPMWQQRGVFLSESTLDKTIVEWNLSGLQHIDSAGFTALCDFLRECQKINKTVRLVYPPKQLLTLADLVGLSDWIANFT

SEQ ID NO: 2609 - DNA, 297 bp, Haemophilus influenzae
  Name: NTH1446
ttggatcgcaaattttacatagcttacttaaacggaaatccaatggaacttcaaaaaattgaacaaattttaaaagacacgctaaatatcgtagaagtctatgcacaaggtgaaaatgcacattttggtgtaattgtagtgagtgatgaaattgctgcactatctcgtgtaaaacaacaacaaacgatttatgcccctttaatgccttattttagcactggtgaaattcacgctctaaccatcaaaacttataccgtagaaaaatggaaacgcgatcgtgcattaaaccagtttaat

SEQ ID NO: 2610 - protein, 99 aa, Haemophilus influenzae
  Name: NTH1446
LDRKFYIAYLNGNPMELQKIEQILKDTLNIVEVYAQGENAHFGVIVVSDEIAALSRVKQQQTIYAPLMPYFSTGEIHALTIKTYTVEKWKRDRALNQFN

SEQ ID NO: 2611 - DNA, 1272 bp, Haemophilus influenzae
  Name: NTH1447
atggataaatttcgtgtttatgggcaatctcgtttaagtggaagtgtgaatatttcaggcgcaaaaaacgccgcacttccaattctttttgcggctattttagctacagaacctgttaaattgacaaatgttcccgaacttaaagatattgaaacaactttaaatattttgcgtcaattaggcgtaattgcaaatcgtgatgaaactggtgcagttttattagatgcctctaatatcaatcatttcactgcaccttatgaattggttaaaactatgcgtgcttcaatttgggcattggcacctttagtcgctcgtttccatcaagctcaagtctcattacctggaggttgttctatcggagctagacctgttgatctccacattagcggtttagaaaaattaggtgcggacatcgttcttgaagaaggatatgtaaaagcacaagtatcagatcgtcttgttggaactcgaattgtaatagaaaaagtaagtgtaggcgcaactttatctattatgatggcagcaacccttgcgaaaggtacgactgttattgaaaacgccgctcgtgaacctgaaattgtagatactgcagatttccttaataaaatgggtgcgaaaataacaggtgcaggttctgatcacattacgactgaaggtgttgaacgtttaactggttgtgagcacagtattgtgccagatcgcattgaaacgggtacattcttaattgctgcagcaatttcgggcggtcgtgttgtttgtcaaaatactaaagcggatactttagatgccgtaattgataaactccgtgaagctggtgcgcaagttgatgtaactgaaaatagcattactttagatatgcttggtaatcgccctaaagcagtgaatattcgtactgcaccacatccagggttcccaactgatatgcaggctcaatttactttattaaatatggtggcagaaggtacaagcattatcactgaaacgatttttgaaaatcgttttatgcatattcctgaattaattcgtatgggtggtaaagctgaaattgaagggaatacagcggtatgtcacggggttgaacaattgtctggcacagaggtaatagcgacagatttacgcgcttcaatcagtttagtgcttgcaggttgtatcgcaacgggtgaaaccattgtagatcgtatttatcatatcgatcgtggttatgaacatatcgaagataaattacgtgctctaggtgcgaaaattgaacgtttttctagaagtgatgaagcg

SEQ ID NO: 2612 - protein, 424 aa, Haemophilus influenzae
  Name: NTH1447
MDKFRVYGQSRLSGSVNISGAKNAALPILFAAILATEPVKLTNVPELKDIETTLNILRQLGVIANRDETGAVLLDASNINHFTAPYELVKTMRASIWALAPLVARFHQAQVSLPGGCSIGARPVDLHISGLEKLGADIVLEEGYVKAQVSDRLVGTRIVIEKVSVGATLSIMMAATLAKGTTVIENAAREPEIVDTADFLNKMGAKITGAGSDHITTEGVERLTGCEHSIVPDRIETGTFLIAAAISGGRVVCQNTKADTLDAVIDKLREAGAQVDVTENSITLDMLGNRPKAVNIRTAPHPGFPTDMQAQFTLLNMVAEGTSIITETIFENRFMHIPELIRMGGKAEIEGNTAVCHGVEQLSGTEVIATDLRASISLVLAGCIATGETIVDRIYHIDRGYEHIEDKLRALGAKIERFSRSDEA

SEQ ID NO: 2613 - DNA, 330 bp, Haemophilus influenzae
  Name: NTH1448
ttggtttttataatcacgcttagacaaacacaacacaaggaagaaaaaatgaaaaaattactttttacgaccgcacttttaactggagctattgctttctcaacgttttctcacgcaggcgaaattgccgatcgtgttgaaaaaacgaaaactttattagttggaacagaagggacttatgcaccatttactttccatgataaaagtggaaaattaacaggctttgatgtagaggttattcgtaaagttgctgaaaagctcggtttgaaagtggaatttaaagaaacacaatgggatgcaatgtatgcggggttaaatgcaaaaacgttt

SEQ ID NO: 2614 - protein, 110 aa, Haemophilus influenzae
  Name: NTH1448
LVFIITLRQTQHKEEKMKKLLFTTALLTGAIAFSTFSHAGEIADRVEKTKTLLVGTEGTYAPFTFHDKSGKLTGFDVEVIRKVAEKLGLKVEFKETQWDAMYAGLNAKTF

SEQ ID NO: 2615 - DNA, 405 bp, Haemophilus influenzae
  Name: NTH1449
gtgattgtaacaaaatcatcggataacagtattaaatcatttgaagatttgaaaggtcgtaaatctgcgcaatctgcaacaagtaactggggtaaagatgcaaaagctgcaggtgcgcagattcttgtagtggatggtttagcacagagcttagagcttattaaacaaggccgtgcagaagcaacaattaatgataaattggctgtattagattattttaaaaaacacccaaattctggtttaaaaattgcttatgatcgtggggataaaactccgactgcctttgcttttttacaaggtgaagatgcattgattacaaaatttaatcaagtacttgaagcacttcgccaagatggtacattaaaacagatttcaattgaatggtttggttatgatattactcaa

SEQ ID NO: 2616 - protein, 135 aa, Haemophilus influenzae
  Name: NTH1449
VIVTKSSDNSIKSFEDLKGRKSAQSATSNWGKDAKAAGAQILVVDGLAQSLELIKQGRAEATINDKLAVLDYFKKHPNSGLKIAYDRGDKTPTAFAFLQGEDALITKFNQVLEALRQDGTLKQISIEWFGYDITQ

SEQ ID NO: 2617 - DNA, 702 bp, Haemophilus influenzae
  n 689, 690, 691, 692, 693: n is any nucleotide
  Name: NTH1450
ttgaatggtttggttatgatattactcaataattggttggcgagtcttccatttatgagtgcagaacgagctgattatgtaatcagctcgttttggcctatgttggaagcagcaattttatacacattgccattggcagtcatttccttcttctgtggtttgcttattgcagtgattgttgcagttattcgtactttgcctagccctaatttacccttaaaattgttacaggctttatgtcgagtgtatatctctataattagaggtacaccgatgttagtacaaatttttattattttttatgggttacctgaagtcggtattactttagagccttttccgacagcgattattgcattttctattaatataggtgcttatgcagcagaaactgttcgtgcttcaattattgctatacctaaagggcagtgggaagcctcttatgcgataggtatgaattatcgacaagcatttattcgtacaattatgccacaggctttacgtatttcagtaccatcgctttctaatacttttattagtacagtgaaagacacttcattagcttctcttgttttagtgacagaattattccgtgtcgcacagaatattacggcagcgaactatgaatttattttaatttatagtgaggcagctttgatttattggattttactgttttgttttaactnnnnnttaattaat

SEQ ID NO: 2618 - protein, 234 aa, Haemophilus influenzae
  Xaa 230, 231: Xaa is any amino acid
  Name: NTH1450
LNGLVMILLNNWLASLPFMSAERADYVISSFWPMLEAAILYTLPLAVISFFCGLLIAVIVAVIRTLPSPNLPLKLLQALCRVYISIIRGTPMLVQIFIIFYGLPEVGITLEPFPTAIIAFSINIGAYAAETVRASIIAIPKGQWEASYAIGMNYRQAFIRTIMPQALRISVPSLSNTFISTVKDTSLASLVLVTELFRVAQNITAANYEFILIYSEAALIYWILLFCFNXXLIN

SEQ ID NO: 2619 - DNA, 786 bp, Haemophilus influenzae
  Name: NTH1451
atgaccgcactttctgagatttttgtgccgttgcatcggattattcctttttcaaatgtagagggacaaggcaatcgttcgagtatttttctgcaaggttgcaagctaaattgcttgtattgccataatccggaaaccatacctcgttatacggaaagtgcgaaattggtcagtttgcagtatttgtatgaacaggttatggaggcagttccatttattcgcggtgtaacggtttctggtggagaacccactattcatcacaaaaaacttgtgccactctttaaggctttacgttcgcaaggattgacttgttatttggatagtagtggcttttttgagtttgatcgtgtttgttcgttaattgatgtcactgacaaatttttatttgatctcaaaggcgagggcattggcttgcaaacactttgttttgatcggaaaaatcaagcaggtattgtatcacagcaagtgatactagagcgtttgcatataaaaaacgataaactggagcggaatttgcaaaatttagctgccttattgccattaaataaagtggaagaagtgcggttggtttttttaaagcatttttttgatgctgaacatttggtgggcaaagttgctcaactactacgaaattatcctgatgtggcattaaaaattatctgcgtgcatagcaaaggcgtacgtgatgaagctgggttatcagcgtatatcccaagtgtggaagaaactaatgcgctatctgcttatgcgcgtcaatgtggaattaacaagattttgactatttta

SEQ ID NO: 2620 - protein, 262 aa, Haemophilus influenzae
  Name: NTH1451
MTALSEIFVPLHRIIPFSNVEGQGNRSSIFLQGCKLNCLYCHNPETIPRYTESAKLVSLQYLYEQVMEAVPFIRGVTVSGGEPTIHHKKLVPLFKALRSQGLTCYLDSSGFFEFDRVCSLIDVTDKFLFDLKGEGIGLQTLCFDRKNQAGIVSQQVILERLHIKNDKLERNLQNLAALLPLNKVEEVRLVFLKHFFDAEHLVGKVAQLLRNYPDVALKIICVHSKGVRDEAGLSAYIPSVEETNALSAYARQCGINKILTIL

SEQ ID NO: 2621 - DNA, 1542 bp, Haemophilus influenzae
  Name: NTH1453
atgttagcttcacttcaagatattctcgatacggttaaagccaataatctgacttatcatcaaaaattaatgacattaggcaatattgccgagcgtttatttgatcctcgcgatttacttggctataccgatgaagaatggggctttttacagaatcagatgatttgtgatttatgtgaaggctacgcgatttatcgtcctcgttatatcctgcctgattacaatgtgtatatccaaaagggctgcgaatttttagagttgccgcctccaaaagatcttgatgaggcacttgatggattattgattctttactcccgcgtgccatccattacgacttatcctgtttatgttgggcgtcttgatgtgttgctcgaaccgttcattactgatgaagaaaaagattacataaaaattaaacgtttcttaaatcatattgataaaactgtgcctgactcattctgtcatgccaatattgggccttatgatacgaaagcaggtcgcttgattttacgcgccgtgattgagcttgaagcgccaacaccgaatatgactattcgttatgacaaatcgaaaacaagccgtgattttgctgaacttgcagcaaaagcctgtttgttggtttctaaaccatcttttgccaacgatgcttactatatttccgatctaggcgaagaatacggcgtagcaagttgctataacgcactgcctgaatgtggcggcgcctacaccttaacgcgtttacgtctagggacaattgctcgcacctgtaaaagtgcggatgaaatgctgaatgaattattaccgcgtgtggcgaaatgtgctctttcaaccatggataaacgccacaaatttgtagtggaagaaagtaatttctttaacagttcattcctcgaaaaagagggatttatcaaacgcactaattttacggggatgttcgcaattgtgggcttggcagatgcagcaaaccacttattgcaatgtgaaggcttaaatgaaacctttggtaagagcgttcgtggcgatgaaattgccactgcgattatggataaattgaaagaaattactgatgcgcacgaaggagtttatgccgaacgtactggcaatcgttatttattacacgcacaagtgggcgcaagtaaccacgaagaagacaagcgtaacgcaccggctcaccgtattcgtgtaggcgaagaaccaacgttacttgcacatttgaaacaatctgcaccgttccataaatatttcccatctggtacaggggatttattcgcctttgatcaaacctatgtagatcactgcgatgcagtggtggatattattgatggcgcattttccttaggctatcgctacattaccacctatttgaaaaatacagatttaattcgagttacaggttatctagtgaagaaaagcgaagttgaaaaataccgtaaaggcgaagttgcattacgcgatacaacttggtatggctcgggtacggatgaatgtgccaatgtgtttgatcgccaattacgcaatgaaaaagatgtgatcgctgaaaaa

SEQ ID NO: 2622 - protein, 514 aa, Haemophilus influenzae
  Name: NTH1453
MLASLQDILDTVKANNLTYHQKLMTLGNIAERLFDPRDLLGYTDEEWGFLQNQMICDLCEGYAIYRPRYILPDYNVYIQKGCEFLELPPPKDLDEALDGLLILYSRVPSITTYPVYVGRLDVLLEPFITDEEKDYIKIKRFLNHIDKTVPDSFCHANIGPYDTKAGRLILRAVIELEAPTPNMTIRYDKSKTSRDFAELAAKACLLVSKPSFANDAYYISDLGEEYGVASCYNALPECGGAYTLTRLRLGTIARTCKSADEMLNELLPRVAKCALSTMDKRHKFVVEESNFFNSSFLEKEGFIKRTNFTGMFAIVGLADAANHLLQCEGLNETFGKSVRGDEIATAIMDKLKEITDAHEGVYAERTGNRYLLHAQVGASNHEEDKRNAPAHRIRVGEEPTLLAHLKQSAPFHKYFPSGTGDLFAFDQTYVDHCDAVVDIIDGAFSLGYRYITTYLKNTDLIRVTGYLVKKSEVEKYRKGEVALRDTTWYGSGTDECANVFDRQLRNEKDVIAEK

SEQ ID NO: 2623 - DNA, 147 bp, Haemophilus influenzae
  Name: NTH1454
gtggcagcccaagatgtgcgaggtataacgcgtacttttttcttcatatttattaccttttatattccgttttatcataaaaggaaagatgcaaaaacagaaataattttgtcagttcatttatatcaaaaacatatttattttgag

SEQ ID NO: 2624 - protein, 49 aa, Haemophilus influenzae
  Name: NTH1454
VAAQDVRGITRTFFFIFITFYIPFYHKRKDAKTEIILSVHLYQKHIYFE

SEQ ID NO: 2625 - DNA, 177 bp, Haemophilus influenzae
  Name: NTH1455
atgaagaaaaaagtacgcgttatacctcgcacatcttgggctgccacatcattatggaccgcgcaatataaaaccatttcaatcttactttttgctctttctattttaggtattggagatgggcttattgtattatcaggtttaggatcgacaccttggactgtacttcacaaggta

SEQ ID NO: 2626 - protein, 59 aa, Haemophilus influenzae
  Name: NTH1455
MKKKVRVIPRTSWAATSLWTAQYKTISILLFALSILGIGDGLIVLSGLGSTPWTVLHKV

SEQ ID NO: 2627 - DNA, 153 bp, Haemophilus influenzae
  Name: NTH1456
gtggggatggccccattatgggtggacgtgcattataacgtctatccaccaaaagttggaatacagcttggcacaacaaattctatctggtgcgttattcctggtaaggttgttaccattgattacgccaacgcagaagttcaagctagacaa

SEQ ID NO: 2628 - protein, 51 aa, Haemophilus influenzae
  Name: NTH1456
VGMAPLWVDVHYNVYPPKVGIQLGTTNSIWCVIPGKVVTIDYANAEVQARQ

SEQ ID NO: 2629 - DNA, 738 bp, Haemophilus influenzae
  Name: NTH1457
atgtcagaacaaatctacggtattcacgcggttaatagtattttaacccattcgccagagcgtctaattgaagtcttcgtacttaaaagacgtgaagataaacgcctacagccactcttaaatgagctttattccctgggaattggtgtgcaatttgttaatcgacaaacacttgataaaaaagccgatggtgaggttcatcagggtgtcattgctcgagtacaagcggcaaaagaacttaatgaaaatgatcttgatgaaattcttgcgaataaacaaaatccgcttttattagttttggatggcgtgacggatccacacaacttgggtgcctgcctgcgaacagcggatgcagcgggcgcagtggcagtgatcgtaccgaaagataaatccgcacaattaacatctatcgcacgtaaagttgcttgtggcgcggcagaaaccgtgccgttaattcgtgtaaccaatctttctcgcacactgcgcgatttacagcaaaaccataatatttgggtggttggcactgctggcgaagccactgaaaccatttatcaaagcaaactgacaggaccactagcacttgttatgggagccgaaggcgaaggaatgcgtcgtttaacgcgtgaacattgcgatcaactgattagtattccaatggctggttcagtttcatcattaaatgtatctgtcgcaacaggggtatgtttatttgaaattgcacgtcagcgtttaggttca

SEQ ID NO: 2630 - protein, 246 aa, Haemophilus influenzae
  Name: NTH1457
MSEQIYGIHAVNSILTHSPERLIEVFVLKRREDKRLQPLLNELYSLGIGVQFVNRQTLDKKADGEVHQGVIARVQAAKELNENDLDEILANKQNPLLLVLDGVTDPHNLGACLRTADAAGAVAVIVPKDKSAQLTSIARKVACGAAETVPLIRVTNLSRTLRDLQQNHNIWVVGTAGEATETIYQSKLTGPLALVMGAEGEGMRRLTREHCDQLISIPMAGSVSSLNVSVATGVCLFEIARQRLGS

SEQ ID NO: 2631 - DNA, 2346 bp, Haemophilus influenzae
  Name: NTH1459
atgacaaaaaaacgtaaaaacttaatcagccaagatcctcattacaaacgagaattggaaaaatacggcaatccaatcccgagccgtgaatttattttaagcgttattcgagacaataatgcaccgatgaatcgggatgaaattttgaccgcactttccattcgaaatgaagagcaaatagaagcgatgcgtcgccgattacgcgcgatggaaaatgatggccaattagtgttcaccaaacgtaaacgctatgccttaccagaaaaattagatttatttaaaggcacggtaattggtcatcgcgaaggttttggttttttacaggtcgatggcaaaaaggatgatttattcattccaaaccatcaaatgcaaagagtcatgcatggagattttgtcttagcgcaacttgctggattagatcgtcgtggtcgccgtgaagtgcgaattgtgcgcgtattagaaagccgtaaaaaacaaattgtgggtcgttttttcttagaaaacggttttagctatgtggtgcctgatgacagcagaattggtcgagatattctcgtgccaaatgaacatcgtaatggtgctcgcatgggacaagttgtggttgtcgagttgcaagaacgttctgccagttttaaccagccaattggcgtaatcacagagatcctaggcgataatatggcgaaagaaatggaagtggaaatcgccttgcgtaaccacgatattccccataagtttccaagtgcggtggaaaaatacgtaaaaaaattcactgaagaagtgcctgaagaagcaaaaaaaggccgtgtggatttacgaaatttaccgcttgtgaccattgatggtgaagatgcgcgggattttgacgatgccgtttattgtgaaaaacacggcaaaggctggaaactttgggtggcgattgcggatgttagttattacgtacgtttacgttccgctttggatgtggaagcgcataatcgtggtaactcggtctattttccgaaccgagttgtacctatgctacccgaaattttatcgaacggcttatgctctctaaacccacaagtggatcgtttgtgtatggtgtgtgagatgcaaatttctgccaaaggtaagctcatagattatcgcttttatgaagcagtgatgaattctcacgcccgcctcacttatacaaaagtagcaaaaatgcttgaaggcgatgaagaattacgcgctcgttattctacgcttgtgcctcatttagaagatctttataaactctatcaagcgttgcttggtgcacgtcatcaacgtggtgcgatcgattttgaaaccattgaaactaagtttatttttaatgcaatggggagaattgagcgtattgaacccgttgttcgcaatgatgcccacaaaatcattgaggaatgtatgattcttgcgaatatcgcagcagctaattttatggaaaaacataaagaacctgcattatatcgcattcatgccaccccgagcgaagaaaaattaacatcgttccgcactttcttaagtgagtttggtttaaccttagaaggtggattgaagccaaccacaaaagactatgctgctctcttagaaaaagttaaagaacgacatgatcatgaacttattcaaacaatgttgctacgttcattaagtcaagccgtctatcatgctgataatattgggcattttggtttggctttggaagaatatgcacactttacttcgccaattcgccgttatccagacttaacacttcatcgaggtatcaagtatttactcgctaaagaacaaggcgcaaaacgtaaaaccaccgatacaggcggttatcattactcttttgatgaaatggatttacttggcaatcactgttcaatgacggaacgccgtgccgacgacgccactcgtgaagtggcagattggctgaaatgcgaatatatgcaagatcatgttggcggtgaatttagcggtgttatttcatctgtgactggatttggtttatttgtacgcttagatgatttattcatcgatggtttagtccatatttccaccttagaaaacgattattaccaattcgatgcagcaaaacagcgtttaattggcgaaaatagcggaatgcaatatcgcttaggcgataaagttcgtatcaaagttgaagcagtacatttagaaaataaaatggtcgatttctcgctgatggggagtgaacgtaaacctcgtcgtgctggaaaaacggcgaaagaaaaagccaagaaagtctttaaagaactaccgtctaaaacatcccagaaacgaaaaagtgcggtaaaaaagaaagatgttttgaagaaagcatctagaaaacgaaaa

SEQ ID NO: 2632 - protein, 782 aa, Haemophilus influenzae
  Name: NTH1459
MTKKRKNLISQDPHYKRELEKYGNPIPSREFILSVIRDNNAPMNRDEILTALSIRNEEQIEAMRRRLRAMENDGQLVFTKRKRYALPEKLDLFKGTVIGHREGFGFLQVDGKKDDLFIPNHQMQRVMHGDFVLAQLAGLDRRGRREVRIVRVLESRKKQIVGRFFLENGFSYVVPDDSRIGRDILVPNEHRNGARMGQVVVVELQERSASFNQPIGVITEILGDNMAKEMEVEIALRNHDIPHKFPSAVEKYVKKFTEEVPEEAKKGRVDLRNLPLVTIDGEDARDFDDAVYCEKHGKGWKLWVAIADVSYYVRLRSALDVEAHNRGNSVYFPNRVVPMLPEILSNGLCSLNPQVDRLCMVCEMQISAKGKLIDYRFYEAVMNSHARLTYTKVAKMLEGDEELRARYSTLVPHLEDLYKLYQALLGARHQRGAIDFETIETKFIFNAMGRIERIEPVVRNDAHKIIEECMILANIAAANFMEKHKEPALYRIHATPSEEKLTSFRTFLSEFGLTLEGGLKPTTKDYAALLEKVKERHDHELIQTMLLRSLSQAVYHADNIGHFGLALEEYAHFTSPIRRYPDLTLHRGIKYLLAKEQGAKRKTTDTGGYHYSFDEMDLLGNHCSMTERRADDATREVADWLKCEYMQDHVGGEFSGVISSVTGFGLFVRLDDLFIDGLVHISTLENDYYQFDAAKQRLIGENSGMQYRLGDKVRIKVEAVHLENKMVDFSLMGSERKPRRAGKTAKEKAKKVFKELPSKTSQKRKSAVKKKDVLKKASRKRK

SEQ ID NO: 2633 - DNA, 249 bp, Haemophilus influenzae
  n 244, 245, 246, 247, 248: n is any nucleotide
  Name: NTH1460
atgaaagtagaaaaaaatgtagtggtgagcatttcttaccaagttcgcacacaagatggcgtattggtagatgaagctccagcaaatcaaccactagaatatttacaaggtcacaataatttagtagtcggtcttgaaaaagcacttgaaggtaaagaagttggcgacaaatttgaagtacgtgtacaacctgaagaaggttatggtgcgtacagcgaaaatatggttcaacgtgtacggggtnnnnnt

SEQ ID NO: 2634 - protein, 83 aa, Haemophilus influenzae
  Xaa 82, 83: Xaa is any amino acid
  Name: NTH1460
MKVEKNVVVSISYQVRTQDGVLVDEAPANQPLEYLQGHNNLVVGLEKALEGKEVGDKFEVRVQPEEGYGAYSENMVQRVRGXX

SEQ ID NO: 2635 - DNA, 420 bp, Haemophilus influenzae
  Name: NTH1461
atgtcaaaatgggctgaattacaagcagaaacccgtgaaattatcgaagatttacttaatgatggcagtgatccaaatgcgctttacattattgagcatcacatcgcacaccacgattttgatttgttagaaaaaattgcggttgatgcgtttaaagcgggctatgaagtttccgaagcggaagaatttaaagatgatgacggtaaaccaattttctgttttgacatcatcagtgaagtagaattaaaagctgaaattatcgatgcacaacaaaaacaaatccttccattgttagaaaaacataaaggcatttatgatggttggggcacctattttgaagacccaaatgccgatgacgatgaatacggtgacgatggggaattttttgatgatgaagatgaagaagagcctcgtgttcat

SEQ ID NO: 2636 - protein, 140 aa, Haemophilus influenzae
  Name: NTH1461
MSKWAELQAETREIIEDLLNDGSDPNALYIIEHHIAHHDFDLLEKIAVDAFKAGYEVSEAEEFKDDDGKPIFCFDIISEVELKAEIIDAQQKQILPLLEKHKGIYDGWGTYFEDPNADDDEYGDDGEFFDDEDEEEPRVH

SEQ ID NO: 2637 - DNA, 384 bp, Haemophilus influenzae
  Name: NTH1462
atggcaagagaatttaaacgtagcgatcgcgtcgctcaagaaatacaaaaagaaatagcagtcattttacaacgcgaagtgaaagatccccgtattgggatggtgacggtttctgatgtggaagtgtcgagcgatttatcttacgcaaaaatctttgtgacttttttattcgatcacgatgaaacggcaattgagcaaggcatgaaaggcttagaaaaagcatcgccttatattcgttcattactaggcaaagcgatgcgtttacgtatcgtgccagagattcgctttatttatgatcaatccttagtggaagggatgcgtatgtcaaatcttgtgacaaatgttgtgcgtgaagatgagaaaaaacacgttgaggaaagcaac

SEQ ID NO: 2638 - protein, 128 aa, Haemophilus influenzae
  Name: NTH1462
MAREFKRSDRVAQEIQKEIAVILQREVKDPRIGMVTVSDVEVSSDLSYAKIFVTFLFDHDETAIEQGMKGLEKASPYIRSLLGKAMRLRIVPEIRFIYDQSLVEGMRMSNLVTNVVREDEKKHVEESN

SEQ ID NO: 2639 - DNA, 918 bp, Haemophilus influenzae
  Name: NTH1463
atgtctagacctcgtaaacgctggcgtgatgttgatggtgtgtttttgttggataaaccacaaggtatgtcatcaaatgacattatgcaaaaggtgaagcgtttatttcaagcgaataaagcagggcatacaggtgcgctcgatccgttggctacgggaatgttgccaatttgcttgggtgaagcaactaagttttcacaatttttgcttgatgccgataagcgttatcttgttacggcaaaattaggcgaacgtaccgatacttccgatgcggaagggcaagtcgtggaaactcgtgaagttcatgttgaaactccgcaaattttgaccgcacttgaacaatttcgtggcgatattttgcaagtgccgaccatgttttccgcactaaaacataacggtaaaccgctttatgaatatgcgcgtcaaggtattacggttgagcgtgaggcacgtccaattacgatttttgaacttaattttattgaatatcacgcaccttttttaaccttagaagtacattgttcaaaaggcacttatattcgcaccttagtcgatgatttgggtgaagtgctaggttgtggcgcacatgtgacaatgttacgccgtacagccgtagcggattaccccgtagcagaaatgataccaatcaatgagttacaactgctcgctgaaagttttccattaagtgaattagatcgtctattactgccaaccgataccgcagtaagtaaattgcccgctttgcatttggatgtagagcagagtaaagccattggttttggtcagcgagtgaaatttgctaatgaacagcaattaggtggccaagtgcggttattttcagcggagaatttattcttaggcgtggcattaatcgacgggaatattattcgcccacaacggttaattacacaatctgca

SEQ ID NO: 2640 - protein, 306 aa, Haemophilus influenzae
  Name: NTH1463
MSRPRKRWRDVDGVFLLDKPQGMSSNDIMQKVKRLFQANKAGHTGALDPLATGMLPICLGEATKFSQFLLDADKRYLVTAKLGERTDTSDAEGQVVETREVHVETPQILTALEQFRGDILQVPTMFSALKHNGKPLYEYARQGITVEREARPITIFELNFIEYHAPFLTLEVHCSKGTYIRTLVDDLGEVLGCGAHVTMLRRTAVADYPVAEMIPINELQLLAESFPLSELDRLLLPTDTAVSKLPALHLDVEQSKAIGFGQRVKFANEQQLGGQVRLFSAENLFLGVALIDGNIIRPQRLITQSA

SEQ ID NO: 2641 - DNA, 1137 bp, Haemophilus influenzae
  Name: NTH1464
ttgcaggtgggttttatggaagtccttaaagatttacgttctgaaattgattcgcttgatcgcgaacttatccaactttttgctaaacgtcttgagttggtttctcaagtcggtaaagtgaaacatcaacatggattacctatttatgcgccagagcgtgaaatagcaatgctccaagcacgtcgtttagaggctgaaaaagcaggcatttcagccgatttaattgaagatgttctacgccgttttatgcgtgaatcctatgccaatgaaaaccaatttggttttaaaactatcaattctgatattcacaaaattgttatcgtgggcggttatggtaaattaggtggcttatttgcccgttatttacgtgcatctggctatccaatttctattttagatcgcgaagattgggcggtggctgaaagtattttagcgaatgctgatgtcgtgatcgtttccgtccccatcaatattactttggaaacgattgagcgactaaaaccttatttaacagaaaatatgttgcttgcagatttaacttctgttaagcgtgaaccgctagcgaaaatgcttgaagttcattctggtgcagttttaggtttacatccaatgtttggtgcagacattgcaagtatggcaaaacaagtggttgtacgttgtgatggacgttttcctgaacgttatgaatggttacttgagcaaattcaaatttggggcgcaaaaatttatcaaaccaatgccacagaacacgatcacaatatgacttatatacaagccttgcgccatttttcgacttttgcgaatggtttacacctttccaaacagcccattaatctcgctaatttattggcgctttcttctcctatttatcgcttagaacttgcgatgatcggtcgcttatttgcgcaagatgcagagctttacgcagatattattatggataagccagaaaatttagcggtaattgaaacgctaaaacaaacttacgacgaagccttaactttctttgaaaagaatgatcgtcaaggttttattgatgctttccacaaggtgcgtgactggtttggcgattattctgaacaattcttaaaagaaagccgtcagctattacagcaggcaaatgatttgaaacaaggg

SEQ ID NO: 2642 - protein, 379 aa, Haemophilus influenzae
  Name: NTH1464
LQVGFMEVLKDLRSEIDSLDRELIQLFAKRLELVSQVGKVKHQHGLPIYAPEREIAMLQARRLEAEKAGISADLIEDVLRRFMRESYANENQFGFKTINSDIHKIVIVGGYGKLGGLFARYLRASGYPISILDREDWAVAESILANADVVIVSVPINITLETIERLKPYLTENMLLADLTSVKREPLAKMLEVHSGAVLGLHPMFGADIASMAKQVVVRCDGRFPERYEWLLEQIQIWGAKIYQTNATEHDHNMTYIQALRHFSTFANGLHLSKQPINLANLLALSSPIYRLELAMIGRLFAQDAELYADIIMDKPENLAVIETLKQTYDEALTFFEKNDRQGFIDAFHKVRDWFGDYSEQFLKESRQLLQQANDLKQG

SEQ ID NO: 2643 - DNA, 879 bp, Haemophilus influenzae
  Name: NTH1465
gtgtcgaaatttgcaaaagtcgaacacctaatcggagaaaagatgaattaccaagacaacagcttaaaatccttaaaactcggtcaaaaaacggaatacgcctctcaatatgaccgcactttattacagcctgtgccacgtgcgttaaatcgtgatggattaggcattactcaaaaccaaccatttactatcggcgccgatatttggacggcttatgaaatctcgtggctcaacgaaaaaggcttaccgcaagtggctatcgcagatatttatctggattatcaaagccaaaatttgattgaatcaaaaagttttaaactttatttaaatagctttaaccaaagcaaatttaccgacttcaacgccgttcaacaaactatgcaacgcgatttaatcgaatgtgcgcaaggcgatgtaaaagtgcggttaaatccagtggcagtttatgatgctcaaaaaattgagcatttacaaggcgattgcattgatgaacaagatattgaaattactagctacgaatttaacgctaattggctgaaagattgcgtatcggatgaaattgtcgaagaaaaattagtcagccatttattgaaatctaactgcctcattaccaatcagccagactggggcaccttgcatattcactatgttggtaaaaaaatcaatcacgaaaaattattgcgttacgttatatcgttccgtcagcataatgaattccacgaacaatgtgtcgaacgtattttttgcgatttaatgcactacgcaaaaccagaaaaactcaccgtttacgcacgctatactcgtcgtggcggattagacattaatccattccgctctaattttgagaatttacctgaaaatttaagattggcgagacag

SEQ ID NO: 2644 - protein, 293 aa, Haemophilus influenzae
  Name: NTH1465
VSKFAKVEHLIGEKMNYQDNSLKSLKLGQKTEYASQYDRTLLQPVPRALNRDGLGITQNQPFTIGADIWTAYEISWLNEKGLPQVAIADIYLDYQSQNLIESKSFKLYLNSFNQSKFTDFNAVQQTMQRDLIECAQGDVKVRLNPVAVYDAQKIEHLQGDCIDEQDIEITSYEFNANWLKDCVSDEIVEEKLVSHLLKSNCLITNQPDWGTLHIHYVGKKINHEKLLRYVISFRQHNEFHEQCVERIFCDLMHYAKPEKLTVYARYTRRGGLDINPFRSNFENLPENLRLARQ

SEQ ID NO: 2645 - DNA, 372 bp, Haemophilus influenzae
  Name: NTH1466
ttgaaaaatcacccgcacttaagccaagatctgattaaatggcaagaaaattggcaagcctgcgatcaactacaaatgaatggtgcggtattagaacaacaatctttggcagaaatttcggagcaccaaagcacactttcaaaacacggacgatatttagctcaagaaatagaaaaagaaactggcataccgacttactattatttatatcgtgtaggtgggcaatctttaaaatctgaaaaatcccgttgctgcccttcttgtggtgcaaattgggcgttaaaaaacgcgatttttgatacctttcattttaaatgcgatacctgtcgattcgtttcgaatctatcgtggaatttttttgtaattaattta

SEQ ID NO: 2646 - protein, 124 aa, Haemophilus influenzae
  Name: NTH1466
LKNHPHLSQDLIKWQENWQACDQLQMNGAVLEQQSLAEISEHQSTLSKHGRYLAQEIEKETGIPTYYYLYRVGGQSLKSEKSRCCPSCGANWALKNAIFDTFHFKCDTCRFVSNLSWNFFVINL

SEQ ID NO: 2647 - DNA, 114 bp, Haemophilus influenzae
  Name: NTH1467
gtgacaaaaggtcgtcacgatccttgtgtgggtattcgtgctgtacccatcgcagaagccatgatggcgattgtcttattagatcatctattacgttttaaggcgcagtgtaaa

SEQ ID NO: 2648 - protein, 38 aa, Haemophilus influenzae
  Name: NTH1467
VTKGRHDPCVGIRAVPIAEAMMAIVLLDHLLRFKAQCK

SEQ ID NO: 2649 - DNA, 858 bp, Haemophilus influenzae
  Name: NTH1468
atgaataaaattttattaaaaacaaccataatttttaccgcacttttctctctgaacgttgttgcgtctcctctagattggcaaaaagtgaaacgtcctattccaagtgacgatgggaaagcaaaacctattggtagctataccaatgggtgtattattggggcgcaagcactaccgccgaaaggagacggttaccaagttattcgtatgaatcgcaatcgttattatggtcatccaaatatgattcagtatattgaacgtttggggcagcgagctaaagctgctgggttaccaactatgttagtgggtgatattgccatgccgggtggcgggcggtttttaacgggtcatgctagccatcagatgggattagatgcggatatttggttaagaatgggcgaaatgtcagacgccgatgcgctgaattctgatggtaaaggtttattagttgtagatagaaaggcgcaacgagtggatgaacgagtatggaatagcaatcatgcgacgttaatcaagttagccgcacaagatccaaatgtgacgcgtatttttgttaatcctgcgattaaggtaaaattatgtcaaaccgctggcaatgatcgcggttggctacacaaagttcgtccttggtatggacacaactctcattttcatgttcgtttaacttgccccgcagatgcatcttattgtgaaaatcaagcgcctgtgcctgctggtgatggttgtggagacgaattatattcttggtttgaaccgccaaaaccaggtgcttcagtgagcaaacctaaagttacaccgcctgagccgtttttgtgccaacaaattttaaattccccgaatcggagtgaatggttagaa

SEQ ID NO: 2650 - protein, 286 aa, Haemophilus influenzae
  Name: NTH1468
MNKILLKTTIIFTALFSLNVVASPLDWQKVKRPIPSDDGKAKPIGSYTNGCIIGAQALPPKGDGYQVIRMNRNRYYGHPNMIQYIERLGQRAKAAGLPTMLVGDIAMPGGGRFLTGHASHQMGLDADIWLRMGEMSDADALNSDGKGLLVVDRKAQRVDERVWNSNHATLIKLAAQDPNVTRIFVNPAIKVKLCQTAGNDRGWLHKVRPWYGHNSHFHVRLTCPADASYCENQAPVPAGDGCGDELYSWFEPPKPGASVSKPKVTPPEPFLCQQILNSPNRSEWLE

SEQ ID NO: 2651 - DNA, 765 bp, Haemophilus influenzae
  Name: NTH1470
atggatatcggcattgatcttttagcaatattgttttgtgttggttttgtcgcatcatttatcgatgcaattgctggcggtggtggattaattactattccagcgttgcttatgactggcatgccaccagcaatggcgttaggcaccaacaaattgcaagctatgggcggtgcattatccgcaagcctttatttcttgcgaaaaagagcggtcaatttacgcgatatttggtttattttgatttgggttttcttaggttcagccctaggtacattattaattcaatcaattgacgtggcgattttcaaaaaaatgctgccttttttgattttagctattggtctatattttttatttacccctaaattaggtgatgaagatcgaaaacagcgtttaagttacatgttatttggtcttttagttagcccatttttaggtttttatgatggcttctttggaccagggactggctcaatcatgagtttagcctgtgttactttgctaggatttaatctcccgaaagcgacggcacatgcaaaagtgatgaacttcacttcgaaccttgcttcttttgcgcttttcttattgggtggacaaattctttggaaagtgggtttcgtgatgatggctgggagcattttaggtgcaaatttaggtgccaaaatggtgatgacgaaaggtaaaaccttgattcgaccgatggttgttatcatgtcttttatgatgacggctaaaatgatttacgatcagggttggtttcatttt

SEQ ID NO: 2652 - protein, 255 aa, Haemophilus influenzae
  Name: NTH1470
MDIGIDLLAILFCVGFVASFIDAIAGGGGLITIPALLMTGMPPAMALGTNKLQAMGGALSASLYFLRKRAVNLRDIWFILIWVFLGSALGTLLIQSIDVAIFKKMLPFLILAIGLYFLFTPKLGDEDRKQRLSYMLFGLLVSPFLGFYDGFFGPGTGSIMSLACVTLLGFNLPKATAHAKVMNFTSNLASFALFLLGGQILWKVGFVMMAGSILGANLGAKMVMTKGKTLIRPMVVIMSFMMTAKMIYDQGWFHF

SEQ ID NO: 2653 - DNA, 90 bp, Haemophilus influenzae
  Name: NTH1471
ttggtttcatttttaattcggaaagcgcgcaaaagtgcggttaaaattaattacattttattatgtcggataatcaacaaaatttacgtt

SEQ ID NO: 2654 - protein, 30 aa, Haemophilus influenzae
  Name: NTH1471
LVSFLIRKARKSAVKINYILLCRIINKIYV

SEQ ID NO: 2655 - DNA, 954 bp, Haemophilus influenzae
  Name: NTH1472
atgtcggataatcaacaaaatttacgtttgacggcgagagtgggctatgaagcgcacttttcatggtcgtatttaaagcctcaatattgggggatttggcttggtattttctttttattgttgttagcatttgtgccttttcgtctgcgcgataaatttgcgggaaaattaggtatttggattgggcataaagcaaagaaacagcgtacgcgtgcacaaactaacttgcaatattgtttccctcattggactgaacaacaacgtgagcaagtgattgataaaatgtttacggttgttacacaagttatgtttggaattggtgagattgcaatccgttcaaagaaacatttgcaaaaacgaagcgaatttatcggtcttgaacatatcgaacaggcaaaagctgaaggaaagaatattattcttatggtgccacatggctgggcgattgatgcgtctggcattattttgcacactcaaggcatgccaatgacttctatgtataatccacaccgtaatccattggtgaattggctttggacgattgcacgccaacgtttcggcggaaaaatgcacgcacgccaaaatggtattaaaccttttttaaatcatgttcgtaaaggcgaaatgggttattacttaccagatgaagattttggggtggaacaaagcgtatttgttgatttctttgggacttataaagcgacattgccagggttaaataaaatggcaaaactttctaaagccgttgttattccaatgtttcctcgttataacgctgaaacgggcaaatatgaaatggaaattcatcctgcaatgaatttaagtgatgatcctgaacaatcagcccgagcaatgaacgaagaaatagaatcttttgttacaccatctccagagcaatatgtttggattttgcaattattgcgtacaaggaaagatggtgaggatctttacgat

SEQ ID NO: 2656 - protein, 318 aa, Haemophilus influenzae
  Name: NTH1472
MSDNQQNLRLTARVGYEAHFSWSYLKPQYWGIWLGIFFLLLLAFVPFRLRDKFAGKLGIWIGHKAKKQRTRAQTNLQYCFPHWTEQQREQVIDKMFTVVTQVMFGIGEIAIRSKKHLQKRSEFIGLEHIEQAKAEGKNIILMVPHGWAIDASGIILHTQGMPMTSMYNPHRNPLVNWLWTIARQRFGGKMHARQNGIKPFLNHVRKGEMGYYLPDEDFGVEQSVFVDFFGTYKATLPGLNKMAKLSKAVVIPMFPRYNAETGKYEMEIHPAMNLSDDPEQSARAMNEEIESFVTPSPEQYVWILQLLRTRKDGEDLYD

SEQ ID NO: 2657 - DNA, 378 bp, Haemophilus influenzae
  Name: NTH1473
atgaataatttgttcgccttgtgccaacgaagtgcggctattttttctattatttttacgggggaggcttgcgataaattggatagtcctaagcctatttcgccacaaattgagacacaaaaaaatactcaattagaatctaaccgagttgaattaaaacgtggcgtttatagcgatttgactttgcaaccttggcaagcacaaagcgaagaacaaactcaattattacgagatctttttgaaggattaacggcttatgatgtgcaaaggaatcttgttccagctgtagcccaaaattggcaaaccgaagacaataaaacttggattttcactttgcgggaaaagcttaatggtcaaatggcgagcctatcactgcat

SEQ ID NO: 2658 - protein, 126 aa, Haemophilus influenzae
  Name: NTH1473
MNNLFALCQRSAAIFSIIFTGEACDKLDSPKPISPQIETQKNTQLESNRVELKRGVYSDLTLQPWQAQSEEQTQLLRDLFEGLTAYDVQRNLVPAVAQNWQTEDNKTWIFTLREKLNGQMASLSLH

SEQ ID NO: 2659 - DNA, 465 bp, Haemophilus influenzae
  Name: NTH1474
ttgaaaactgtttttttatgtgacggcaaattctataatatcaaggttgaaaaatctaaaaaatcagtaataatagtttgcattttcttttttattaggaacattatgaaaattatttacattattttaggttttctttcacttgcaattggcatcattgggatttttcttcctcttttgcctaccacgccttttttattacttactttatttttcttcacaaaaggttcaaaacgcttagaacaatggtttttaggcacaagtatttatcaaaaacatctcaagtcctttcatgaaaatcgatcattaaagaaaaataccaaaatttttattttgacttttgctaccacaatgctactaattggtttttatttcacgccaagtgtaatagggcgtagtgttattgttgcgttgatttgtattaagttttggttcttcttattttggattaaaaccgaaaatgaa

SEQ ID NO: 2660 - protein, 155 aa, Haemophilus influenzae
  Name: NTH1474
LKTVFLCDGKFYNIKVEKSKKSVIIVCIFFFIRNIMKIIYIILGFLSLAIGIIGIFLPLLPTTPFLLLTLFFFTKGSKRLEQWFLGTSIYQKHLKSFHENRSLKKNTKIFILTFATTMLLIGFYFTPSVIGRSVIVALICIKFWFFLFWIKTENE

SEQ ID NO: 2661 - DNA, 2088 bp, Haemophilus influenzae
  Name: NTH1475
ttgccgtcacataaaaaaacagttttcaaaaaaggaacatttatgtctatgtcaaatccattacttcacattcaaggcctaccgccattttcacaaatcaagccagaacacattcaaccagctgttgaaaaattaattcaagattgtcgcaatacgatagaacaagtgttaaaacaaccgcactttacttgggaaaatttcattttgcctttaacggaaactaatgatcggttaaatcgtgcttggtcgcccgtttctcatctcaattcagtaaaaaatagcactgaattacgtgaagcctatcaaacgtgcttaccgttactttctgaatacagcacttggattggtcagcataaagggctttataatgcttatttagcgttaaaaaatagtgctgaatttgccgattattcgattgcacaaaagaaagccattgaaaattcactgcgtgattttgaactttcaggtatcgggctttccgaagagaaacaacaacgttatggcgaaattgtggcacgcttatcggaattaaattcacaattcagcaataatgtattagatgccacaatgggttgggaaaaactcattgaaaacgaagctgaacttgctggcttacccgaatccgcactgcaagcagcacaacaatctgccgaaagtaaaggattaaaaggttatcgttttacgttagaaatcccaagttatttgcctgtgatgacttactgcgaaaatcgtgcattgcgtgaagaaatgtaccgtgcttatgcaacacgcgcctctgaacaaggccctaatgcgggcaaatgggacaacagtaaagttatggaaagaaattcttacattacgcgtggaattggcgaaataccctcgggtttaatacttacaccgaactctcacttgccacaaaaatgggcagaaaacccacaacaagtgcttgatttcttagatcatcttgccgaacgtgccaaaccacaaggcgaaaaagaactgcaagaattgaaaaattactgcgaaaaagaatttggtgtcacggaacttgcaccttgggatattggtttttacagcgaaaaacaaaaacaacatttatacgccattaatgatgaagaacttcgcccatattttctagaaaatcgcgtgatttcaggattgtttaaattaattaaacgcattttcaatattcgtgcagtggaacgcaaaggcgtggatacttggcataaagatgtgcgtttctttgatttaatcgatgaaaatgatcaactccgaggcagtttctatcttgatttatatgcgcgcgaacataaacgtggcggtgcgtggatggatgattgtatcggacgtaagcgtaaactggatggcagcattgaaacgcctgtggcttatttaacttgcaacttcaacgcccctatagggaataaaccagcgttatttactcacaatgaagtcaccacgctattccacgaatttgggcacggaatccatcatatgctcacgcaaattgatgtatccgatgtggcgggtataaatggcgtgccttgggatgctgtggaattaccaagtcaatttatggaaaactggtgctgggaagaagaggctttggcgtttatttcagggcattacgaaacaggcgagccgttgccaaaagaaaaactcacgcaattattaaaagcgaaaaatttccaagctgcaatgtttatcttacgtcagcttgaatttgggatttttgatttccgcttgcatcacacctttgatgcggaaaaaaccaatcaaattttggatacacttaaatcagtgaaatcacaagttgccgtcataaaaggcgtagattgggcaagaacgccacacagcttcagccatatttttgcagggggctacgccgcaggttattacagctatttatgggctgaagtattatcagcagacgcttattcacgctttgaagaagaaggtattttcaacccaatcaccggcaaatcattcttagatgaaattctcacgcgtggtggctcagaagaaccaatggaactcttcaaacgcttccgtggccgtgaaccgcaattagatgcgttgttaagacataaaggaattatgaac

SEQ ID NO: 2662 - protein, 696 aa, Haemophilus influenzae
  Name: NTH1475
LPSHKKTVFKKGTFMSMSNPLLHIQGLPPFSQIKPEHIQPAVEKLIQDCRNTIEQVLKQPHFTWENFILPLTETNDRLNRAWSPVSHLNSVKNSTELREAYQTCLPLLSEYSTWIGQHKGLYNAYLALKNSAEFADYSIAQKKAIENSLRDFELSGIGLSEEKQQRYGEIVARLSELNSQFSNNVLDATMGWEKLIENEAELAGLPESALQAAQQSAESKGLKGYRFTLEIPSYLPVMTYCENRALREEMYRAYATRASEQGPNAGKWDNSKVMERNSYITRGIGEIPSGLILTPNSHLPQKWAENPQQVLDFLDHLAERAKPQGEKELQELKNYCEKEFGVTELAPWDIGFYSEKQKQHLYAINDEELRPYFLENRVISGLFKLIKRIFNIRAVERKGVDTWHKDVRFFDLIDENDQLRGSFYLDLYAREHKRGGAWMDDCIGRKRKLDGSIETPVAYLTCNFNAPIGNKPALFTHNEVTTLFHEFGHGIHHMLTQIDVSDVAGINGVPWDAVELPSQFMENWCWEEEALAFISGHYETGEPLPKEKLTQLLKAKNFQAAMFILRQLEFGIFDFRLHHTFDAEKTNQILDTLKSVKSQVAVIKGVDWARTPHSFSHIFAGGYAAGYYSYLWAEVLSADAYSRFEEEGIFNPITGKSFLDEILTRGGSEEPMELFKRFRGREPQLDALLRHKGIMN

SEQ ID NO: 2663 - DNA, 876 bp, Haemophilus influenzae
  Name: NTH1476
atggctgctgcaattcaacaacgtgccgaacttcaacgtcgtatttggcaaattgctaatgatgtgcgaggctcagtcgatggctgggatttcaaacaatatgtacttggcacacttttttaccgttttattagcgaaaattttgccaattacattgaagcaggcgatgaaagcgtaaattatgcccaattacctgatgaaatcattaccccagacattaaaacagatgccattaaaacgaaaggctactttatttacccaagccaattatttaagaatgttgcggctaatgctggcaacaatcctaatttgaatactgatttaaaacagatttttactgatattgaaaactcagcgacgggctttccgtctgaacaagatattaaaggcttatttgccgattttgataccaccagcaatcgcttaggcaataccgtaaaagataaaaacgaccgcttaacggctgttttgaaaggcgtggctgaacttgattttggcaaatttgaagataaccacattgatttatttggcgatgcatacgaatatcttatttctaactatgctgccaatgcaggcaaatctggtggtgaattttttaccccacaaagtgtttccaaactcattgctcaaattgcaatgcacgggcaaacctcggtcaataaaatttatgatcccgcagcaggttctggctcacttttgcttcaagccaaaaaacaatttgatgaacatattattgaagaaggctttttcgggcaggaaattaaccataccacatataaccttgcccgtatgaatatgtttttgcataacatcaactacgacaaatttgatattgctttaggcaacaccttaatggaaccacaatttggcgatgga

SEQ ID NO: 2664 - protein, 292 aa, Haemophilus influenzae
  Name: NTH1476
MAAAIQQRAELQRRIWQIANDVRGSVDGWDFKQYVLGTLFYRFISENFANYIEAGDESVNYAQLPDEIITPDIKTDAIKTKGYFIYPSQLFKNVAANAGNNPNLNTDLKQIFTDIENSATGFPSEQDIKGLFADFDTTSNRLGNTVKDKNDRLTAVLKGVAELDFGKFEDNHIDLFGDAYEYLISNYAANAGKSGGEFFTPQSVSKLIAQIAMHGQTSVNKIYDPAAGSGSLLLQAKKQFDEHIIEEGFFGQEINHTTYNLARMNMFLHNINYDKFDIALGNTLMEPQFGDG

SEQ ID NO: 2665 - DNA, 588 bp, Haemophilus influenzae
  n 529, 548, 588: n is any nucleotide
  Name: NTH1477
ttggcgatggataaacctttcgatgccatcgtttctaacccaccttactccgtgaaatgggctggctccgacaatccaacactgattaacgatgaacgatttgcccccgcaggcgtgcttgcaccaaaatccaaagcggattttgcctttattttacacgcattaagctatctttcaggcaaaggcagggcggcgattgtctccttcccaggcattttttatcgtggcggtgcggagcaaaaaattcgtcaatatttggtggataataattttgtggaaaccgtgattgcccttgcacctaatctattctacggcaccagtattgccgtaaatattttggttttgtccaagcacaaaccaaatacccaaactcaatttatcgatgccagcggtttatttaaatctgccaccaataacaacattttagaagaagaacatattgagcaaattctcaaactgtttgccaataaagaagatgtgccgcatttggcaaaatccgtatcctttgaagaaatcgcccaaaatgacncacaaccttgcagtaagtncgtatgtggaacaaaaagatacccgagaagaattaatatn

SEQ ID NO: 2666 - protein, 196 aa, Haemophilus influenzae
  Xaa 177, 183, 196: Xaa is any amino acid
  Name: NTH1477
LAMDKPFDAIVSNPPYSVKWAGSDNPTLINDERFAPAGVLAPKSKADFAFILHALSYLSGKGRAAIVSFPGIFYRGGAEQKIRQYLVDNNFVETVIALAPNLFYGTSIAVNILVLSKHKPNTQTQFIDASGLFKSATNNNILEEEHIEQILKLFANKEDVPHLAKSVSFEEIAQNDXQPCSKXVCGTKRYPRRINX

SEQ ID NO: 2667 - DNA, 1392 bp, Haemophilus influenzae
  Name: NTH1479
atgaattttcgtcttttatctcaataccacgctgatattaaaaagttgattaaaatttccttgcctattttattagcacaaatcgcacaaaactcaatgggattagcggataccattatggcgggtcgtgtgagttccactgatatggcagccatttctattggtgcttcaatttggatgccattgatgctttttggacaaggtttattgttggcattgccgcctacaatttcttatttgaatggttcaggccaacgccatcgcattgcccatcaagttcgccaaggcatttggcttgtgttaggcgtgagtattcctttagggttgctgatttatttctgtgaaattccgctgcaatatatgcaaatggaaagcaaaatgtcagatttagcacgggattatttacatgcgatgttgtggggattgccagcctatttgatgctgattaattttcgctgtttaaatgatggtattgctaaaactaagcctgcgatggtcattacctttttaggtttgctaattaatattccacttaattacatttttatttatggaaaatttggcatacctgcttttggtgcggtgggctgtggtattgcaacagctattgtgaactgggcaatgtgcttaatgatgattttttattcctatacgaatgctcaagaacgttcactaaaagtatttagccaattaatcgaaatgccaaatctgaaaacacttaaaaaattactgcgtttaggattacccattgccattgcaatttgttgtgaagtggcgttatttgcacttacgtctttaatgctttctccgctgggtgcaactattgtcgcaagccatcaaatcacattgaataccagttcttttatttttatgttccctatgtcgattggtatggcagcgacgattctagttggacaagcgttgggtacaggttctccacaaaatgcgaagaaaattggctatgccgcattattattagggctaacggtgacgattattactgcattaattacgattttcttccgttatgaaattgcctctattttcgtaaccgatgaaattgtcatcgcaatggcggcaaatttattattatttgccgcactttatcaattttcagataccattcaaatggtggttggtggcattttacgtggctataaagataccaaaatgattttatacattacccttttttcttattgggtaattggtgtgccacttggttacacactcggtcgtacagattggcttattccacatattgatgcgaaaggtttctggattgcttttgtggtctcactcacttttgcggcgttcttactttctttgagaatgaaaaaaatgcaggccatgagcgataacgccattttacaacgtttagaaaaacttaaa

SEQ ID NO: 2668 - protein, 464 aa, Haemophilus influenzae
  Name: NTH1479
MNFRLLSQYHADIKKLIKISLPILLAQIAQNSMGLADTIMAGRVSSTDMAAISIGASIWMPLMLFGQGLLLALPPTISYLNGSGQRHRIAHQVRQGIWLVLGVSIPLGLLIYFCEIPLQYMQMESKMSDLARDYLHAMLWGLPAYLMLINFRCLNDGIAKTKPAMVITFLGLLINIPLNYIFIYGKFGIPAFGAVGCGIATAIVNWAMCLMMIFYSYTNAQERSLKVFSQLIEMPNLKTLKKLLRLGLPIAIAICCEVALFALTSLMLSPLGATIVASHQITLNTSSFIFMFPMSIGMAATILVGQALGTGSPQNAKKIGYAALLLGLTVTIITALITIFFRYEIASIFVTDEIVIAMAANLLLFAALYQFSDTIQMVVGGILRGYKDTKMILYITLFSYWVIGVPLGYTLGRTDWLIPHIDAKGFWIAFVVSLTFAAFLLSLRMKKMQAMSDNAILQRLEKLK

SEQ ID NO: 2669 - DNA, 612 bp, Haemophilus influenzae
  Name: NTH1480
atgtttactggaattgtacaaggcaccgcccccatccactccattaaagaaacggctaattttagaacacaagtggtaaaattactacctgaaatgcgtaaagatctggaaattggcgcatcaatagcaaataacggtgtatgtttaactgtaactgaaatcaatggcgatctggttagctttgatctgatgcaagaaactttaaaaattacaaatctcggcacaataaaagtgggcgattatgtgaatatcgaacgtgctatgcaaatgggaacggaaattggcggacatttattatctggtcatatttattgcaccgcaaaaatttcagatattatcgctagtgaaaataaccgacaaatttggttcgagctcccaaacgcagatgtaatgaaatacattttaacgaaaggatttgttgcggtagatggtattagcctcactattggtgaagtaaaaggcacgcaattctgtgtgaatttaatccctgaaaccttgcaaagaacgttaatggggcaacgtaaagtgggcgatattgtgaatattgaaatcgatcctcaaacgcaagctattgtagatactgtagaaaattatttgcagtcaaaaaatttt

SEQ ID NO: 2670 - protein, 204 aa, Haemophilus influenzae
  Name: NTH1480
MFTGIVQGTAPIHSIKETANFRTQVVKLLPEMRKDLEIGASIANNGVCLTVTEINGDLVSFDLMQETLKITNLGTIKVGDYVNIERAMQMGTEIGGHLLSGHIYCTAKISDIIASENNRQIWFELPNADVMKYILTKGFVAVDGISLTIGEVKGTQFCVNLIPETLQRTLMGQRKVGDIVNIEIDPQTQAIVDTVENYLQSKNF

SEQ ID NO: 2671 - DNA, 636 bp, Haemophilus influenzae
  Name: NTH1482
ttgcgtgtttatacccatattcgtcttgatgattatcaagttacgcaacaagacatcgccttgcgtgcaatgcgtaatctttgcttaacttatttggcttatacgaatttgggtaacaacttagtgcaaaaacactataataatgcgaataatatgacagatacattggcagcattaagtgttgcaactaaagctgcattaccttgcagagatgcgttattagctgattttgaacaaaaatggcaacaggatggattagtgatggataaatggtttgcattacaagccactcgcccagatgaaaatgtgttggaaattattcagttattaatggatcacccaagttttaattttaataatccaaaccgtttacgttcattagtgggtagttttgcaaatcacaatttaaaagcatttcacaacgtaagcggttctggctatcgtttcttaacggatgtgttaatccgtttaaatgaaagtaatccacaagtggctgcgcgtttaatcgagccattaattcgattttctcgctttgatgctcaacgccaaacgctgatgaaacgtgctttagaacgcctaagcgttgtagaaaatctttcaaaagatttatttgaaaaaattgagaaagcgttgcag

SEQ ID NO: 2672 - protein, 212 aa, Haemophilus influenzae
  Name: NTH1482
LRVYTHIRLDDYQVTQQDIALRAMRNLCLTYLAYTNLGNNLVQKHYNNANNMTDTLAALSVATKAALPCRDALLADFEQKWQQDGLVMDKWFALQATRPDENVLEIIQLLMDHPSFNFNNPNRLRSLVGSFANHNLKAFHNVSGSGYRFLTDVLIRLNESNPQVAARLIEPLIRFSRFDAQRQTLMKRALERLSVVENLSKDLFEKIEKALQ

SEQ ID NO: 2673 - DNA, 420 bp, Haemophilus influenzae
  Name: NTH1483
atgcgtttgcgtaatgcttatgtgattaaagctgaacgtgtagaaaaagatgcaaatggtgaaatcaccacgatcttctgtacttacgatcctgaaactttaggtaaaaatccagcagatggacgtaaagtgaaaggtgtcattcattgggtttctgcggttaataatcatccagctgaattccgtttgtatgatcgcttatttactgtgccaaatccaggggctgaagatgatatcgaaagcgtgttaaacccaaattctttagtgataaaacaaggttttgtagagcaaagcctcgcaaatgcagaagcagagaaaggctaccaatttgaacgtgagggttatttctgtgcagatagtaaagatagccgacctgaacatttggtatttaacttaacagtaagcttaaaagaaggcttc

SEQ ID NO: 2674 - protein, 140 aa, Haemophilus influenzae
  Name: NTH1483
MRLRNAYVIKAERVEKDANGEITTIFCTYDPETLGKNPADGRKVKGVIHWVSAVNNHPAEFRLYDRLFTVPNPGAEDDIESVLNPNSLVIKQGFVEQSLANAEAEKGYQFEREGYFCADSKDSRPEHLVFNLTVSLKEGF

SEQ ID NO: 2675 - DNA, 462 bp, Haemophilus influenzae
  Name: NTH1484
atgcaatccaatatgcaacttgaacccaatttctggcaaacaaaatccctgcttgaaatgactgaatctgaatgggaagccttatgtgatggctgcggcaaatgctgttatcgcaaatatattcaagggcgaagtaaacgccaaaaactctattacacccgaattgcttgtaatcttttagatgtggaaacaggaaagtgcggtaattattcagagcgttttaacattgaaaccgattgcaccaaactcaccaaaaagaatttacctgattttcattggctgcctgatacttgcgcctatcgtttgctttatgaaggaaaaacactacctgaatggcatccgcttatttctggctctccccattctgtaaaaaatgcggatattttgattaaaaatggtatccacgaacgcgatgtgattgattggtttgaatttattattgacgaagatcacacttttaaa

SEQ ID NO: 2676 - protein, 154 aa, Haemophilus influenzae
  Name: NTH1484
MQSNMQLEPNFWQTKSLLEMTESEWEALCDGCGKCCYRKYIQGRSKRQKLYYTRIACNLLDVETGKCGNYSERFNIETDCTKLTKKNLPDFHWLPDTCAYRLLYEGKTLPEWHPLISGSPHSVKNADILIKNGIHERDVIDWFEFIIDEDHTFK

SEQ ID NO: 2677 - DNA, 2097 bp, Haemophilus influenzae
  Name: NTH1485
gtggtgtctatgcaaatctcggattctctcaaacaaaaagcagaaaaatgcggtatcgcgctttctcactatgatattgatgggcatcttatttttgcggatgaaaagacggttttaacttttgttgagcttttgcagcctccgccaaaagcgaaaggacagtttgacgatgtactggctgcatttgaaaatgaaccgattgattatcgactcaatcgtctagatctcccaccatctgcggaatatcgttatcagctgattgatgaatctaatgctattctgttagaaaaaatactttcaaatttatccgcactttctttgcctccacttccttttggctattatcaattatctattttttctgacactgaacagtatcgcgttcgtttacttatttctcctaaaacagcttttcaaccatccgtattaaaaaataaaaaagtgtggggcgtgaatgtgcaactttacagtttacgctcagaacaaaactgggggattggcgattttggcgatttggctgctttgattgaacaaagtgcaaaacaaggggcggattatgtgggaattaatccattacatttgccatatcctgctgtgccaaattgggctagtccttatagttcatcctctcgtcgttggttgaatttcttatatttggacattcctgatttacccgaatttaagcgttgccgttcagtacaaaattggtttaagcgtgaggatattaaagcaaaaattgctgctttacgtgaaagtgattgcgtcgattattcttcaattttggctttaaaattaaccgcacttgagtccctgttttatttctttcagcgtagtcaatccgttgaaattgtgacacgtcgaaaaatctttgctgattatttaaaaagcaaaggggaacctttgttgttacagggcttatttaatgtcttggatttacaagaacacgctgaccatcaagcagaagaaaataccattggttggcttggctggcgtaaggaatggcagcatttaagtgcggcaaaaagaaaagccctattaaaaatacaccatgagcaaatccaattttttgcttggttgcaatggcttacagaagaacaactttccgcattacaaaatctttgtaaacagtctggcatgaagttgggtatttatggcgatttagccgtaaatagttctcgtggcagtgctgatgtatggagcgatcctgatttatattgtgtaaatgcctctattggtgcgccacctgatccgttaggcccagtcgggcaaaattggaatttgccaccttataatccaacagtgctaaaagcacgtggctttacaccatttatcgatatgctacgtgccaatatgcaatatttcggtgtgctacgcatcgatcatgttatgggcttattccgtttgtggtggattccaaaaggaaaaaccgcggctgacggtgcttatgtgcattatccttttgatgaattaatggcgattcttgccattgaaagtgtacgcaatgaatgtttgattattggtgaagatctcggcactgtgcctgatgaagtgcggtggaaattaaacgagtttcaaattttctcttattttgtattgtattttgcccaacgaaatggcgaatttcctcgtatatctgattatcctcgaaatgcttatgccactattggtacacatgatgttccctcattacaaagtttttggcattgccgtgatttagaattatttaatcaactcggtattctgaatggggaagtgctcaagcaaaaatatgatcaacgtgttatggataaacaagccttattaaatagtttacatcgtgataattatttaccgccgcattatgaaggtgatgcactttctatggcgatgcacgattatttaaatcgaatgatccattattatttagcggaaagtaacagccgattgattggtgtgcaattagaaaatttacttagccaagaaatcagttctaatttaccgggcacctcaaatgaatacccaaactggtgcaagaaacttgctcaaccgttagcggttatttttagcaatgaagctttaaaaacgttctttgtgcaaattaaccaagggcgaaatgtt

SEQ ID NO: 2678 - protein, 699 aa, Haemophilus influenzae
  Name: NTH1485
VVSMQISDSLKQKAEKCGIALSHYDIDGHLIFADEKTVLTFVELLQPPPKAKGQFDDVLAAFENEPIDYRLNRLDLPPSAEYRYQLIDESNAILLEKILSNLSALSLPPLPFGYYQLSIFSDTEQYRVRLLISPKTAFQPSVLKNKKVWGVNVQLYSLRSEQNWGIGDFGDLAALIEQSAKQGADYVGINPLHLPYPAVPNWASPYSSSSRRWLNFLYLDIPDLPEFKRCRSVQNWFKREDIKAKIAALRESDCVDYSSILALKLTALESLFYFFQRSQSVEIVTRRKIFADYLKSKGEPLLLQGLFNVLDLQEHADHQAEENTIGWLGWRKEWQHLSAAKRKALLKIHHEQIQFFAWLQWLTEEQLSALQNLCKQSGMKLGIYGDLAVNSSRGSADVWSDPDLYCVNASIGAPPDPLGPVGQNWNLPPYNPTVLKARGFTPFIDMLRANMQYFGVLRIDHVMGLFRLWWIPKGKTAADGAYVHYPFDELMAILAIESVRNECLIIGEDLGTVPDEVRWKLNEFQIFSYFVLYFAQRNGEFPRISDYPRNAYATIGTHDVPSLQSFWHCRDLELFNQLGILNGEVLKQKYDQRVMDKQALLNSLHRDNYLPPHYEGDALSMAMHDYLNRMIHYYLAESNSRLIGVQLENLLSQEISSNLPGTSNEYPNWCKKLAQPLAVIFSNEALKTFFVQINQGRNV

SEQ ID NO: 2679 - DNA, 1779 bp, Haemophilus influenzae
  Name: NTH1487
atggacgaacaagttattaatcaaccttcccccgaagtgacagtggaaatcaaacgtaaagcacagcagatgtatttcagtggttataaaatcgctgaaatttcacgccagttaaatactcctgcctcaacaattgccagttggaaagacagagaaaaatgggacgatattgcgcctgttggtcgggttgaattggcattagagacaagattgaatttgctgattgcgaaagaagaaaagagcggttcagattacaaagaaattgatttgctcggtcgccaaatggaaagaatggcgagagtgaaaaagtattcttttggtgacggtaatgaagtagatttaaacccgaaactggcgaaccgcaacaagggcgaacggaagaaagccgaacccaatgccattgatcaggaacaagaggaattgctgataaatggctttcttgatgggatgtttaattatcaacgtatttggcacaaggcgaaagaacaccgcatcagaaatattttgaaaagccgacaaatcggggcgacttactattttgcccatgaagcctttattgatgctttgacgacggggcacaatcagattttcttatcagccagtaaaaaacaagccttacagtttcgctcgtacattgtgaattacgccaagcaaacggcagatgtagatttaaaaggcgaaaccatcaaattgccaaatggggcagaattgattttccttggcacgaactccgctacggctcaatcctaccacggcaatttgtatttcgatgaagtgttttgggtgcctaaatttgatgtgatgcgaaaagtggcatcaggtatggcagcacaaaaaatgtatcgccaaacttatttttccacgccgaccacaattgcacaccctgcttatgcgttcttttcaggcaaggcgtttaatcgcaatcgtgcgaaatcagaaaaaatcgaaatcgatatttctcacgaaaacttaaagagcggaaaactttgtgccgaccgtcaatggaagcagattgtgagtatttatgatgcaatggaaagtgggtgcaatctattcaatattgacgacctaatcgcagaaaacagcaaagaagaatttgaacaattgtttttgtgtcaatttgccgatgataacagttctgctttcaagttttcggacttacaactttgccaagtggatagtttggaagaatggcacgattataagccattttatcaacgtccattcggcaatcgtgaagtgtggttaggttatgaccctgcttttactggcgaccgtgcagcattagtgattgttgcaccgccgaaagtagaagggggcgattatcgcgttttacataaacaaacttttcacggtatggattacgaaacacaagcaagccgcattaagcagttttgtgatgattacaatgtgactcgcatcgtgattgataaaacgggtatggggtcgggcgtttatcaggaagtgagaaagttttatccaatggcgcagggcctagagtataacgccgatcttaaaaatgaaatggtgttaaaaacacaaaacttaattcagaaacgtcgccttaaatttgatagtggtgacaatgacatcgtgagtagttttatgaccgtgaaaaaacgcattactggcacagggaaaattacttatgtttcggaccgttcggaagatgcaagccacggcgatttatcatgggcaattatgaactgcattttaaatgtgccttatggtttaggcggcgatgtatcaagcaacaaatcaacaatatttacctttgaa

SEQ ID NO: 2680 - protein, 593 aa, Haemophilus influenzae
  Name: NTH1487
MDEQVINQPSPEVTVEIKRKAQQMYFSGYKIAEISRQLNTPASTIASWKDREKWDDIAPVGRVELALETRLNLLIAKEEKSGSDYKEIDLLGRQMERMARVKKYSFGDGNEVDLNPKLANRNKGERKKAEPNAIDQEQEELLINGFLDGMFNYQRIWHKAKEHRIRNILKSRQIGATYYFAHEAFIDALTTGHNQIFLSASKKQALQFRSYIVNYAKQTADVDLKGETIKLPNGAELIFLGTNSATAQSYHGNLYFDEVFWVPKFDVMRKVASGMAAQKMYRQTYFSTPTTIAHPAYAFFSGKAFNRNRAKSEKIEIDISHENLKSGKLCADRQWKQIVSIYDAMESGCNLFNIDDLIAENSKEEFEQLFLCQFADDNSSAFKFSDLQLCQVDSLEEWHDYKPFYQRPFGNREVWLGYDPAFTGDRAALVIVAPPKVEGGDYRVLHKQTFHGMDYETQASRIKQFCDDYNVTRIVIDKTGMGSGVYQEVRKFYPMAQGLEYNADLKNEMVLKTQNLIQKRRLKFDSGDNDIVSSFMTVKKRITGTGKITYVSDRSEDASHGDLSWAIMNCILNVPYGLGGDVSSNKSTIFTFE

SEQ ID NO: 2681 - DNA, 813 bp, Haemophilus influenzae
  Name: NTH1489
atggcaaaaaaatctaaatgggtggttgtggcgacagaaggcgcaaccacagacggacgcactattcagcgcaactggatttcagaaatggcggcaaattatgacccgaaaaaatacggtgcacgcgttaatcttgaacacattaaatggcgttatatgtggaacgatgatccgcactcaaaatgctatggtgatgtgattggtttaaaaacggaagaaaatgctgaaggtaaattgcaattactggctcaaatcgacccaacggacgatttaatcaaactcaataaagaccgtcagaaaatctacacctctattgagtgcgatccaaattttgctgacacaggtgaagcctatttagtcggtttggctgtaacggacaatcctgcaagtcttggcacagaaatgttggtattttctgccggtgcaagcgcaaatcctctcaacaaccgcaaagaaaaagccgataacattttcactgcagccgttgaaactgaattggaatttgtggaagaaacacaaagcatctttgaaaaaatcaaaggcttgtttgcgaaaaaagaaaaatcagacgatgaacgcttttctgatcaaacacaagccattgagcttttagccgagcaaaccaaagaaaccttggaaaaattaaccgcactttctgacgatttagccaaacaaaaagccgaaatcgaagaaatgaaagcaagtaatgcagaaatccaagcaacgttcgcagaactccaaaagcctgttgaacccgaaaatcctcgccctttagtttacggtgaacaacctgaaactgacggccgcttcttt

SEQ ID NO: 2682 - protein, 271 aa, Haemophilus influenzae
  Name: NTH1489
MAKKSKWVVVATEGATTDGRTIQRNWISEMAANYDPKKYGARVNLEHIKWRYMWNDDPHSKCYGDVIGLKTEENAEGKLQLLAQIDPTDDLIKLNKDRQKIYTSIECDPNFADTGEAYLVGLAVTDNPASLGTEMLVFSAGASANPLNNRKEKADNIFTAAVETELEFVEETQSIFEKIKGLFAKKEKSDDERFSDQTQAIELLAEQTKETLEKLTALSDDLAKQKAEIEEMKASNAEIQATFAELQKPVEPENPRPLVYGEQPETDGRFF

SEQ ID NO: 2683 - DNA, 633 bp, Haemophilus influenzae
  n 628, 629, 630, 631, 632: n is any nucleotide
  Name: NTH1490
atgaataaatttaccaaacaaaaatttaatacttaccttgctggtgttgcacaagataacggcgaagatgttgcttttatcgcaaatggtggtcagtttaccgttgagccaactattcaacaaaaattagaaaatgctgtgcttgaaagttctgatttcttgaaacgcatcaatgtagtgatggtgcaagaaatgaaaggttctgcattgcgtttaggtgtgctttcaccagtggcaagtcgcaccgacaccaacaccaaagcacgtgaaaccactgatattcacagcttgcaagaaaacacctattcttgcgaacaaaccaactttgacacacatttaaattatccaaccttagacagttgggcgaaattccctgattttgccgcacgtgtgggcaaactcaaagcagaacgcattgcattagaccgtatcatgatcggttggaatggcacaagtgcagcaacaaccacaaaccgtacctcaaatccattattgcaagatgtgaataagggttggttagtccaaatcgaagataaagccaaagcccgtgtgttaaaagaaattgaagaaagcagtggcaaaatcgaaatcggcgcaggtaaaacctataaaaatcttgatgcccttnnnnnt

SEQ ID NO: 2684 - protein, 211 aa, Haemophilus influenzae
  Xaa 210, 211: Xaa is any amino acid
  Name: NTH1490
MNKFTKQKFNTYLAGVAQDNGEDVAFIANGGQFTVEPTIQQKLENAVLESSDFLKRINVVMVQEMKGSALRLGVLSPVASRTDTNTKARETTDIHSLQENTYSCEQTNFDTHLNYPTLDSWAKFPDFAARVGKLKAERIALDRIMIGWNGTSAATTTNRTSNPLLQDVNKGWLVQIEDKAKARVLKEIEESSGKIEIGAGKTYKNLDALXX

SEQ ID NO: 2685 - DNA, 279 bp, Haemophilus influenzae
  n 270, 271, 272, 273, 274: n is any nucleotide
  Name: NTH1491
atgtcaagcgataaagaacaaacaatcccctttcttcctactcgattaaatcgtgaatcgagtgtgtatggcgggttatctgtaagtgaatttatgttggctgcagcaatgggatttatcttgggtgcagtgcttggcctcctttgttgttttgccttaggctttgatttttggttgttaattccgtctctcgccatgttgttttgcatctttttggggggatggccaagggttattgcgccccttaaccaggtagcccgaagcctactnnnnnttaat

SEQ ID NO: 2686 - protein, 93 aa, Haemophilus influenzae
  Xaa 91, 92: Xaa is any amino acid
  Name: NTH1491
MSSDKEQTIPFLPTRLNRESSVYGGLSVSEFMLAAAMGFILGAVLGLLCCFALGFDFWLLIPSLAMLFCIFLGGWPRVIAPLNQVARSLLXXN

SEQ ID NO: 2687 - DNA, 399 bp, Haemophilus influenzae
  Name: NTH1492
atgaagttgattaaatccttctttcagaatgtttcaagtcgttttcttgcggtagtaactttactttggttatccgttgaaaatgcgtttgctacaggcggtggtaatggtatcaatgcctctaaaatccctgattttaaaatcccaggcgtagatagcaataccaaagacccgatggaaatcatctatcttgttgctaaatcattggcaaccttgtgtgcaattttatttgcagcatggtcaatcatgacagtggttaaggcattaattaaaacctataacgcagcgactgacgaaaatgacaaaaaaggatggggcccatttattatcgctcttattcttggtttcattttaattttcttcagcctctggttggtgaaattggctatcggtctgttt

SEQ ID NO: 2688 - protein, 133 aa, Haemophilus influenzae
  Name: NTH1492
MKLIKSFFQNVSSRFLAVVTLLWLSVENAFATGGGNGINASKIPDFKIPGVDSNTKDPMEIIYLVAKSLATLCAILFAAWSIMTVVKALIKTYNAATDENDKKGWGPFIIALILGFILIFFSLWLVKLAIGLF

SEQ ID NO: 2689 - DNA, 243 bp, Haemophilus influenzae
  Name: NTH1493
atgagtaacgctaatttcccttctgtttcaccattagacagtttttatactgtaagtggtttagacccgctaaaactgaaaatcatgctggccattattttggttgtcgtattactgcttgcgtatatgtgggcaactaatcatggctacaaaggcatggtgaacgacggtgatatttggtcattctttaaactgattctatggggcgcagcattaattatatgtgttgtcagcttttttatt

SEQ ID NO: 2690 - protein, 81 aa, Haemophilus influenzae
  Name: NTH1493
MSNANFPSVSPLDSFYTVSGLDPLKLKIMLAIILVVVLLLAYMWATNHGYKGMVNDGDIWSFFKLILWGAALIICVVSFFI

SEQ ID NO: 2691 - DNA, 276 bp, Haemophilus influenzae
  Name: NTH1494
ttgtttggcgctataagtgctcaagcaacagagcaagagcatttagcgcaagcaattaaacagttggatgcagcaaaactctcattacagcgagcagctgcaagtgcaaaggtttctgcgaaaagtcgtgaatattttgattacgcttcagcacatcaagatattgctacggtacaggcagggattaagcaatatattaacccttcccgggcaatccctagaaatcctaaagctattcgtaacttaaaagaagattatctcaatcttcggagtcaa

SEQ ID NO: 2692 - protein, 92 aa, Haemophilus influenzae
  Name: NTH1494
LFGAISAQATEQEHLAQAIKQLDAAKLSLQRAAASAKVSAKSREYFDYASAHQDIATVQAGIKQYINPSRAIPRNPKAIRNLKEDYLNLRSQ

SEQ ID NO: 2693 - DNA, 684 bp, Haemophilus influenzae
  Name: NTH1495
atggcagaacaacaagtcaaaaaaaagaaaaagggtcttttttactacattaatgcggtattagccgccttattgggttccctgattttgagcattattcttgaatggttaggtattgcatttttatggcctgaagaaggtcatttacacagtcaaaaaatgatgctaactgagcttggatggctttctgatagtctaacgagaggtcttttctatcattctccaaaagagctggctgaaggtcttattttgtcattacatgaatggctttttgtgaaaacaggtgtaaaagattggttagccaaccctcgtgagcatagtggcgtaggtttgtgggtgtatcattatgggcgagcgtatattgagtcagtgatttatgtttttatcacctttgttattcgacttgtagtgattgtttttacttccccactctttttgttagccgcatttgcgggctttactgaagggttaatgatgcgtgaccgtcgtaaatttggtgcgggcagagagtctagttttctttatcatcatgcacgtcgattaattggcccgattatgttgtcggcatgggtattgtatctttctatcccaatttctatttacccgaatataattttggtgccagctgcatttctatttggactatccatctgtgtaacggcagcgagctttaaaaaatacctt

SEQ ID NO: 2694 - protein, 228 aa, Haemophilus influenzae
  Name: NTH1495
MAEQQVKKKKKGLFYYINAVLAALLGSLILSIILEWLGIAFLWPEEGHLHSQKMMLTELGWLSDSLTRGLFYHSPKELAEGLILSLHEWLFVKTGVKDWLANPREHSGVGLWVYHYGRAYIESVIYVFITFVIRLVVIVFTSPLFLLAAFAGFTEGLMMRDRRKFGAGRESSFLYHHARRLIGPIMLSAWVLYLSIPISIYPNIILVPAAFLFGLSICVTAASFKKYL

SEQ ID NO: 2695 - DNA, 411 bp, Haemophilus influenzae
  Name: NTH1496
atgttgaagctccagttgctgaagatatggaagatgaagatattgatcagaatgatgatacagatgaggatgattttgatgacacagataattaatcagccggatatgaacttgcttgatattccggatatgagcgtagatttcaattcagtcactagctgttcttgtgggctggaaaacgctgatgaattacttaattactttttaccttatttggaagattggaataatcagcgttataccacacatgaatttgcgaaaaagtatgcaaataaaggcatctcactttggacggctaatgatgtaaaaaaatctgaaaatggcatccaggcaattcaaatttttttagacggtgaagtaaaaggttatcttttctttcactgtaaattatctccagcgggaacattacag

SEQ ID NO: 2696 - protein, 137 aa, Haemophilus influenzae
  Name: NTH1496
MLKLQLLKIWKMKILIRMMIQMRMILMTQIINQPDMNLLDIPDMSVDFNSVTSCSCGLENADELLNYFLPYLEDWNNQRYTTHEFAKKYANKGISLWTANDVKKSENGIQAIQIFLDGEVKGYLFFHCKLSPAGTLQ

SEQ ID NO: 2697 - DNA, 1470 bp, Haemophilus influenzae
  n 1464, 1465: n is any nucleotide
  Name: NTH1497
atgttaaaacgaatgtatgcagaagcaaaacgtgcggggcgtgaaaatgaattttatgtattccatttagggcatccggaaatttctgctcgatataacccagttggtcgcttcggtcgaatttctgaagtggcaggacgtatttctgggcaattaagtggtgcgggaaatagtgcagcatttaaagagtttgcgtggcgttttgtgaatattgtctcccgtgcattggttgaaatgggaaaacgcccggactatgtgcaaatctcgcgttttgtgcaaaatattgatgcacttttcttagattacgccaaacttcattttgatgccgtagataagaaaatatggccaacgttggcttcggttgcggctaacttagatgtaaaaaatttaccgttctcgatgaaagatagaccgctgattgctgttattaaccaatatattttagagaataagatttttgacccggtacttgaagggttatcaagtgcggtacgttacgataaaacctattttgataaaattgtggcatcgcttttaccgttacttgaaaaactcactacaggtaaaactgcagagcttctctcgcctgattacactgatattcatgatgagcgccctatctttgattgggaatctattattcgtaaaagagggattgtttacgttggattagatgcattatccgatgcgaccgtagctgcagctgtgggtaatagtatgtttgctgatttggtatcaatggctggtcatatttataaatttggcgtagatgaggggttgccagatgcatttaaaactaaaagcaaaccgcctaaaatcaaccttcattgcgatgagttcaatgaattgatgggggatgaatttatcccgctgatcaataaaggtcgtggtgcgggaatgcaggtaacagcctatactcaaacactttcagatattgaagctcgtattggaagtaaggcaaaaacgggacaaacaacaggtaacttcaatacacttttaatgttccgggtaaaagagccggccactgcagagtttttaacgcgtcagctcaacgatgtcacaatttatcaaagcatggtgacatcaagtacgacagataacagcaatccggatgatggcaaggcgtttacttctaatactggtgaacgtatttctgaaaaaatggtgccaatgctatcgccagcacatattacaaatttaccaaaaggacaggcatttgctcttcttgaagggagtacgctttataaattaagaatgcctttacctgcggttgataaagatgatgtgatgccggaatcacttcaagaattgacggcttatatgcgcaaaaactaccatatttctccaaattggtggcaatctgcattttctgattatgcgccaagtcaagatatagcaaccgcttttcagtcaatgtcattaaatcgagcgccttcacacgcaggagaagaaatgcttttcggnngatgt

SEQ ID NO: 2698 - protein, 490 aa, Haemophilus influenzae
  Xaa 489: Xaa is any amino acid
  Name: NTH1497
MLKRMYAEAKRAGRENEFYVFHLGHPEISARYNPVGRFGRISEVAGRISGQLSGAGNSAAFKEFAWRFVNIVSRALVEMGKRPDYVQISRFVQNIDALFLDYAKLHFDAVDKKIWPTLASVAANLDVKNLPFSMKDRPLIAVINQYILENKIFDPVLEGLSSAVRYDKTYFDKIVASLLPLLEKLTTGKTAELLSPDYTDIHDERPIFDWESIIRKRGIVYVGLDALSDATVAAAVGNSMFADLVSMAGHIYKFGVDEGLPDAFKTKSKPPKINLHCDEFNELMGDEFIPLINKGRGAGMQVTAYTQTLSDIEARIGSKAKTGQTTGNFNTLLMFRVKEPATAEFLTRQLNDVTIYQSMVTSSTTDNSNPDDGKAFTSNTGERISEKMVPMLSPAHITNLPKGQAFALLEGSTLYKLRMPLPAVDKDDVMPESLQELTAYMRKNYHISPNWWQSAFSDYAPSQDIATAFQSMSLNRAPSHAGEEMLFGXC

SEQ ID NO: 2699 - DNA, 903 bp, Haemophilus influenzae
  Name: NTH1498
atgaacggtacaatatgtccaatcaatcaatcaatcaatcaatcaatcaatcaatcaatcaatcaatcaatcaatcaatcaatcaatcaatcaaagtctgtcattattgcaggtaatggaacaagtttaaaatcaattgactatagtttattacctaaagattatgatgttttccgttgcaatcaattttattttgaggatcattattttcttggtaagaaaataaaaaaggtattttttaattgttctgtaatttttgaacaatactatacgtttatgcaattaattaaaaataatgaatatgaatatgctgatattattttatcatcttttctaaatttaggggattcagaattaaagaaaatccagcgtttagaaaaattactaccacaaatcgatcttggtcatagctatttaaaaaaactacgagcttttgatgctcatttacaatatcacgaactatatgagaataagaggattacatcaggcgtctatatgtgtgcagtggcaactgcaatgggttataaagatctttatttgacaggcattgatttttatcaagaaaaagggaatccttacgcatttcatcatcaaacagaaaatattattaaattattaccttctttttcacaaaataaaagtcaaagcgatatccattctatggaatatgatttaaatgcactttattttttacaaaaacattatggagtaaatatttattgcatttcgccagaaagtcctctatgtaattatttccctttatcaccactgaataacccaattacttttattctcgaagaaaagaaaaattacacacaagatattttaattccgccgaagtttgtatataaaaaaattggtatatattccaaaccaagaatttaccaaaatctgtttttcggt

SEQ ID NO: 2700 - protein, 301 aa, Haemophilus influenzae
  Name: NTH1498
MNGTICPINQSINQSINQSINQSINQSINQSKSVIIAGNGTSLKSIDYSLLPKDYDVFRCNQFYFEDHYFLGKKIKKVFFNCSVIFEQYYTFMQLIKNNEYEYADIILSSFLNLGDSELKKIQRLEKLLPQIDLGHSYLKKLRAFDAHLQYHELYENKRITSGVYMCAVATAMGYKDLYLTGIDFYQEKGNPYAFHHQTENIIKLLPSFSQNKSQSDIHSMEYDLNALYFLQKHYGVNIYCISPESPLCNYFPLSPLNNPITFILEEKKNYTQDILIPPKFVYKKIGIYSKPRIYQNLFFG

SEQ ID NO: 2701 - DNA, 819 bp, Haemophilus influenzae
  Name: NTH1499
atgtcaaatgccattgcttccgtgtttaaattgatcgaagagaatgatattaggtttgtattgcttcgttttactgacattaaaggtaaagaacatggtgtttctatcccagttagccttgttgatgaagatatgtttgaagacggcaagatgtttgatggttcctctgttgaaggttggaaaaccattaataaagccgatatgttgcttatgccaatagctgaaaccgcagttgtcgatccattcgcgcaaattccgacactttctattcgttgtagtgtttatgaaccaacgacaatgcaaagctatgatcgcgatccgcgctctattgcaattcgtgcagaaaattatatgcgttcaacaggtattgcggatcaagctttttttggccctgaacctgaattcttcttatttgatgatgtgcgttttaatgtatcaatgaacaaagcgtctttttctattgatgatatagaagctgcttggaacacgaataaaaaatatgaagaaggcaataatgcttatcgcccattaaaaaaaggcggatattgtgccgttgcaccgattgatagtgcgcacgatattcgttctgaaatgtgcttgattttagaagaaatgggattagtcatcgaagcccatcatcatgaagtggctactgcagggcaaaacgaaattgcgactaaattcaatacgctcactttaaaagcggatgaaactcaaatctataaatatgtggtgcaaaatgtggcattggagcatggtaaaacggcgtgttttatgccaaaaccaattactggagataatggtttcgggtatgcactg

SEQ ID NO: 2702 - protein, 273 aa, Haemophilus influenzae
  Name: NTH1499
MSNAIASVFKLIEENDIRFVLLRFTDIKGKEHGVSIPVSLVDEDMFEDGKMFDGSSVEGWKTINKADMLLMPIAETAVVDPFAQIPTLSIRCSVYEPTTMQSYDRDPRSIAIRAENYMRSTGIADQAFFGPEPEFFLFDDVRFNVSMNKASFSIDDIEAAWNTNKKYEEGNNAYRPLKKGGYCAVAPIDSAHDIRSEMCLILEEMGLVIEAHHHEVATAGQNEIATKFNTLTLKADETQIYKYVVQNVALEHGKTACFMPKPITGDNGFGYAL

SEQ ID NO: 2703 - DNA, 288 bp, Haemophilus influenzae
  n 227, 230, 235: n is any nucleotide
  Name: NTH1500
atgcgttcactaatccaaagtactatttcatataaacgtttagtgcctggttatgaagcaccagtattgttggcttactctgcaagcaatcgttcagcctcaattcgtattcctgctgtaaccaatccgaaagcgattcgcgtagaagcgcgtttcccagatccattggcaaacccatatttagcatttgctgcattattaatggcaggtcttgatggcgtggtaancanaaatnccacccaggcgatgcgatggataaaaatctttacgatcttcctccagaagaat

SEQ ID NO: 2704 - protein, 96 aa, Haemophilus influenzae
  Xaa 76, 77, 79: Xaa is any amino acid
  Name: NTH1500
MRSLIQSTISYKRLVPGYEAPVLLAYSASNRSASIRIPAVTNPKAIRVEARFPDPLANPYLAFAALLMAGLDGVVXXNXTQAMRWIKIFTIFLQKN

SEQ ID NO: 2705 - DNA, 150 bp, Haemophilus influenzae
  Name: NTH1501
ttgaattcattagaaaaagactatgaatttttaacccaaggtggcgtatttgctaaagattttattgatgcgtttatcagtatcaaacgtaaagaagtggaacgtttaaatatggcaccacatccagttgaatttgaaatgtattatgcg

SEQ ID NO: 2706 - protein, 50 aa, Haemophilus influenzae
  Name: NTH1501
LNSLEKDYEFLTQGGVFAKDFIDAFISIKRKEVERLNMAPHPVEFEMYYA

SEQ ID NO: 2707 - DNA, 1041 bp, Haemophilus influenzae
  Name: NTH1503
atgtcgaatacaaatagaacaattctagtgactggtggagcggggtttattggttctgcgcttgtccattatcttcttgaaaagacacataataaaatcgtaaatgttgataagctgacttatgcaggaaatttagcctcacttaaaaccgtagaaaaccatccacgttatgcttttgtacaagcagatatttgtgatactaaagcgttgtcttatattttttcacaatatcaacctgatgctgttatccatcttgccgctgaaagccatgttgatcgttctataaatgcttcttcggagtttatacaaaccaatattgtaggcacttactgcctacttgaatcaactctagattactggcatcgtttagataatcaaaaaaaatccagcttccgattcttacatatttccaccgatgaagtttatggggatttaaaaagtaatgagggtttatttactgaaacatcagcttataaacctagcagcccttattctgcttcaaaggcggcaagcgatcatctcgtgcaggcttggtatagaacatatgggttaccgacaattattacacatagttcaaataattatggcccgtatcagtaccctgaaaaattaattccattgatgattttaaatgcgatagagggaaaaacactgcctatttatggcgatggtttgcaaattagagattggttatttgttgaagatcatattgatgcactatataacgttttgatgaaaggaaatattggggaaacctataatattggcggaaataatgaaaagtccaatattgatgtagtgcgttctatttgttctttgctggaagaatttttacctaataaaccaaaacatattgataaatatgaagatttaatttgctatgtgcaagatagaccaggtcacgatcttcgttatgcgcttgatacaagtaaaatcaatcataaactaggctggatacctaaagaaacttttgaatcgggattaagaaaaacggtaatttggtatttaaatcatcaagaatggtgtcaaaaagtgagtgaa

SEQ ID NO: 2708 - protein, 347 aa, Haemophilus influenzae
  Name: NTH1503
MSNTNRTILVTGGAGFIGSALVHYLLEKTHNKIVNVDKLTYAGNLASLKTVENHPRYAFVQADICDTKALSYIFSQYQPDAVIHLAAESHVDRSINASSEFIQTNIVGTYCLLESTLDYWHRLDNQKKSSFRFLHISTDEVYGDLKSNEGLFTETSAYKPSSPYSASKAASDHLVQAWYRTYGLPTIITHSSNNYGPYQYPEKLIPLMILNAIEGKTLPIYGDGLQIRDWLFVEDHIDALYNVLMKGNIGETYNIGGNNEKSNIDVVRSICSLLEEFLPNKPKHIDKYEDLICYVQDRPGHDLRYALDTSKINHKLGWIPKETFESGLRKTVIWYLNHQEWCQKVSE

SEQ ID NO: 2709 - DNA, 411 bp, Haemophilus influenzae
  Name: NTH1504
ttgtttatacatgggggaataaatatgcaaattacactttcaaataacttagcgaatgatgcttggggaaaaaatgctattttgagctttgactctaataaagcaacaattcatttaaaaaataatgaaaaaactgaccgcactttagttcaacaagctgctcgtaaattgcgtgggcagggaattaaaaatgtggaattgctcggtgaagaatgggatttagaattttgctgggcgttttatcaaggtttttataccgcaaaacaagattacgggattgagtttcctcatttggatcatgatctacaagatgaattattagcgcgtatcgaatgtggcgattttgtgcgtgggattattaatgagccagcacaaagcctaacaccagtaaaattagcagaacgtgcgggc

SEQ ID NO: 2710 - protein, 137 aa, Haemophilus influenzae
  Name: NTH1504
LFIHGGINMQITLSNNLANDAWGKNAILSFDSNKATIHLKNNEKTDRTLVQQAARKLRGQGIKNVELLGEEWDLEFCWAFYQGFYTAKQDYGIEFPHLDHDLQDELLARIECGDFVRGIINEPAQSLTPVKLAERAG

SEQ ID NO: 2711 - DNA, 1581 bp, Haemophilus influenzae
  n 1576, 1577, 1578, 1579, 1580: n is any nucleotide
  Name: NTH1505
atgacaaccaattattcagctcaagaaattaccgttcttaaagatctcgaaccagtgcaaattcgcccgggaatgtacactgacactactcgccctaatcatttagcacaagaagttattgataacagcgtagatgaagcccttgccggttttgcctcaaaaattgaagtaattttacaccctgatcaatccattgaagtaacggacaatggtcgcggtatgcctgtggatactcatcctacggaaggcgtttctggcgtagaagtaatcctgactaaactgcatgctggtggtaaattctccaataaaaattatgaatttgcgggaggtttacacggtgtggggatttctgtggtaaatgcgctttctgaacgcgtggatattcaagtcaaacgcaatggcgaaatctataaaattgcctttgaaaacggcagtaaagtagaagaattggaaattatcgggacttgtggtagacgcacaacgggaacaaccgttcacttcaaaccgaatccaaaatattttgacagcgcaaaattttccgttagccgcctacgccatttattaagagcgaaagcggtactctgctcagggcttgaaatcaaattcattgataaagtaaacaatactcaagacatttggttatatgaagatgggctttccgattaccttatcgaagcagtaaatggctttgaaacccttccggaaaaaccatttgttggcgaatttaaaggaacaaatgaagcggttagctgggcattactttggttgccagaaggtggtgaactgattggcgaaagctacgtaaacttaattccaacaattcaaggcggaacgcatgttaatggtctacgtcaaggtttattagatgccattcgagaattttgcgaatttagaaatctattaccacgcggggtaaaacttaccgccgatgatatttgggatcgttgttcttacattctttcccttaaaatgcaggatgcgcaattcgcagggcaaacaaaggaacgcttatcatcacgccaaagtgcggtgtttgtcagcggtgttttaaaagatgcgttcagcctatggctaaatcaaaatgtacaagatgctgaaaaattagcagaaattgccattagttctgcacaacgccgattacgcgccgccaaaaaagtcgtgcgaaaaaaactcgttagtggcccagcattaccaggaaaattagctgattgtggctcacaggatttagaaaaaacggaattatttttagtggagggcgactctgctggcggctcagcaaaacaagcacgtgatcgcgaatatcaagcgattttgccgttacgtgggaaaatcttaaacacatgggaagtttcccctgatcaagtattaggttcaaccgaaattcacgatatcgccgtggctctagggatcgatcctgacagcaatgatttatcacaacttcgctatggtaaagtctgtattctcgcggatgctgactccgatggtctgcatattgccaccctactctgcgccctgttcttacgtcattttccgaaattggtacaagacggtcacgtttacgtcgcaatgccaccannnnnt

SEQ ID NO: 2712 - protein, 527 aa, Haemophilus influenzae
  Xaa 526, 527: Xaa is any amino acid
  Name: NTH1505
MTTNYSAQEITVLKDLEPVQIRPGMYTDTTRPNHLAQEVIDNSVDEALAGFASKIEVILHPDQSIEVTDNGRGMPVDTHPTEGVSGVEVILTKLHAGGKFSNKNYEFAGGLHGVGISVVNALSERVDIQVKRNGEIYKIAFENGSKVEELEIIGTCGRRTTGTTVHFKPNPKYFDSAKFSVSRLRHLLRAKAVLCSGLEIKFIDKVNNTQDIWLYEDGLSDYLIEAVNGFETLPEKPFVGEFKGTNEAVSWALLWLPEGGELIGESYVNLIPTIQGGTHVNGLRQGLLDAIREFCEFRNLLPRGVKLTADDIWDRCSYILSLKMQDAQFAGQTKERLSSRQSAVFVSGVLKDAFSLWLNQNVQDAEKLAEIAISSAQRRLRAAKKVVRKKLVSGPALPGKLADCGSQDLEKTELFLVEGDSAGGSAKQARDREYQAILPLRGKILNTWEVSPDQVLGSTEIHDIAVALGIDPDSNDLSQLRYGKVCILADADSDGLHIATLLCALFLRHFPKLVQDGHVYVAMPPXX

SEQ ID NO: 2713 - DNA, 945 bp, Haemophilus influenzae
  Name: NTH1506
gtggaaagaacaatgaaaaacgaaaaactccctcaatttcaaccgcactttttagccccaaaatactggcttttttggttaggcgtggcaatttggcgaagtattttatgtcttccctatcctattttgcgccatattggtcatggtctcggttggctgttttcacatttaaaagtgggtaaacgtcgagcagccattgcacgtcgtaatcttgaactttgttttcctgatatgtctgaaaacgaccgtgaggcgattttgcaagaaaatctccgctctgtaggcatggcaattatcgaaactggcatggcttggttttggtcggattcacgtatcaaaaaatggtcaaaagttgaaggcttacattatctaaaagaaaatcaaaaagatggaattgttctcgttggtgttcatttcttaacgctagaacttggcgcgcgcattcttggtttgcatcatcccggcattggcgtttatcgtccaaatgataatcctttgcttgattggctacaaacgcaaggtcgtttacgctctaataaagatatgcttgatcgtaaagatttacgcggaatgatcaaagctttacgccacgaagaaaccatttggtatgcgcctgatcacgattacggcagaaaaaatgccgtttttgttcccttttttgcggtacccgatgcttgcacaaccactggtagttattatttattgaaatcttcacaaaacagcaaagtgattccatttgcgccattacgcaataaagatggttcaggctataccgtgagtatttcagcgcctgttgattttacggatttacaagatgaaacggcgattgctgcgcgaatgaatcaaatcgtagaaaaggaaatcatgaaggggatatcacaatatatgtggctacatcgccgttttaaaacgcgccccgatgaaaagacgcctagtttatacgat

SEQ ID NO: 2714 - protein, 315 aa, Haemophilus influenzae
  Name: NTH1506
VERTMKNEKLPQFQPHFLAPKYWLFWLGVAIWRSILCLPYPILRHIGHGLGWLFSHLKVGKRRAAIARRNLELCFPDMSENDREAILQENLRSVGMAIIETGMAWFWSDSRIKKWSKVEGLHYLKENQKDGIVLVGVHFLTLELGARILGLHHPGIGVYRPNDNPLLDWLQTQGRLRSNKDMLDRKDLRGMIKALRHEETIWYAPDHDYGRKNAVFVPFFAVPDACTTTGSYYLLKSSQNSKVIPFAPLRNKDGSGYTVSISAPVDFTDLQDETAIAARMNQIVEKEIMKGISQYMWLHRRFKTRPDEKTPSLYD

SEQ ID NO: 2715 - DNA, 924 bp, Haemophilus influenzae
  Name: NTH1507
atggctcaatattcagcagaatttaagcaagcaaaagtacttgtattaggcgacgtgatgcttgatcgttattggttcggcgcaaccaaccgtatttcaccagaagcaccagtgccagtagttcgtgtacaagaaaatgaagaacgcgcgggtggtgcagcaaatgtggcgatgaatattgcttcactcaatgtatccgttcagttaatgggattgattggacaagatgaaactggttctgcactttccctcttattagaaaaacaaaaaattgattgtaattttgttgcattagaaacccatccaactattactaaattacgtattttatctcgtcaccaacagttactccgccttgattttgaagaagatttcaataatgtagattgcaaggatttattagcgaagttagaaagtgcggtgaaaaattacggtgctttgattctttctgattacggcaaaggcacgcttaaagatgttcagaaaatgattcaaattgcacgcaaagcgaatgtgcctgtgttgatcgatccaaagggaactgattttgaacgctatcgtggtgcgacattattgacacccaatatgtctgaatttgaagccgttgtgggtaaatgtaatacagaagaagaaattattaagaagggtttaaaattaatttctgatattgaattaaccgcacttttggtaacgcgttctgaaaaaggcatgacattattacgcccaaatcaagagccttatcatttgccaaccgttgcaaaagaagtgtttgatgtgacgggagccggtgacactgtcattagcgtattagcaaccgcattagcagatggacgttcttttgaggaatcttgttacctagccaatgtagccgctggaattgtggtgggtaaattggggacttcaacggtttcgaccagtggaact

SEQ ID NO: 2716 - protein, 308 aa, Haemophilus influenzae
  Name: NTH1507
MAQYSAEFKQAKVLVLGDVMLDRYWFGATNRISPEAPVPVVRVQENEERAGGAANVAMNIASLNVSVQLMGLIGQDETGSALSLLLEKQKIDCNFVALETHPTITKLRILSRHQQLLRLDFEEDFNNVDCKDLLAKLESAVKNYGALILSDYGKGTLKDVQKMIQIARKANVPVLIDPKGTDFERYRGATLLTPNMSEFEAVVGKCNTEEEIIKKGLKLISDIELTALLVTRSEKGMTLLRPNQEPYHLPTVAKEVFDVTGAGDTVISVLATALADGRSFEESCYLANVAAGIVVGKLGTSTVSTSGT

SEQ ID NO: 2717 - DNA, 249 bp, Haemophilus influenzae
  Name: NTH1508
atgacccgcgaaaaagtggacggacgaggcgacagtatgttattgtacgatcctcgcgaagctgaaaaagcatatcgtacaggcgaagcagaattacattctcgtgtgaaagtacgtattactgaatatgtgaaaaatgaagcgggcgaatttgatgcgaaaaccacgctgactgatacaactatcggtcgtgcaatcttatggatgatcgcgccgaaggcatgccttattcattgttcaaccaaacat

SEQ ID NO: 2718 - protein, 83 aa, Haemophilus influenzae
  Name: NTH1508
MTREKVDGRGDSMLLYDPREAEKAYRTGEAELHSRVKVRITEYVKNEAGEFDAKTTLTDTTIGRAILWMIAPKACLIHCSTKH

SEQ ID NO: 2719 - DNA, 2487 bp, Haemophilus influenzae
  Name: NTH1509
atgccttattcattgttcaaccaaacattaggtaaaaaagccatttctaaactgattaacgaagcatatcgtcgtttaggtttaaaagaagcggtaatgtttgctgaccaaattatgtataccggttttgcgtatgcggcacgttctgggtcatcagttggtattgatgatatggaaattccagcgaagaaatacgaaattatttctgcagcggaagaagaagtagctgagatccaagaacaattccaatcaggtcttgtgacggcaggcgaacgctataataaagtaatcgatatttgggctgccgcgaatgagcgcgtagcgaaagcgatgatggaaaacttatctcaagaagaagtcatcaatcgtgaaggtaatcctgaaaaacaagcgtcctttaacagtatctttatgatggctgattctggtgcgcgtggttctgcagcgcagattcgtcagttagcaggtatgcgtggtttgatggctcgtccagatggctcgatcattgaaaccccaattacagcaaacttccgtgaaggtttgaacgtattacagtactttatttcaacccacggtgctcgtaaaggtttggcggataccgcattaaaaacagcgaactcaggttacttaactcgtcgtttagttgatgtggcacaagacttagtgattgtagaagatgactgtggtacgcacgaaggcttagtcatgaccccattaattgaaggtggagatgaaaaagtgccacttcgtgaattagtattaggtcgtgttgctgcagaagatattttaaaaccgggtgcagaagaagtattaattccgcgtaacaccttattagatgaaaaactctgtgatgtgttggatgcaaactctgtagatagcgtaaaagtacgttctgttgtaacttgtgatactgactttggcgtgtgtgcgaaatgttatggtcgtgatcttgcgcgtggtcatttaatcaaccaaggcgaagcggtgggggttattgccgctcaatctatcggtgagccgggtacacagctaacaatgcgtacgttccatattggtggtgcggcatctgcggcagcgaaagaatctagtgtgcaagttaaaaacactggtacagtgcatttaatgaatgcaaaattcgtgactaacgatgaaagcaaactagtattaacttctcgtaacacggaattaactattactgatgcatttggtcgtactaaagaacattataaagtgccttatggtgcggtattaagcaaaggtgacggtcaagaagtcactgcaggcgaaactatcgcaaattgggatccacatacaatgccagttgtctctgaagtatctggttttgtgaaatttgtagacattattgatggtttaactgtgacgcgtcaaacagatgaattaacaggtttatcatcaatcgtggttcaagatgtgggtgaacgtgcaactgcgggtaaagatttacgtccaactattaaattagttgatgcaaatggcaacgatattttcttacctgaaactgatgttcttgcacaatacttcttacctggtaaagcaattgtaagtttagacgatggcgcagcagtgaaagtaggggaaccattagcacgtattccacaagaatctgtgggtactaaagatattactggtggtctaccgcgcgttgcagatttatttgaagcacgtaaaccaaaagaaccagctatcttggctgaaatttctggtatcgtgtctttcggtaaagaaaccaaaggtaaacgccgtttattaattactcctgcggaaggcgaaacttacgaagaaatgattccaaaatggcgtcagctcaacgtatttgaaggcgaaatggtacaacgtggcgatgtaatttctgatggtgctgaaacaccacacgacattttacgtttacgtggcgtgcgtgcagtaactgaatacatcgtgaacgaagtgcaagatgtttaccgcttacaaggggtaaaaatcaacgataaacatatcgaagttatcgttcgtcaaatgttacgtaaagcggtaattactaaagcttacgactcagaattccttgagggagaacaagtcgaagtggctcgcgtgaaaattgttaatcgccaacgtgaagcagaaggtaaaccaccagttgaatttgaacgtgaattattgggtatcaccaaagcgtctcttgcgactgaatccttcatctctgccgcatcgttccaagaaactactcgtgttcttaccgaagcagcagtggcaggtaaacgtgatgaattacgtggcttgaaagagaacgtaatagtaggtcgattaattcctgcgggtacaggttttgcgtatcatcaaaatcgtcacaaacatcgtttagttgatgatgtcgtagcgaaattatctgaagaagatgaagctgctatcgctgatgaatttgttatgactgcagatgatgcaagtgcgaacttagctgaaatgcttaacatggcagatgatgcggaa

SEQ ID NO: 2720 - protein, 829 aa, Haemophilus influenzae
  Name: NTH1509
MPYSLFNQTLGKKAISKLINEAYRRLGLKEAVMFADQIMYTGFAYAARSGSSVGIDDMEIPAKKYEIISAAEEEVAEIQEQFQSGLVTAGERYNKVIDIWAAANERVAKAMMENLSQEEVINREGNPEKQASFNSIFMMADSGARGSAAQIRQLAGMRGLMARPDGSIIETPITANFREGLNVLQYFISTHGARKGLADTALKTANSGYLTRRLVDVAQDLVIVEDDCGTHEGLVMTPLIEGGDEKVPLRELVLGRVAAEDILKPGAEEVLIPRNTLLDEKLCDVLDANSVDSVKVRSVVTCDTDFGVCAKCYGRDLARGHLINQGEAVGVIAAQSIGEPGTQLTMRTFHIGGAASAAAKESSVQVKNTGTVHLMNAKFVTNDESKLVLTSRNTELTITDAFGRTKEHYKVPYGAVLSKGDGQEVTAGETIANWDPHTMPVVSEVSGFVKFVDIIDGLTVTRQTDELTGLSSIVVQDVGERATAGKDLRPTIKLVDANGNDIFLPETDVLAQYFLPGKAIVSLDDGAAVKVGEPLARIPQESVGTKDITGGLPRVADLFEARKPKEPAILAEISGIVSFGKETKGKRRLLITPAEGETYEEMIPKWRQLNVFEGEMVQRGDVISDGAETPHDILRLRGVRAVTEYIVNEVQDVYRLQGVKINDKHIEVIVRQMLRKAVITKAYDSEFLEGEQVEVARVKIVNRQREAEGKPPVEFERELLGITKASLATESFISAASFQETTRVLTEAAVAGKRDELRGLKENVIVGRLIPAGTGFAYHQNRHKHRLVDDVVAKLSEEDEAAIADEFVMTADDASANLAEMLNMADDAE

SEQ ID NO: 2721 - DNA, 996 bp, Haemophilus influenzae
  Name: NTH1510
ttgttgatagttatgttacactttgctcatatttttcaaaataaggatcatactatgaatataacaaagccttttcctcttccaacaggatatttcggtattcctcttggtttagcagccttatctttagcttggtttcatttagaaaacttatttcctgctgcgcgaatggtaagtgatgttcttggcattgtagcaagtgtggtctggattttatttattttaatgtatgcgtataaacttcgttattactttgaggaagttcgtgcagagtatcatagcccagttcgtttttcctttattgcattgattcctattacaactatgttggtaggcgatattctttatcgttggaatcctttaattgctgaagttttaatttggattggaacgattggtcaattacttttctcaacattacgtgtcagtgaattatggcaaggtggtgtatttgagcaaaaatctactcatcctccgttttatttgcctgcggtagctgctaattttaccagcgcaagttcattagcattacttggctaccatgatttagcctacttattctttggcgcaggaatgattgcttggattatttttgaacctgtattattacaacatttacgtatttcatctcttgagccacaatttagagccacaatagggattgttttagcacctgcgtttgtgtgtgtatctgcttatttatcgatcaatcactgcgaggtggatacgttagctaaaatcctttggggatatggatttttgcaattatttttcttattgcgattattcccttggattgtggaaaaaggacttaacattggcttatggacattctcattcggattagcgtctatggcaaacagtgctaccgctttctatcatggcaatgttttacaaggcgtgtctatttttgcctttgttttctcaaatgtaatgattggcttattggttttaatgacaatatataaattaactaaagggcagtttttcctaaaa

SEQ ID NO: 2722 - protein, 332 aa, Haemophilus influenzae
  Name: NTH1510
LLIVMLHFAHIFQNKDHTMNITKPFPLPTGYFGIPLGLAALSLAWFHLENLFPAARMVSDVLGIVASVVWILFILMYAYKLRYYFEEVRAEYHSPVRFSFIALIPITTMLVGDILYRWNPLIAEVLIWIGTIGQLLFSTLRVSELWQGGVFEQKSTHPPFYLPAVAANFTSASSLALLGYHDLAYLFFGAGMIAWIIFEPVLLQHLRISSLEPQFRATIGIVLAPAFVCVSAYLSINHCEVDTLAKILWGYGFLQLFFLLRLFPWIVEKGLNIGLWTFSFGLASMANSATAFYHGNVLQGVSIFAFVFSNVMIGLLVLMTIYKLTKGQFFLK

SEQ ID NO: 2723 - DNA, 243 bp, Haemophilus influenzae
  Name: NTH1511
gtggcagtaactggtcgtaaagaaacagataaactttactactggcacactggctatgtaggtggtattaaacaagcgactttcaaagaaatgatcgctcgccgtcctgaagcagtgattgaaattgcggttaaaggtatgttgccaaaaggtccattaggccgtgcaatgttccgtaaattaaaagtgtatgcaggtgctgaacaccaacacgctgcacaacaaccacaagtattagatatt

SEQ ID NO: 2724 - protein, 81 aa, Haemophilus influenzae
  Name: NTH1511
VAVTGRKETDKLYYWHTGYVGGIKQATFKEMIARRPEAVIEIAVKGMLPKGPLGRAMFRKLKVYAGAEHQHAAQQPQVLDI

SEQ ID NO: 2725 - DNA, 459 bp, Haemophilus influenzae
  n 341: n is any nucleotide
  Name: NTH1512
atggcagagaatcaaaactacggcacaggccgccgcaaaagctcttcagctcgtgtatttatcaaaccgggcagtggtaaaatcactatcaatcaacgtgaattagatgtttactttggtcgcgaaacagcacgtatggtagtacgtcagccattagagttggttgaattaactgataaattagacctatacatcactgttaaaggtggtggtatttctggtcaagcgggtgcaatccgtcacggtatcactcgtgcattgatggaatacgatgaaacattacgcccagcacttcgtgcagctggtttcgttactcgggacgcacgtcgcgttgaacgtanaaaagtggggttacacaaagcacgtcgtcgtccacatactcaaaacgttaattttattttcgtttccaaagaaagcagagagaatctctgctttttattatttgagtactctacttat

SEQ ID NO: 2726 - protein, 153 aa, Haemophilus influenzae
  Xaa 114: Xaa is any amino acid
  Name: NTH1512
MAENQNYGTGRRKSSSARVFIKPGSGKITINQRELDVYFGRETARMVVRQPLELVELTDKLDLYITVKGGGISGQAGAIRHGITRALMEYDETLRPALRAAGFVTRDARRVERXKVGLHKARRRPHTQNVNFIFVSKESRENLCFLLFEYSTY

SEQ ID NO: 2727 - DNA, 303 bp, Haemophilus influenzae
  Name: NTH1513
atgatcccaggcgaataccaattagccgaaggcgatattctcgctaatgtcggcagaaaaaccgtaaaaatcgaagtaacaaattcaggcgaccgcccaattcaagttggctcgcattaccatttttttgaaaccaataatgcccttaaatttgaccgcactttggcgcgtggaatgcgcttaaatgtgccatcaggcaatgcggtgcgttttgaaccaggtgaagtgaaatcagtagaattagttgcttttggtggtaaccaaatcatttatggtttccataatcaaattgatggcaaatta

SEQ ID NO: 2728 - protein, 101 aa, Haemophilus influenzae
  Name: NTH1513
MIPGEYQLAEGDILANVGRKTVKIEVTNSGDRPIQVGSHYHFFETNNALKFDRTLARGMRLNVPSGNAVRFEPGEVKSVELVAFGGNQIIYGFHNQIDGKL

SEQ ID NO: 2729 - DNA, 1716 bp, Haemophilus influenzae
  Name: NTH1514
atggcattaacaatttcaagagcacaatatgtagcaacttatggcccaaccgttggcgataaagtccgtttaggcgataccaatttatgggcaaccattgaacaagatttattgaccaaaggtgatgagtgtaaatttggtggcggtaaaagcgtgcgtgatggtatggctcaaagcggtacggcaactcgcgacaatccgaatgtattggattttgtgattaccaacgtgatgatcattgatgctaaattaggcattatcaaagcagatattggtattcgtgatgggcgtattgtgggcattggacaagcaggtaaccctgacaccatggataacgtcacgccaaacatgattatcggtgctagcacagaagttcataacggtgcacatttaattgcaaccgctggcggtattgatacccacattcactttatttgtccgcaacaagcacaacatgcgattgaaagtggcgttaccacgttaattggcggtgggactggccctgctgatggtacgcacgcaaccacttgtacccctggcgcatggtatatggaacgtatgtttcaagcggcagaagccttgcctgtaaacgtcggattttttggtaaaggcaactgttcaaccctagatcctctgcgtgagcaaattgaagcgggtgcattaggtttaaaaatccacgaagactggggtgcaacgcctgccgtgattgattctgccttaaaagtagcagatgaaatggatattcaagtggccattcacacagacacgctaaatgaaagtggctttttggaagacacgatgaaagcgattgatggacgtgtcattcatactttccatacggagggcgcaggtggtggtcatgcacctgacatcattaaagcagcgatgtattcaaacgtattacctgcttcaaccaacccgactcgtccgtttaccaaaaacaccattgatgaacatttggatatgttgatggtttgccatcacttagataaacgcgtgccggaagacgtagcttttgccgatagccgtatccgccctgaaaccattgcagcagaagatattttgcatgatatgggcgtcttctccattatgagttcagactctcaagcaatgggacgtattggagaagtcgttattcgtacatggcaaactgcagataagatgaaaatgcaacgtggtgagctaggtaatgaaggaaacgataacttccgtattaaacgctacattgcgaaatatactatcaacccagcaattgcacatggtattgcggagcatattggctcgttagaagtgggtaaaatcgcagatatcgtgttatggaaaccgatgttctttggggtaaaacctgaagtcgtcattaaaaaaggttttattagctacgccaaaatgggcgacccaaatgcctcaattccaacgccacaacctgtattctaccgtccaatgtacggtgcacaaggcttagcaacggcacaaacagcggtattttttgtttcacaagccgctgaaaaagccgatattcgtgaaaaattcggtttacacaaagaaaccattgctgtgaaaggctgccgcaacgtaggtaaaaaagatctggttcataatgatgtaacaccaaacattactgttgatgctgaacgttatgaagttcgagtggatggagagttaattacctgtgaaccagtggatagcgtaccattgggtcagcgatatttcctattc

SEQ ID NO: 2730 - protein, 572 aa, Haemophilus influenzae
  Name: NTH1514
MALTISRAQYVATYGPTVGDKVRLGDTNLWATIEQDLLTKGDECKFGGGKSVRDGMAQSGTATRDNPNVLDFVITNVMIIDAKLGIIKADIGIRDGRIVGIGQAGNPDTMDNVTPNMIIGASTEVHNGAHLIATAGGIDTHIHFICPQQAQHAIESGVTTLIGGGTGPADGTHATTCTPGAWYMERMFQAAEALPVNVGFFGKGNCSTLDPLREQIEAGALGLKIHEDWGATPAVIDSALKVADEMDIQVAIHTDTLNESGFLEDTMKAIDGRVIHTFHTEGAGGGHAPDIIKAAMYSNVLPASTNPTRPFTKNTIDEHLDMLMVCHHLDKRVPEDVAFADSRIRPETIAAEDILHDMGVFSIMSSDSQAMGRIGEVVIRTWQTADKMKMQRGELGNEGNDNFRIKRYIAKYTINPAIAHGIAEHIGSLEVGKIADIVLWKPMFFGVKPEVVIKKGFISYAKMGDPNASIPTPQPVFYRPMYGAQGLATAQTAVFFVSQAAEKADIREKFGLHKETIAVKGCRNVGKKDLVHNDVTPNITVDAERYEVRVDGELITCEPVDSVPLGQRYFLF

SEQ ID NO: 2731 - DNA, 555 bp, Haemophilus influenzae
  Name: NTH1515
atgaaaataattaacccaattctccctattatagaaaatatcttgggaaatttaaccgcacttcaagcagagggcaaaattaccacacagcccattgaacgcgtggcattgcagtggtatgaaagcgaacgcaatattttgcgtaaaactacaaatacggggcgtgaagtagcatttcgcttgctaaaagaggggcaacgcttgaaacacgatgatgtagtgtttatcagcgatgaattagtgattgcgattgaaattttaccgagtgacgtgattgtgctgtcgccgaaaaccttgcctgaaatggctcgagcttgttatgaaatcggcaacaaacattcgccgctttttttagatggcgatgaagtaacattaccttacgataagccgatgtttgaatggctgcaagctgcgggatttcatccgcaaaaagcagaacgccgtttaagccaagcgttaagagcaaattctgcacaagggcatggacattctcatagccattcgcatgatcatcatggctatcatcatcacggagatggacattggcacaaacat

SEQ ID NO: 2732 - protein, 185 aa, Haemophilus influenzae
  Name: NTH1515
MKIINPILPIIENILGNLTALQAEGKITTQPIERVALQWYESERNILRKTTNTGREVAFRLLKEGQRLKHDDVVFISDELVIAIEILPSDVIVLSPKTLPEMARACYEIGNKHSPLFLDGDEVTLPYDKPMFEWLQAAGFHPQKAERRLSQALRANSAQGHGHSHSHSHDHHGYHHHGDGHWHKH

SEQ ID NO: 2733 - DNA, 126 bp, Haemophilus influenzae
  Name: NTH1516
ttggcacaaacattaaaccgctctttaacggatttaggtgcgttgttgcacttggtcgatcccaccttgccgattggtggatttaaccattccaatggcttggaaaccttcgtcagcaacgtgtgg

SEQ ID NO: 2734 - protein, 42 aa, Haemophilus influenzae
  Name: NTH1516
LAQTLNRSLTDLGALLHLVDPTLPIGGFNHSNGLETFVSNVW

SEQ ID NO: 2735 - DNA, 549 bp, Haemophilus influenzae
  Name: NTH1519
gtgcaaacccagcttttacaaaactggatttacaacgacggggcgtatctttctcttgccttcgatgcaatgtgtgaggggaattttgaccgcttgtgcgaactggattggcaactttccgccaccaaagtggcacgcgaaagtcgtgaagggagtttcaaactcggcgtacgattgttgaaaatttttattcgctatgaaacacatacgttgctcacagcttaccagcaagcgattgcagaaaaacgcgtgcagggctatttcccgatagtgtttgcaatggttgctcaagccatgggtttaagcaaagccgatacgctctatgcgttctactacaacgcagcagtcggtgcgatcactaacggcgtgaagctaattcctctcagccaaatggatgggcaagatattctgtttgacttgcgtggctcgctcgtacaagcggtggaattaagctttgaccctgacgaagaatggcttggtgcggcaacgctggcgaatgatattcgggctatgcaacacgaagtgctttatacgcgactttatatgtcg

SEQ ID NO: 2736 - protein, 183 aa, Haemophilus influenzae
  Name: NTH1519
VQTQLLQNWIYNDGAYLSLAFDAMCEGNFDRLCELDWQLSATKVARESREGSFKLGVRLLKIFIRYETHTLLTAYQQAIAEKRVQGYFPIVFAMVAQAMGLSKADTLYAFYYNAAVGAITNGVKLIPLSQMDGQDILFDLRGSLVQAVELSFDPDEEWLGAATLANDIRAMQHEVLYTRLYMS

SEQ ID NO: 2737 - DNA, 321 bp, Haemophilus influenzae
  n 318: n is any nucleotide
  Name: NTH1520
atgagcaacacagttgctacgatgataaacaaaaggaacattatgcgtaactacattaaaattggcgtagcaggtcctgttggcgcaggcaaaaccgcgttaattgaaaaactcactcgtgaaatagcgtcaaaatatagcgtagcagtcattactaacgatatttacacccaagaagatgcggaatttttaacgaaaaatagtttgcttccaccagagcgaattatgggcgtggaaacgggcggttgcccgcacacagcaattcgtgaagatgcctcgatgaatttagaagccgtggacgaaatggtgactcgtttnccc

SEQ ID NO: 2738 - protein, 107 aa, Haemophilus influenzae
  Xaa 106: Xaa is any amino acid
  Name: NTH1520
MSNTVATMINKRNIMRNYIKIGVAGPVGAGKTALIEKLTREIASKYSVAVITNDIYTQEDAEFLTKNSLLPPERIMGVETGGCPHTAIREDASMNLEAVDEMVTRXP

SEQ ID NO: 2739 - DNA, 267 bp, Haemophilus influenzae
  Name: NTH1521
gtggggacagaaaaagtcttttttattggtaaaactccagaggatttagttgcagtagaaacttatttacgagataagtttggtgacgtaacgacaattgtttattcagcattagcttgtttggaagtaatgaataagaatgtttcaaaaggggatgcattaaaacatttactcgaatcacgcgagtatcagttaaaagactgtattgctttttgtgatgggaagaatgatgtaaaaatgctttttttggctggaacagttgcatta

SEQ ID NO: 2740 - protein, 89 aa, Haemophilus influenzae
  Name: NTH1521
VGTEKVFFIGKTPEDLVAVETYLRDKFGDVTTIVYSALACLEVMNKNVSKGDALKHLLESREYQLKDCIAFCDGKNDVKMLFLAGTVAL

SEQ ID NO: 2741 - DNA, 465 bp, Haemophilus influenzae
  Name: NTH1522
atgaatttaccttttcgagcaatggtgtctgatttagatggcacgcttttaacacctgaacatttagtgggtgatcttaccattgatacgctgagagcattagagcaaaaaggcgtagatattattttggcaacaggacgcaatcataccgatgtgtcatccattcttggaaaaattggtgcggaacgtgcggttatgattacatcaaacggtgctcgtgtacgggatttacagggtaatttgctttatagcaatagtttgcctgaagaattagttcttgagctttacaaaacgccatttgatacttccaaagtatgcatgaatagctatcaagatgaaggttggtttactaataaagatattcctgcaatgcgtcagttccataaagaatctggattcgattataacgttgtcgatttttctaaacatcatggacgtggggacagaaaaagtcttttttattgg

SEQ ID NO: 2742 - protein, 155 aa, Haemophilus influenzae
  Name: NTH1522
MNLPFRAMVSDLDGTLLTPEHLVGDLTIDTLRALEQKGVDIILATGRNHTDVSSILGKIGAERAVMITSNGARVRDLQGNLLYSNSLPEELVLELYKTPFDTSKVCMNSYQDEGWFTNKDIPAMRQFHKESGFDYNVVDFSKHHGRGDRKSLFYW

SEQ ID NO: 2743 - DNA, 1002 bp, Haemophilus influenzae
  Name: NTH1523
atggctttcaatatgaaaaatagacatttacttagtcttgttcatcacacagaacgtgaaattaaatatctcttagatctctcccgagatttgaaacgagccaaatatgccggcacagaacaacaaaaattaaaaggcaaaaatatcgcgctcatctttgaaaaaacctccacccgcacacgctgtgcatttgaagtcgccgcttatgatcaaggcgcacaagtcacctacatcgaccctaattcctctcaaattggccacaaagaaagtatgaaagataccgcccgcgtattaggcagaatgtatgatggtattgaatatcgtggctttaaacaaagtatcgttcaagaactggctgattatgctggagtgccagtattcaatggtttaaccgatgaattccacccaacacaaatgcttgccgacgtacttaccatgattgaacattgcgacaaaccattaagtgaaattagctatgtatatattggggatgctcgcaataacatgggtaattcacttttattaattggtgcaaaattaggtatggatgttcgtatttgtggacctaaagcattattaccagaagcaaatcttgtggaaatgtgcgaaaaatttgcgaaagaaagtggagctcgtattactgtaactgaagatatcgacaaagcggtgaaaggcgtagattttatccatactgatgtgtgggtttcaatgggtgaaccattagaaacctggggcgaacgcattaaattattacttccttatcaagtcacacctgaattaatgaaacgcactggtaatccaaaagtgaaatttatgcactgcctacctgccttccataacagcgaaaccaaagttggtcgtcaaattgctgaaaaatatcctgaattagctaatggtattgaagtaactgaagaggtatttgaatcgccaatgaacattgcatttgaacaagcagaaaaccgtatgcacacaattaaagcggtaatggtagcaagtttggca

SEQ ID NO: 2744 - protein, 334 aa, Haemophilus influenzae
  Name: NTH1523
MAFNMKNRHLLSLVHHTEREIKYLLDLSRDLKRAKYAGTEQQKLKGKNIALIFEKTSTRTRCAFEVAAYDQGAQVTYIDPNSSQIGHKESMKDTARVLGRMYDGIEYRGFKQSIVQELADYAGVPVFNGLTDEFHPTQMLADVLTMIEHCDKPLSEISYVYIGDARNNMGNSLLLIGAKLGMDVRICGPKALLPEANLVEMCEKFAKESGARITVTEDIDKAVKGVDFIHTDVWVSMGEPLETWGERIKLLLPYQVTPELMKRTGNPKVKFMHCLPAFHNSETKVGRQIAEKYPELANGIEVTEEVFESPMNIAFEQAENRMHTIKAVMVASLA

SEQ ID NO: 2745 - DNA, 930 bp, Haemophilus influenzae
  Name: NTH1524
atgagaatagtgattgcattaggcggtaatgcattattacgacgcggagaaccaatgacagccgaaaatcaacgacaaaatgttcgcattgcttgtgagcaaattgctaagatttggccaaataatgaattagtgatagcacacggtaatggcccacaagtgggtttgctcgccttacaaggtgctgcctatactgatgtgccaacctatcctttagatgtattgggagcagaaacagctggaatgattggttatatgattcaacaagaactcggtaatttagttccatttgaagtgccatttgcaacgttattatctcaagtagaagttgatatcaacgacccagctttcaaaaatccaactaagccaataggtcctgtttatacaaaagaagaagctgaacgtttggcaaaagaaaaaaattggtctatcgcacaagatggtgataaatatcgtcgcgttgtgccaagcccattaccaaaacgtatttttgaaattcgtccggtcaaatggttgcttgaaaaaggcagtatcgtaatttgtgcggggggcggtggcattccaacctattatgatgaacaccataatttacaaggtgttgaagccgttatcgacaaagatttatgttcagctttacttgcagaaaatcttgacgctgatttattcatcatcgcaactgatgtttccgcaactttcgtagattggggtaaacctaatcaaaaagcaatttcagttgcctcacctgaagccatttcagaacttggtttcgcttcaggttccatggggccgaaagtacaagccgcgatcaactttgcgaaacaaacaggaaaagatgcagtaataggatctttatctgatattgtggacattgtgaaaggcaaagctggtactcgtattacgaaaaaagctgaaggcatatcctattatgct

SEQ ID NO: 2746 - protein, 310 aa, Haemophilus influenzae
  Name: NTH1524
MRIVIALGGNALLRRGEPMTAENQRQNVRIACEQIAKIWPNNELVIAHGNGPQVGLLALQGAAYTDVPTYPLDVLGAETAGMIGYMIQQELGNLVPFEVPFATLLSQVEVDINDPAFKNPTKPIGPVYTKEEAERLAKEKNWSIAQDGDKYRRVVPSPLPKRIFEIRPVKWLLEKGSIVICAGGGGIPTYYDEHHNLQGVEAVIDKDLCSALLAENLDADLFIIATDVSATFVDWGKPNQKAISVASPEAISELGFASGSMGPKVQAAINFAKQTGKDAVIGSLSDIVDIVKGKAGTRITKKAEGISYYA

SEQ ID NO: 2747 - DNA, 1173 bp, Haemophilus influenzae
  Name: NTH1525
ttgggaagccattctcaaggtaaaaagtgcggttggtttaaccaatgttttaccaaccgcactttaaacgttaaacataaggaactcgctatggatgcgtccaaaaagaagaaaacgtttaatttcccatcagcgtttacaattttatttgcaatcttaattctcgctgttggattaactggggttattccatccggttcatattcaaaattaacatataactctactgataatgtttttgtcgtcaaagcttatggcgttgatgataaaacttatcccgccacaacagacactcttgataatctcaatatcaaaattaaactctccaacttcaccgaaggcgtgatcaaaaaaccaatcgctattcctggcacttatcaacgtgtagaacaacaccataaaggcattgaagatatcaccaaaagtatggtagaaggtaccattgaagccgttgatgttatggtctttatctttgtattaggtggtatgattggtgtcattaaccgtactggttcttttaatgctggtttgatggctctcgtgaagaaaaccaaaggcaatgagttttttattgtattctgcgtatccgtcttaatggtgttaggcggcacaacctgtggtatcgaagaagaagcagtggcattttacccgattctggtgccagtattcttggctctgggatatgatgcgatagtctgcgtaggggctatattccttgctgcatctatgggaactgcattctctacaattaacccattctccgttgttatcgcatcaaatgcggctggtattcaatttactgaaggtattggtttccgtgctctaggtttagttttaggggcaacttgcgtaatcgcatatctttattggtactgtaaaaaaatcaaagctgacccaagcttttcttatacttacgacgatcgcgaagaattccgtcaacgttatatgaaaaactttgatccaaacacaactatcccattctcagctcgtcgcaaattaatcttaacgcttttctgcatctcattccctattatgatttggggtgtaatggttggcggatggtggttccctcaaaggctgcatctttccttgccattactatcatcattatgtttattagtggcttgtctgaaaaagatgttgtggaatctttcactgaaggtgcatcagaat

SEQ ID NO: 2748 - protein, 391 aa, Haemophilus influenzae
  Name: NTH1525
LGSHSQGKKCGWFNQCFTNRTLNVKHKELAMDASKKKKTFNFPSAFTILFAILILAVGLTGVIPSGSYSKLTYNSTDNVFVVKAYGVDDKTYPATTDTLDNLNIKIKLSNFTEGVIKKPIAIPGTYQRVEQHHKGIEDITKSMVEGTIEAVDVMVFIFVLGGMIGVINRTGSFNAGLMALVKKTKGNEFFIVFCVSVLMVLGGTTCGIEEEAVAFYPILVPVFLALGYDAIVCVGAIFLAASMGTAFSTINPFSVVIASNAAGIQFTEGIGFRALGLVLGATCVIAYLYWYCKKIKADPSFSYTYDDREEFRQRYMKNFDPNTTIPFSARRKLILTLFCISFPIMIWGVMVGGWWFPQRLHLSLPLLSSLCLLVACLKKMLWNLSLKVHQN

SEQ ID NO: 2749 - DNA, 579 bp, Haemophilus influenzae
  Name: NTH1526
ttggggtgtaatggttggcggatggtggttccctcaaaggctgcatctttccttgccattactatcatcattatgtttattagtggcttgtctgaaaaagatgttgtggaatctttcactgaaggtgcatcagaattagtaggcgtatccttaatcatcggtcttgctcgtggcgtgaacttagtgctcgaacaaggtatgatttctgacactatccttgattatatgtctaatgtggttagtggtatgccgggtagcgtatttatcttaggccaattagtcgtatttattttcctaggtttaatagtgccgtcttcttctggcttagccgtactttcaatgccaattatggcgccacttgctgactcagtgggtattccacgcgatatcgtggtttcagcttacaactggggacaatatgcaatgctattcttggcaccgacaggattagttttggtgacactccaaatgttgcatattccatttgatagatgggttaaattcgtcatgccaatgattggatgcttattgctaattggttccattttattggtagtacaagtatctttatatagtgtt

SEQ ID NO: 2750 - protein, 193 aa, Haemophilus influenzae
  Name: NTH1526
LGCNGWRMVVPSKAASFLAITIIIMFISGLSEKDVVESFTEGASELVGVSLIIGLARGVNLVLEQGMISDTILDYMSNVVSGMPGSVFILGQLVVFIFLGLIVPSSSGLAVLSMPIMAPLADSVGIPRDIVVSAYNWGQYAMLFLAPTGLVLVTLQMLHIPFDRWVKFVMPMIGCLLLIGSILLVVQVSLYSV

SEQ ID NO: 2751 - DNA, 339 bp, Haemophilus influenzae
  Name: NTH1527
atggtgaaaggcttagttgaaactgcaccatgggcatttgcttttgcgctatttgtactttcagtattagtaaacagccaaggtgcaacagtagcgacattgttccctcttggtatcgcattaggtatccctgcacctgtattaatcggtgtatttgttgctgtaaatggttacttcttcatccctaactatggtccaatcattgcatctcttgacttcgataccacaggtacaaccaaaatcggtaaatacattttaaaccacagctttatgcttccaggtttattgagcatgtttttctgcttattaatcggtttaggtctttctcacgttattctt

SEQ ID NO: 2752 - protein, 113 aa, Haemophilus influenzae
  Name: NTH1527
MVKGLVETAPWAFAFALFVLSVLVNSQGATVATLFPLGIALGIPAPVLIGVFVAVNGYFFIPNYGPIIASLDFDTTGTTKIGKYILNHSFMLPGLLSMFFCLLIGLGLSHVIL

SEQ ID NO: 2753 - DNA, 408 bp, Haemophilus influenzae
  Name: NTH1528
atgaaaaacgtcgtgatcgttggtgggggtgctggcggtattgaattagcaacatttttgggtaataaattaggtcgtcaaaaacaagctaaagtaacgctggttgatcgcaatgccacccatttatggaaacccttattgcatgaaattgcaacaggcgtaatggatgatggcgttgattctttaagttatcgtgcgcacggtaaaaatcattttttcagttttgagcaaggttcaattatacgtattaatcgcgagcaaaaatatgttgaacttgcacctgtttatggacaagagggcgatatgcttgtcattgctcgtcgaattccttacgattatttagtgattgccattggcagtaaatctaatgatttcaacacaaaggggtggctgataattgtatttttt

SEQ ID NO: 2754 - protein, 136 aa, Haemophilus influenzae
  Name: NTH1528
MKNVVIVGGGAGGIELATFLGNKLGRQKQAKVTLVDRNATHLWKPLLHEIATGVMDDGVDSLSYRAHGKNHFFSFEQGSIIRINREQKYVELAPVYGQEGDMLVIARRIPYDYLVIAIGSKSNDFNTKGWLIIVFF

SEQ ID NO: 2755 - DNA, 945 bp, Haemophilus influenzae
  Name: NTH1530
gtggctgataattgtatttttttagatagttcaaaacaggctttacgttttcaacataaactgttggaattatttttaaaattttcagaaaaccgtgcattagatgacattggcgaagaagaatttaaacaaaagttagtggatgaaaataaagtaaatattgctattgtgggaggtggtgctactggtgtggaattaaccgcagaactttatcatgcggctgaagatttgtcttcttacggttatggtaaaattgatagttcttgcttacaagttactttagtcgaagcaggaacacgtttattgccagcattacctgaaaatttatctgctgcagtgttagatgaattaaaggaaatgggcaccaatgtgcaattaaacacaatgattactgaggcgcagccaaatacacttattaccaaagatggcggggagattaaagctgatcttattgtttgggcagcaggagttcgcgcctcaacagtaacgcagcaatttgatggattagaaattaatcgtatcaatcaattagtggttaaagatacacttcaaactaccgttgatgatagtatttttgcgattggcgattgtgctgcattaatacaatcaaatggtaaattggttccgccaagagcgcaagctgcacatcaaatggcaaaggcttgtgcaaaaaatatttttgcattgtttgaaaataaaccactgaaatcttttaaatataacgataaaggtactttagtttctctgtcaaattttaccgcacttggtagtctaaccaataagtttggtaaaaatccacttaccgttcaaggtaaatttgcgcagtttgcttatgtgtctttgtatcgaatgcaccaacatgctttgcacggttgtattaaaattggtttgattattctcgttgataaattgaatcgttatttaaaaccaagattaaaattgcat

SEQ ID NO: 2756 - protein, 315 aa, Haemophilus influenzae
  Name: NTH1530
VADNCIFLDSSKQALRFQHKLLELFLKFSENRALDDIGEEEFKQKLVDENKVNIAIVGGGATGVELTAELYHAAEDLSSYGYGKIDSSCLQVTLVEAGTRLLPALPENLSAAVLDELKEMGTNVQLNTMITEAQPNTLITKDGGEIKADLIVWAAGVRASTVTQQFDGLEINRINQLVVKDTLQTTVDDSIFAIGDCAALIQSNGKLVPPRAQAAHQMAKACAKNIFALFENKPLKSFKYNDKGTLVSLSNFTALGSLTNKFGKNPLTVQGKFAQFAYVSLYRMHQHALHGCIKIGLIILVDKLNRYLKPRLKLH

SEQ ID NO: 2757 - DNA, 1230 bp, Haemophilus influenzae
  Name: NTH1531
atgatgtcaatgacacttcaagcattgcaacatagtcaaactcgccccatttcgattgttcctgtttacgttggttatgaacacgtattagaagtagacacttatgctaaggaattacgtggtgcagcgaaagaaaaagaaaatgcgggtttagtacttcgtgtaattaaaaaattacgtaatcttggtcaaggttttgtaaattttggtgagccaattacgctttcaaactatttgagccaacatttccctgattggaaagagcaaaatcacgaagaaaaaccacaatggtttacacctgcggtaaataatatttctaaacaagtaatgattaatattaacaaagcagcggcagttaattcaatgaaccttgtgggtacagcactactttcatctcgtcagcgagcactttcacgtgagcaactgttagaacaacttagtagttatcaacaattgttacaaaatgtcccttattctacggacgtagtgctaccaaatgtgacaccgcaagcaatgttagaacacgtattagctttagatcgtataggtgtgttaattgaaaaagataattttggcgaaattgtacgcttagaacgttcatctgctgtactaatgacttattatcgtaataatattcagcatctattcgtattaccatctttagttgcgagtattattttgcattacgaagcgatccaaaaagatttattattagacgcgattagaaaaatttaccctttcttacaaggcgaattgttcttacatttcaatgaagatgaattgaatgtacaaatccatcaaatcattaatgaatttgcacgccaaagcgttattaattcaaatgataacttcttatctattaataaatcaaaagtacgaattttacagctttggtctgcgggaacgcgggaaatcttgcaacgttattacattactgtcactattttacaaaaacaacctgctatttctcgagctgaacttgaaaaagaaagccagcttgttgctcaacgtttatcagtattacacggcataaatgcaccagaattctttgataaagcggttttttcaagctttattgcaaacttgaaagagcaacgttactttgatgaatctggttatactgttcttgataaaatagaagaattagcttcaacgctttcccatttgatttcaacagaaatttgcttaacggtgaaaggaacaattgaaaaatccgaagatctttcttca

SEQ ID NO: 2758 - protein, 410 aa, Haemophilus influenzae
  Name: NTH1531
MMSMTLQALQHSQTRPISIVPVYVGYEHVLEVDTYAKELRGAAKEKENAGLVLRVIKKLRNLGQGFVNFGEPITLSNYLSQHFPDWKEQNHEEKPQWFTPAVNNISKQVMININKAAAVNSMNLVGTALLSSRQRALSREQLLEQLSSYQQLLQNVPYSTDVVLPNVTPQAMLEHVLALDRIGVLIEKDNFGEIVRLERSSAVLMTYYRNNIQHLFVLPSLVASIILHYEAIQKDLLLDAIRKIYPFLQGELFLHFNEDELNVQIHQIINEFARQSVINSNDNFLSINKSKVRILQLWSAGTREILQRYYITVTILQKQPAISRAELEKESQLVAQRLSVLHGINAPEFFDKAVFSSFIANLKEQRYFDESGYTVLDKIEELASTLSHLISTEICLTVKGTIEKSEDLSS

SEQ ID NO: 2759 - DNA, 1101 bp, Haemophilus influenzae
  n 1065: n is any nucleotide
  Name: NTH1532
ttggacgataaaaacaccaaagggctaaaaatagttctattcacaaactgctttttaaacgtctataagatctacaaacttataacaaagagaaaatttattatggcaaattttataaatatgtatcgccaattattgagcttgccgctgtctgcattggtgaaaaataatcctattcccgccaatccaatagaagagctttcacttaatattcatcaacctattgtttatgttttgccttatacatctcaaactgatttcgttattttccgccgaaattgcttagcgttaggcttgcccgatcccgcagagaaaaatgaaattaatggcgttaagttaccacgttatgtatatttagacgaaggtcgccgaatttttaaatcaaaaggtgcaaaagacgaaaccactaccattttcaataaatatcttgaattacaccgcacttctgaaagtttagatgtgcaacttattcctgtttctgttctttggggacgttctcctggacaagaagataaatcagatttgcctaatttgcgtttattaaatggtatacaaaaaacatttgcagcaatttggtttggacgtgatacttttgtgcgtttttctcaagcggtttcattacgttatatggtagttgaacatggctcagatgaaaaaattgcacaaaagctggctcgagttgcaaaaatgcacttcgcaaaacaacgtatttcagcgacaggccctcgtttaccaaatcgtcaagcaatgtttaataaattattgcaatcagaagcaatccgacgagcaattgaagatgaagcaaaatcaaaaaatatcagtattgaaaaagcacaaaaagaagcatataaaattttggatgaaattgcagctgatgtcagccattcaagtttacgtgcagtagatcgttttttacgttggctttggaataaactttattcaggtattgatgtacaaaattcgaatcgtgtccgtaaattagcgttagaaggtcatgaaattgtttatgtgccttgccaccgtagtcatattgattacttattgctttcttatgtgctttatcantcaaggtcttgttccgccacatatcgcggcagggat

SEQ ID NO: 2760 - protein, 367 aa, Haemophilus influenzae
  Xaa 355: Xaa is any amino acid
  Name: NTH1532
LDDKNTKGLKIVLFTNCFLNVYKIYKLITKRKFIMANFINMYRQLLSLPLSALVKNNPIPANPIEELSLNIHQPIVYVLPYTSQTDFVIFRRNCLALGLPDPAEKNEINGVKLPRYVYLDEGRRIFKSKGAKDETTTIFNKYLELHRTSESLDVQLIPVSVLWGRSPGQEDKSDLPNLRLLNGIQKTFAAIWFGRDTFVRFSQAVSLRYMVVEHGSDEKIAQKLARVAKMHFAKQRISATGPRLPNRQAMFNKLLQSEAIRRAIEDEAKSKNISIEKAQKEAYKILDEIAADVSHSSLRAVDRFLRWLWNKLYSGIDVQNSNRVRKLALEGHEIVYVPCHRSHIDYLLLSYVLYXSRSCSATYRGRD

SEQ ID NO: 2761 - DNA, 225 bp, Haemophilus influenzae
  n 112, 119, 136: n is any nucleotide
  Name: NTH1533
gtgtatatgagaccattaaccgcacgccaacaagaagtgttggatttattaaaacgccatttggaaacaacaggtatgccaccaacacgagcagaaatatctcgagaattangtttcanatctgcaaatgccgcanaagaacatttgaaagcactttcacgtaaaggtgcaatcgaaatcattcccggcgcatttcgtggtattcgtattttagacatagttcaa

SEQ ID NO: 2762 - protein, 75 aa, Haemophilus influenzae
  Xaa 38, 40, 46: Xaa is any amino acid
  Name: NTH1533
VYMRPLTARQQEVLDLLKRHLETTGMPPTRAEISRELXFXSANAAXEHLKALSRKGAIEIIPGAFRGIRILDIVQ

SEQ ID NO: 2763 - DNA, 363 bp, Haemophilus influenzae
  Name: NTH1534
gtgggttataaagtaggaaatacacgtgttgcgggtgattatactcatcatggaaaagttgatggcacaaaaattcaaggtttaggtgcatcagtattatatgattttgacacgaattctaaagtgcaaccttatgttggtgctcgtgtagcgactaatcaatttaaatacaccaatcgcgcagaacaaaagtttaaaagttcttctgatattgagctcggatatggggttgtagcaggtgcaaaatataagttagatggcaactggtacgcaaatggtggagttgagtacaatcgtttaggtaattttgatagtaccaaagttaataactatggtgcaaaagttggtgtggggtacgggttc

SEQ ID NO: 2764 - protein, 121 aa, Haemophilus influenzae
  Name: NTH1534
VGYKVGNTRVAGDYTHHGKVDGTKIQGLGASVLYDFDTNSKVQPYVGARVATNQFKYTNRAEQKFKSSSDIELGYGVVAGAKYKLDGNWYANGGVEYNRLGNFDSTKVNNYGAKVGVGYGF

SEQ ID NO: 2765 - DNA, 417 bp, Haemophilus influenzae
  Name: NTH1535
ttggaaaatgcttataaaacagagcgtcaaaattatgctgatttggcagaattacgtaatattctttacgatttgccgaaaaaaaaagaggaagttgctaggttaaaaagcaatatggaaaagttgaaaaccgcagctaatccaaatcaagctaagattgacaacgcaactaaatcttatgaaacagctaaaaatgaattagtttcaacttggaaaggcactgcgggttcggtttcagtggggaataaaataagaggcataacccgccaaattactggcatagctgcagggacttatcgaggacaatctgccgttgcagctggagtccgttatacgcctaaaccaaatatggtaattagcctttctggctctgctgataccaataacggtgattgttttaaacgatcaccgttaaat

SEQ ID NO: 2766 - protein, 139 aa, Haemophilus influenzae
  Name: NTH1535
LENAYKTERQNYADLAELRNILYDLPKKKEEVARLKSNMEKLKTAANPNQAKIDNATKSYETAKNELVSTWKGTAGSVSVGNKIRGITRQITGIAAGTYRGQSAVAAGVRYTPKPNMVISLSGSADTNNGDCFKRSPLN

SEQ ID NO: 2767 - DNA, 681 bp, Haemophilus influenzae
  Name: NTH1537
atgtttcaagaatatttaagcgtgatcgtacaagggattccaacgagtttactactcacagtcgtatccttactgattgctttctttttagccttatttcttacttttttactttcaatggaaaacaaatggataaaaagtgcggtcaatttataccttactttattcactggcacgccactgttagtacagttctttttaatttatgcagggccaggccaatttcaatggattattgacagcccattatggtatgtcttatccaatgcgtggttctgtgccgtattagctttagcactaaacagcgcagcttattccacccaattatttcacggtgcagtaaaagccattcctaaaggacaatgggaaagttgcgcagcgttagggttaagccgattacagacactcaaaatcttaattccttatgccttaaaacgtgcgttgccttcttacagtaacgaaattattttggtatttaaaggaacggcattagcatccaccattacgattatggatattatgggttacgcacgccaactttatggtacagaatatgatgcaatcacaatttacggcattgcgggtggtatctatttaattatcacaggcattgcaacattattactacgtaaattagagaaaaaagtattggcatttgaacgttttgaagtaagcaaagca

SEQ ID NO: 2768 - protein, 227 aa, Haemophilus influenzae
  Name: NTH1537
MFQEYLSVIVQGIPTSLLLTVVSLLIAFFLALFLTFLLSMENKWIKSAVNLYLTLFTGTPLLVQFFLIYAGPGQFQWIIDSPLWYVLSNAWFCAVLALALNSAAYSTQLFHGAVKAIPKGQWESCAALGLSRLQTLKILIPYALKRALPSYSNEIILVFKGTALASTITIMDIMGYARQLYGTEYDAITIYGIAGGIYLIITGIATLLLRKLEKKVLAFERFEVSKA

SEQ ID NO: 2769 - DNA, 663 bp, Haemophilus influenzae
  Name: NTH1538
atgttttctgactttctttctttaatgtttaccgctgctctaatgactttagggcttgcggtctgttcattgctcttaggcttatttttaagccttatttttgccgtgcttgaagcaaatcgctttgttggcaagccgatgacagtatttgtggcattattacgtggcttacccgaaattattgttgtattacttgtctattttggttctactgaattagtcgaaatactgacaggagaatacattgaatttggggcatttggctgtggtgtgtttgcgctttctctcatttttgcagcttatgcttcacaaacattacgcggtgcaattcaagccataccaaaaggacaatgggaatcaggtgcagcgttaggcttaagcaaaagctatacgttcattcatattgttatgccacaagtatggcgtcacgccttacctggtttaagcaaccaatggcttgtattgctaaaagatacggcattggtttcattaattggtgtggacgatttgatacaccaagcggatctgatgaataccaatactcatcaaccctttacttggtacggtattgctgcgttaatttatttagcggtaacattaattagccaagttggtattcgaaaattagagctgcgttttactcgttttgaaaggggcatgaaa

SEQ ID NO: 2770 - protein, 221 aa, Haemophilus influenzae
  Name: NTH1538
MFSDFLSLMFTAALMTLGLAVCSLLLGLFLSLIFAVLEANRFVGKPMTVFVALLRGLPEIIVVLLVYFGSTELVEILTGEYIEFGAFGCGVFALSLIFAAYASQTLRGAIQAIPKGQWESGAALGLSKSYTFIHIVMPQVWRHALPGLSNQWLVLLKDTALVSLIGVDDLIHQADLMNTNTHQPFTWYGIAALIYLAVTLISQVGIRKLELRFTRFERGMK

SEQ ID NO: 2771 - DNA, 216 bp, Haemophilus influenzae
  Name: NTH1539
ttgggcgataccgcagtgctttccgatatgatttccaaagagccagaaattcaatttataggcgaaaaagtaaccaataaaaaatattttggtaatggtttaggtattgcaatgcacaaatcaaacaaagatttggctgcacaattaaacaaaggtttagctgcaattaaagcaaatggcgaataccaaaaaatctatgataaatggatgacaaaa

SEQ ID NO: 2772 - protein, 72 aa, Haemophilus influenzae
  Name: NTH1539
LGDTAVLSDMISKEPEIQFIGEKVTNKKYFGNGLGIAMHKSNKDLAAQLNKGLAAIKANGEYQKIYDKWMTK

SEQ ID NO: 2773 - DNA, 99 bp, Haemophilus influenzae
  Name: NTH1540
ttgcttggtttctgctacggtatattgttggaatgttgtaccattttgaacacctatatttttgcactttctaaggttgctttgcctttaagagcaaca

SEQ ID NO: 2774 - protein, 33 aa, Haemophilus influenzae
  Name: NTH1540
LLGFCYGILLECCTILNTYIFALSKVALPLRAT

SEQ ID NO: 2775 - DNA, 297 bp, Haemophilus influenzae
  Name: NTH1541
atgaaaaaaacattattaactgccattttattgggatcatctattgctgtaagcgcacaagaactcacttttgcaatggaacctagctatccaccatttgaaaccacaaatgaaaaaggcgaaattattggttttgatgtggatgtagcaaatgcaatttgtcaagaaattcaagcaacctgtaaattcaagagcgaaacctttgattcattaattcccagtttaaaggcaaaacgtttgatgcagcatttccgcaaattgtatacccgatgctcgtgcaaaacaagtgtattctcc

SEQ ID NO: 2776 - protein, 99 aa, Haemophilus influenzae
  Name: NTH1541
MKKTLLTAILLGSSIAVSAQELTFAMEPSYPPFETTNEKGEIIGFDVDVANAICQEIQATCKFKSETFDSLIPSLKAKRLMQHFRKLYTRCSCKTSVFS

SEQ ID NO: 2777 - DNA, 729 bp, Haemophilus influenzae
  Name: NTH1542
atggctattcgtgttaaaaatctcaatttcttttacggttcatcacaaacgttatttgatattaaccttgaagcggaagagggcgataccgttgtgttgctaggcccaagtggtgcaggcaaaagtacattaattcgcacattaaatttgttagaagtgccaaagtctggtgaattaagtattgcaaataatgattttaatttatccaatgcaatggcaaatcccaaagcaatccgacaattacgtcaagatgtaggaatggtttttcaacaatatcatctttggccgcacttaacggtaattgaaaacctaattgaagcaccaatgaaagtgcgtggtgtgagtgaaagtgaagcgaaaactgatgcaatggaattgttaaaacgtttacgtttagaacaacttgccgatcgctttccattgcatttatcaggcggtcagcaacaacgtgttgcaatagcgcgcgccctgatgatgaagccacaagttctattatttgatgaaccaacggctgcgctagatccagaaattacagcgcaagttgtagatattattaaagaattacaagaaactggcattacgcaagtgattgtaacccacgaagtcaatgtggcgcaaaaagtggcgacaaaagtcgtctatatggaacaaggtaaaatcgtcgaaatgggatcggctgattgctttgaaaatccaaaaacggaacaatttaaacactatctttctcac

SEQ ID NO: 2778 - protein, 243 aa, Haemophilus influenzae
  Name: NTH1542
MAIRVKNLNFFYGSSQTLFDINLEAEEGDTVVLLGPSGAGKSTLIRTLNLLEVPKSGELSIANNDFNLSNAMANPKAIRQLRQDVGMVFQQYHLWPHLTVIENLIEAPMKVRGVSESEAKTDAMELLKRLRLEQLADRFPLHLSGGQQQRVAIARALMMKPQVLLFDEPTAALDPEITAQVVDIIKELQETGITQVIVTHEVNVAQKVATKVVYMEQGKIVEMGSADCFENPKTEQFKHYLSH

SEQ ID NO: 2779 - DNA, 99 bp, Haemophilus influenzae
  Name: NTH1543
ttgagtttgaaatggcaaaacaagcctaaagtgcggttgatttcaatcgagtttttaaaatcccaaatttattgggattttttattaatagcacttgca

SEQ ID NO: 2780 - protein, 33 aa, Haemophilus influenzae
  Name: NTH1543
LSLKWQNKPKVRLISIEFLKSQIYWDFLLIALA

SEQ ID NO: 2781 - DNA, 207 bp, Haemophilus influenzae
  n 197: n is any nucleotide
  Name: NTH1544
atgcatatgtctcttctcgctatgatgaagcggtggggcaaaaagtcgatgtgtaatcggtttatgcatttcaggcaattcgaaaaatattttaaacgtcatgaagcggcaaaaacagaaggcatgatagtcattgcgatcacaggcaaagatggcgtaaaaatggcaggattagcggatgttgaaattagtgtacnccatattcgt

SEQ ID NO: 2782 - protein, 69 aa, Haemophilus influenzae
  Xaa 66: Xaa is any amino acid
  Name: NTH1544
MHMSLLAMMKRWGKKSMCNRFMHFRQFEKYFKRHEAAKTEGMIVIAITGKDGVKMAGLADVEISVXHIR

SEQ ID NO: 2783 - DNA, 219 bp, Haemophilus influenzae
  Name: NTH1545
atgatcaacaaagatacccaactctgcatgtctttatcaggtcgtccgagtaatttcggtactacctttcacaattatttgtacgacaagctagggttaaatttcatttataaagcattcaccacgcaagatattgagcacgccatcaaaggcgttcgcgcattaggcatccgtggttgtgctgtttcaatgccattcaaagaaacttgtatgccattt

SEQ ID NO: 2784 - protein, 73 aa, Haemophilus influenzae
  Name: NTH1545
MINKDTQLCMSLSGRPSNFGTTFHNYLYDKLGLNFIYKAFTTQDIEHAIKGVRALGIRGCAVSMPFKETCMPF

SEQ ID NO: 2785 - DNA, 801 bp, Haemophilus influenzae
  Name: NTH1546
atgacattagatgtgtggcaacatattcgccaagaagccaaagaacttgctgaaaacgaacctatgcttgctagtttttttcactctacaattttaaagcatcaaaatctgggtggtgcgctaagttatttattggctaacaaattagccaatcctattatgccagctatttctctccgtgaaattattgaggaagcctatcaatctaatccttcgattattgattgcgctgcttgcgatatccaagctgtccgccaccgagatcccgctgtagaattgtggtccactccattgctttatttaaaaggtttccacgcaattcaaagctatcgaattacccattatttatggaatcaaaatcgtaaatcccttgccctttatttacaaaaccaaatttcagtagctttcgatgtagatattcacccagcggcgaaaattggccacggaatcatgttcgaccatgcaacaggtattgttgtgggtgaaacatctgtaatcgaaaatgatgtttcaattttgcaaggggtaacacttggcggtacgggaaaagaatcaggcgatcgtcatcccaaagtacgcgagggtgttatgattggggcgggtgcaaaaattctcggtaatattgaagtgggtaaatacgccaaaattggggcaaactctgttgtgcttaaccccgttcctgaatatgccacagcggctggcgtgccagctcgaattgtaagtcaagataaagcagcaaaacctgctttcgatatgaaccaatattttatcggcattgatgatggaatgaatttaaatata

SEQ ID NO: 2786 - protein, 267 aa, Haemophilus influenzae
  Name: NTH1546
MTLDVWQHIRQEAKELAENEPMLASFFHSTILKHQNLGGALSYLLANKLANPIMPAISLREIIEEAYQSNPSIIDCAACDIQAVRHRDPAVELWSTPLLYLKGFHAIQSYRITHYLWNQNRKSLALYLQNQISVAFDVDIHPAAKIGHGIMFDHATGIVVGETSVIENDVSILQGVTLGGTGKESGDRHPKVREGVMIGAGAKILGNIEVGKYAKIGANSVVLNPVPEYATAAGVPARIVSQDKAAKPAFDMNQYFIGIDDGMNLNI

SEQ ID NO: 2787 - DNA, 996 bp, Haemophilus influenzae
  Name: NTH1548
atgataacttcgcaaacaccaatcactgtgctaggtgcgggatcttatggaactgcgctggcaattaccttttctcgcaatggttctcccactcacttatgggggcacaatcccgtccatatcgcacaaatgcagacagaacgacaaaattatcgttttttgccggatgtcatctttcctgaggatcttcatttagaaagtaatcttgcacaagcaatggaatattctcaagatattttaatcgtggtgccaagccatgctttcggtgaaattcttataaaaattaaaccgcacttaaaagcccatcaccgattaatttgggcaacaaaaggtctggagcgtaacacagggcgtttactacaaaccgtagttgaagaacaactcggaacgcaatatccactagctgtactttctggcccaacttttgcaaaagaattagcgcaaggtctaccatcagctattacgcttgctgccaataacgagcaattcgcgcgggaatttcagtctcgtattcattgtagtaaaggtttccgagtttatataaattcggatatgactggcgttcaacttggtggtgcaattaaaaatgtgatcgcaattggtgcgggtatttcagacggtatgggatttggcgcaaatgctcgcacagcactgattactcgaggtattgcagaaattacccgcttaggtatctcgctcggtgcaaataccaatacatttatgggaatgtctggattgggcgatttagtgctaacttgcaccgataatcaatcgcgcaatcgacgttttggattaatgctaggtaaaggattagatgcccaaatggctatggaaaatatcgggcaagtcgtagaaggtttttataatacaaaagaagcctatttgcttgcacaaagacaaggtgtggaaatgccgattacagaacaaatttatcaaatgctgttttgtggcaaaaacgccacaagatgtagcaatcagccttttggggcgagcatg

SEQ ID NO: 2788 - protein, 332 aa, Haemophilus influenzae
  Name: NTH1548
MITSQTPITVLGAGSYGTALAITFSRNGSPTHLWGHNPVHIAQMQTERQNYRFLPDVIFPEDLHLESNLAQAMEYSQDILIVVPSHAFGEILIKIKPHLKAHHRLIWATKGLERNTGRLLQTVVEEQLGTQYPLAVLSGPTFAKELAQGLPSAITLAANNEQFAREFQSRIHCSKGFRVYINSDMTGVQLGGAIKNVIAIGAGISDGMGFGANARTALITRGIAEITRLGISLGANTNTFMGMSGLGDLVLTCTDNQSRNRRFGLMLGKGLDAQMAMENIGQVVEGFYNTKEAYLLAQRQGVEMPITEQIYQMLFCGKNATRCSNQPFGASM

SEQ ID NO: 2789 - DNA, 1701 bp, Haemophilus influenzae
  Name: NTH1549
gtgctcaaaattttgttgttggaagcctattccaaggaatacccaaacacttgcttaattgcccgcacttttaagcgagatttactttcaggcaataccaatcctgatcaccattttgatccttacattgccattcttgcaaaagtaacccaatatttaaccgcactttctgaatttaaacgtttggattttgtgcaccgttgtttctatgtgaaagcaacggaagattttgcacgttaccaagccaataattggcgtattcgttatatggaaatccttgcgcaagaatggggatggtctgcagaaacggtaaaacatctcaataagcgtccattttggaaaattaaggcagtaaaagaaaaccacgataacataatgaaatttttaatgttgagttatcgtaatttagtggaatttgctcgaaagcatcatattcactcgagcgtcgtgccacaagatatcaacattctttctcgtaaactttatactgcttttgaagaacttcccggcaaagtgtccttactcaacacacagatatctcacaatttatcagaagcacacctgacttttgtggaagttcgtggcaataaacattttaaagatagttggtaccttatcaatcaaccaatacaccatattatgttctccaaagaacgggtgatcgaatacggagaaagcctgaataaattagtttcttgggcttatttcaatcatttactcacagaaaaaaccgaattgtcaatttttagcaagaatgtgactttaagcacattgcaacgctttgtcactaacttacgtcagtcttttccaagcaccatcgccaaacaacctaaaaatagcgatttattgaatcaatgtgaaattcgtagcttgtttattgccataaatctcacgaccgatccaacatccaaagtagaagaagtattaacgggtatttcatcgcgagatttatttagttttggatcgcttgagcaaagccttgtgggcagtattgattttacttatcgtaacgtgtggaacgaaatccgaacgctccattttgaagggcaaaatgccattttgcttgcactaaaagtgctttctaacaaaatttatcgtggcgttaatcgcccagattccatccaagtctattgttatagtgaacgttatcgccaagatttacgtcaattagtgatgggattagtcaatcgatgcgttagcatccaagtcggcgatattcaacaaccttgccaaacgtcacgtttacgcgtagcgggtaaaaactggcaattattttttgaagatcgcggcatcagcttacaagaaatcggaaatgaatcggtctgtaatgacgctgaaagtgcggtggattttgacgaagttttacaaacaccaattgaagatggcgagacaaaccaagaaagtcgtcgctatccaccagaaatggatgccttcgcaagtgaaggattcctacaattcttttttgaagataattctgatcacagcttcaatgtttatattttagatgaatctaatcatctcgaaatctatcgccactgcgatggtgaaaaagatgaaaaagtgcgggagattaatcaactttatcaaaacgccaaacaggaaggcgataaaaatccttacaatatcgttcaacataattttaactaccctcaattttatcaactacaaaatgggaaaaaatggcatatccatcgtgccgtt

SEQ ID NO: 2790 - protein, 567 aa, Haemophilus influenzae
  Name: NTH1549
VLKILLLEAYSKEYPNTCLIARTFKRDLLSGNTNPDHHFDPYIAILAKVTQYLTALSEFKRLDFVHRCFYVKATEDFARYQANNWRIRYMEILAQEWGWSAETVKHLNKRPFWKIKAVKENHDNIMKFLMLSYRNLVEFARKHHIHSSVVPQDINILSRKLYTAFEELPGKVSLLNTQISHNLSEAHLTFVEVRGNKHFKDSWYLINQPIHHIMFSKERVIEYGESLNKLVSWAYFNHLLTEKTELSIFSKNVTLSTLQRFVTNLRQSFPSTIAKQPKNSDLLNQCEIRSLFIAINLTTDPTSKVEEVLTGISSRDLFSFGSLEQSLVGSIDFTYRNVWNEIRTLHFEGQNAILLALKVLSNKIYRGVNRPDSIQVYCYSERYRQDLRQLVMGLVNRCVSIQVGDIQQPCQTSRLRVAGKNWQLFFEDRGISLQEIGNESVCNDAESAVDFDEVLQTPIEDGETNQESRRYPPEMDAFASEGFLQFFFEDNSDHSFNVYILDESNHLEIYRHCDGEKDEKVREINQLYQNAKQEGDKNPYNIVQHNFNYPQFYQLQNGKKWHIHRAV

SEQ ID NO: 2791 - DNA, 126 bp, Haemophilus influenzae
  Name: NTH1550
atgaaaaacaggtgggcgcgtttaattactgaagggaaaatagatccaaatgattgggtgatttcgggcggtttaggacaattttctgcaaacgatattttcgggggccagtttatggcatcttta

SEQ ID NO: 2792 - protein, 42 aa, Haemophilus influenzae
  Name: NTH1550
MKNRWARLITEGKIDPNDWVISGGLGQFSANDIFGGQFMASL

SEQ ID NO: 2793 - DNA, 684 bp, Haemophilus influenzae
  Name: NTH1551
gtggaatgtaatctagcacaagcaaaacaatgggttagcgccttggatcaacgccgttttgagcgtgcattacaaggttcaggcgatgcattccaacacgttttagcgattgcacctttacttctacacctaaaccatccgcaacttcccggctatgttattcacgccccctctggcattgcgaatttccttgcttctgattatcaaaaaaaatggctcaccaatgaatacagtattcactatgccgatcataagccatcaacactcaaaagtgcggtaaattttcacgaagttttaccaccaattctaggcgtttatgtaatgggtagctttggctcaataagtcaaacctcttcttcagatcttgatacttggatttgtgtccgtgatggcttgagtccagatgaatatacacttcttactcaaaaagccaagcggattagtgaatgggcaatgcaatttaatgtggaaattaatttttatttgatggatcaacaacgtttccgcaatgaacattatgctgacccactgactattgaaaatagcggctctgcgcaatatatgttattgcttgatgagttctatcgctccgccgtacgcttggctggtaaacttctactttggttgcatttatgggtggaaaatggaaaagactatgaaaaacaggtgggcgcgtttaattac

SEQ ID NO: 2794 - protein, 228 aa, Haemophilus influenzae
  Name: NTH1551
VECNLAQAKQWVSALDQRRFERALQGSGDAFQHVLAIAPLLLHLNHPQLPGYVIHAPSGIANFLASDYQKKWLTNEYSIHYADHKPSTLKSAVNFHEVLPPILGVYVMGSFGSISQTSSSDLDTWICVRDGLSPDEYTLLTQKAKRISEWAMQFNVEINFYLMDQQRFRNEHYADPLTIENSGSAQYMLLLDEFYRSAVRLAGKLLLWLHLWVENGKDYEKQVGAFNY

SEQ ID NO: 2795 - DNA, 330 bp, Haemophilus influenzae
  Name: NTH1552
gtggcaacaaattcagcagccttaattatgtctattatttctcaaattgaagcctgtgatttcgagcgattgtatgaaatcgaacagcaagcacatctggtgccttggtcatttggtacgttaaaaaataatcaaggtgagcgttatctcaatttaaaattaatagagaataatcagattatcggttttgctatttgccaaaccgtattagatgaagcgactttgtttaatattgctattgtaccctctcatcaaggtaatggattggggaaattattgttgaatgagttaatcgctcgattgaaagaaaaaggtgtacagacttatggc

SEQ ID NO: 2796 - protein, 110 aa, Haemophilus influenzae
  Name: NTH1552
VATNSAALIMSIISQIEACDFERLYEIEQQAHLVPWSFGTLKNNQGERYLNLKLIENNQIIGFAICQTVLDEATLFNIAIVPSHQGNGLGKLLLNELIARLKEKGVQTYG

SEQ ID NO: 2797 - DNA, 402 bp, Haemophilus influenzae
  Name: NTH1554
atgaacagacgcgatcttcttttacaagaaatgggcatttcccagtgggaattatatcgccccgaggtactgcaaggttcagtaggaattagtgtggcagagaatattcgctttatcactgtttccaatgaaaatatcagtagctcgcctttgttggctgatgtgctgttaagccttaatcttaaaaaagaaaattgtttatgtttgaattacgatcaaatccagcatatggaatgtaagcagcctattcgttactggttactatcagaaaataacgaccaaattgaccgcactttgccattttgcaagcaggctgagcaggtttatcgctcgccaagttggcagcaatttcaatctaatcatcaagccaaacgagcgttgtggcaacaaattcagcagcct

SEQ ID NO: 2798 - protein, 134 aa, Haemophilus influenzae
  Name: NTH1554
MNRRDLLLQEMGISQWELYRPEVLQGSVGISVAENIRFITVSNENISSSPLLADVLLSLNLKKENCLCLNYDQIQHMECKQPIRYWLLSENNDQIDRTLPFCKQAEQVYRSPSWQQFQSNHQAKRALWQQIQQP

SEQ ID NO: 2799 - DNA, 96 bp, Haemophilus influenzae
  Name: NTH1555
atgaaagatggcgttctaaaacttggctttctagagaaatcacgctttgaatcctgtgggttattggttaaaattacgcaccattttagcaaagat

SEQ ID NO: 2800 - protein, 32 aa, Haemophilus influenzae
  Name: NTH1555
MKDGVLKLGFLEKSRFESCGLLVKITHHFSKD

SEQ ID NO: 2801 - DNA, 666 bp, Haemophilus influenzae
  Name: NTH1556
gtgcgttcagtagaaaaaacattagcaccctatggagaaatagcaaaaattgactctgctcgtcgttgcggtttatatcatttttcactccaaaataaaccgcactttgaacttaaaaatttctggaaaacctaccaacatcctacgatacaagacttaactatatatagtttacctggtgtatttagtgcagcggaattagatacgggcacagaactgttactttcaaccattgataataaaataaaaggaaaagtactcgatcttggctgtggggcgggagtaattggctctgtgataaaaaaaagctctactaacgcacaaattaccatgactgatattcatgcgatggcgttagaatcagcgcataaaacactttctgaaaatcaattacaaggcgaggtttacgccagtgatgtcttttctgatatagaaggaaaatttgatttgatcatttcaaatccaccattccatgatggtattgatactgcctaccgagcagtgacagaactcatcactcaagcaaaatggcacctcaatcaaggtggagaattacgcattgtcgccaatgcatttttgccttatcccgaattacttagacaacatttcggtgattacgaaattcttgctcaaacaggaaaatttaaagtgtattcagtgaaaaat

SEQ ID NO: 2802 - protein, 222 aa, Haemophilus influenzae
  Name: NTH1556
VRSVEKTLAPYGEIAKIDSARRCGLYHFSLQNKPHFELKNFWKTYQHPTIQDLTIYSLPGVFSAAELDTGTELLLSTIDNKIKGKVLDLGCGAGVIGSVIKKSSTNAQITMTDIHAMALESAHKTLSENQLQGEVYASDVFSDIEGKFDLIISNPPFHDGIDTAYRAVTELITQAKWHLNQGGELRIVANAFLPYPELLRQHFGDYEILAQTGKFKVYSVKN

SEQ ID NO: 2803 - DNA, 543 bp, Haemophilus influenzae
  Name: NTH1558
gtgttagctattaacaaagtagataacatcaaaaataaagatgatttattgccgtttattacagatcttagcagtaaatttaactttgctcacattgtgccaatttctgcacagcgtggtaataatgttcatgaattagagaaaattgtacgccaatctttacgcgaaggtgtgcatcatttcccagaagattatgtcacagaccgctcgcaacgttttatggcatcggaaataatccgtgaaaaattaatgcgttttaccggtgaagaattgccttactctgttactgttgaaattgaacaatttaaagtgaatgaacgtggcacttatgaaatcaatggcttaattctcgttgaacgtgaaggtcagaaaaaaatggtaattggtgcgggcggtcaaaaaattaaaactattggtatggaagcgcgtgctgatatggaacgtttatttgataacaaagttcacctcgaactttgggtgaaagtgaagtcaggttgggcagatgatgaacgtgcattgcgtagtttaggatatatggatgaa

SEQ ID NO: 2804 - protein, 181 aa, Haemophilus influenzae
  Name: NTH1558
VLAINKVDNIKNKDDLLPFITDLSSKFNFAHIVPISAQRGNNVHELEKIVRQSLREGVHHFPEDYVTDRSQRFMASEIIREKLMRFTGEELPYSVTVEIEQFKVNERGTYEINGLILVEREGQKKMVIGAGGQKIKTIGMEARADMERLFDNKVHLELWVKVKSGWADDERALRSLGYMDE

SEQ ID NO: 2805 - DNA, 375 bp, Haemophilus influenzae
  Name: NTH1559
atgaccgaacaattcgacaaaacctattgcggctttattgctatcgtaggtcgcccaaatgtgggtaaatcaacgctcttaaataaaattttaggacaaaaaatttcaattacatcgcgtaaagcacaaaccacccgtcaccgcattgttgggattaaaactgaaggtgcgtatcaagaaatctacgtggatacaccggggcttcatattgaagaaaaacgggcgattaaccgcttaatgaaccgtgccgcaagtagtgctattggcgatgttgatttaattatttttgtcgtagatggtacacactggaatgcagatgatgagatggtgctaaacaaactacgtaaatgcaaaagcaccagttgtgttagctat

SEQ ID NO: 2806 - protein, 125 aa, Haemophilus influenzae
  Name: NTH1559
MTEQFDKTYCGFIAIVGRPNVGKSTLLNKILGQKISITSRKAQTTRHRIVGIKTEGAYQEIYVDTPGLHIEEKRAINRLMNRAASSAIGDVDLIIFVVDGTHWNADDEMVLNKLRKCKSTSCVSY

SEQ ID NO: 2807 - DNA, 681 bp, Haemophilus influenzae
  Name: NTH1561
atgaatcatttagatcgacttgagcgtaaaatcggctattgttttaatgatattgcgctcttaaagcaggcacttacgcaccgaagtgcggcaactcaacataatgaacgcctagaattcctaggcgattccattcttaatttcactatcgctgaagcactttatcatcagtttccacgttgtaatgaaggagaactgagccgtatgcgtgctactttggtacgcgaacccactttagcgattttagcgcgccaatttgaattaggcgattatatgtcgcttggttctggcgagctaaagaacggtggttttcgccgtgaatctattcttgccgattgtgtagaagcgattattggcgcaatgtctttggatcagggattggctgtgacgacccaagtgatacgaaattggtatcaacagttattggcagaaattaaaccaggcgataatcaaaaagatgcgaaaacgcgtttacaagaatatttacaaggcaaacatttgccattgccaacttatgaagtggtcaatattcaaggggaagcccattgccaaattttcactgttgaatgcaaagtgaaaagtgcggggaaaattgaccgcacttttgtggcaaaaggatctagccgtcgtaaagctgaacaagcggcagcagaacaaattttaaaagaactggacatcaaa

SEQ ID NO: 2808 - protein, 227 aa, Haemophilus influenzae
  Name: NTH1561
MNHLDRLERKIGYCFNDIALLKQALTHRSAATQHNERLEFLGDSILNFTIAEALYHQFPRCNEGELSRMRATLVREPTLAILARQFELGDYMSLGSGELKNGGFRRESILADCVEAIIGAMSLDQGLAVTTQVIRNWYQQLLAEIKPGDNQKDAKTRLQEYLQGKHLPLPTYEVVNIQGEAHCQIFTVECKVKSAGKIDRTFVAKGSSRRKAEQAAAEQILKELDIK

SEQ ID NO: 2809 - DNA, 1047 bp, Haemophilus influenzae
  Name: NTH1562
atgtcaaatttattttttgtgattttattggctgtcggctttggtgtgtggaaagttttagattattttcagttgccaaatacttttagtattttgttactaattttgaccgcactttctggcgtattatggtgttatcatcgttttgtggtgctgccaaaacgtcatcgtcaagtggcacgtgcagaacaacgttctggtaaaaccttaagtgaggaagaaaaagccaaaattgaaccgatttctgaggcttcagaatttttgtcttcactttttcctgtgcttgcagtggtatttttggttcgttcttttttgtttgaaccgtttcaaattccctctggctcaatggagtccactttacgcgttggcgattttttagttgtgaataaatatgcttatggtgtgaaagatccgattttccaaaacaccattattgagggcgaaaaaccacaacgtggcgatgtgattgtgtttaaagcaccacaacaagcgttaattcgtactggtcttggggctactcgagcggcttttgcagaaaatttagcgttaagttcaaaagataatatgtctggtgtggattatattaagcgtattgttggaaagggcggagatcgcatcatttttgatgtggaacaaaaaacattaaaaattgtatatggcaaagatggtaaaccttgtgaagttgattgcgaaaccaaggcgtttgaatatacacaaaatccaacaaatcctgcttttccgaatgaattagaattgactgaaaaaggcgatgtaacacataacgtgttaattggtgagtatcgtcgttattcagaccttgaatttttcccacaagagggaatgcaaactgcagaatggcttgtgccagaggggcagtattttgtgatgggggatcatcgcgatcacagcgatgacagtcgtttttggggctttgtgcctgaaaaaaatattgtggggaaagccacttatatttggatgagcttagaaaaagaagcgaatgaatggccaacaggtttccgttttgatcgcttctttacagcaataaaa

SEQ ID NO: 2810 - protein, 349 aa, Haemophilus influenzae
  Name: NTH1562
MSNLFFVILLAVGFGVWKVLDYFQLPNTFSILLLILTALSGVLWCYHRFVVLPKRHRQVARAEQRSGKTLSEEEKAKIEPISEASEFLSSLFPVLAVVFLVRSFLFEPFQIPSGSMESTLRVGDFLVVNKYAYGVKDPIFQNTIIEGEKPQRGDVIVFKAPQQALIRTGLGATRAAFAENLALSSKDNMSGVDYIKRIVGKGGDRIIFDVEQKTLKIVYGKDGKPCEVDCETKAFEYTQNPTNPAFPNELELTEKGDVTHNVLIGEYRRYSDLEFFPQEGMQTAEWLVPEGQYFVMGDHRDHSDDSRFWGFVPEKNIVGKATYIWMSLEKEANEWPTGFRFDRFFTAIK

SEQ ID NO: 2811 - DNA, 1434 bp, Haemophilus influenzae
  Name: NTH1563
atggctaattatggattaacgcgtagtggctttgtacgtaagcgtatgccagagcagttaaaagagctttatgaaaatgcgaagaaaatgtttggggaagatattgatttgtcacctgaaactgtgatgggaatgatgttaaacattgaatcagaacgctttgccgccttatgggagcttattgaaagcgtttatagtgcaatgtatccgattagcgcaaccggagcaaatttagatcgagccgtttcttttacaggagtcactcgtttacaagcagaacattcaacggtgccagtgattttttacggcaatgcaggcgttgaaatcccccaatatactgcagtacgcaatgcaggaacacaggttttatattattcagatgaagacgcacgcattgattcaaatcaagccgcttatgcacggattgagctaaattcaaataccattaatacgggcgatgtattttccgtcgtagttaatggtgtgacgtatcgttttacagcaatgcgttcatcaagtgcgagtattattcaaggtttagccaatcaattaaaagcgataagttatgccgatgtgagtaatgataatgtaattattgagatttcggcacaatctataccgcacttttctatctccgttagccaaaatcttacgctttctcgcttaggcgtgcgttgtatgctttccactgaaagccctagtgaagataaagccgatattgggcaaatgattgaactggtaaatatgattgatggcgttgttgaagtgaacaatgttgttgaaggtgcatccggtcgtttagaagaaagtgatattgaattatatcaacgttatcatcgtggtgtttggcaaaatggagccggtacaattgattcactttatgccaatttaagcaaggtagcgggcgttcattcattgagaatttatgaaaacgatgcagatcagacgattaatggtattcctaagcgttcactgtatgcggtagtcaaaggtggtttagatacggatatcgcatcgacattattaaaatttaagcctttgggtattggcacacacgggcaaaccgaagttactgtgcgagacagtcaaaaccaaccgcacttgattaaatttagtcgtccgactaaatgttacatttggttaaaagttaccattgaaacctttgttgatgaagatgaaattgcgagagctggttacattgtaagtgcactcaacaatatcttgaaatatggtaaatcacttggcgtgggagcagatgtaattcatcaacgccttattgctgcttgcattgcggttcaaggcgtgggaaaagttaccgttcagataggtaaaacgaataatattaccgatccagagccaagataccaagaacagaatatcaccatcgcacctgatgaagaagcgattttcgatccgtctatcattgtgatgagt

SEQ ID NO: 2812 - protein, 478 aa, Haemophilus influenzae
  Name: NTH1563
MANYGLTRSGFVRKRMPEQLKELYENAKKMFGEDIDLSPETVMGMMLNIESERFAALWELIESVYSAMYPISATGANLDRAVSFTGVTRLQAEHSTVPVIFYGNAGVEIPQYTAVRNAGTQVLYYSDEDARIDSNQAAYARIELNSNTINTGDVFSVVVNGVTYRFTAMRSSSASIIQGLANQLKAISYADVSNDNVIIEISAQSIPHFSISVSQNLTLSRLGVRCMLSTESPSEDKADIGQMIELVNMIDGVVEVNNVVEGASGRLEESDIELYQRYHRGVWQNGAGTIDSLYANLSKVAGVHSLRIYENDADQTINGIPKRSLYAVVKGGLDTDIASTLLKFKPLGIGTHGQTEVTVRDSQNQPHLIKFSRPTKCYIWLKVTIETFVDEDEIARAGYIVSALNNILKYGKSLGVGADVIHQRLIAACIAVQGVGKVTVQIGKTNNITDPEPRYQEQNITIAPDEEAIFDPSIIVMS

SEQ ID NO: 2813 - DNA, 612 bp, Haemophilus influenzae
  Name: NTH1564
atgaaagatattttaaccgcacttaatgatgattttaagcagttagggcgagagcgattactttctcaatttaattactcgcctaacttaaacgcatttttatcacttcttcttttaccgcatcacgaaattcaagcaaccttaaagcaaatgcttacagaaaggcatattgataccgctataggaaaacaacttgatggcgtaggcgatattgtcggtatgccacgccctttcgctagagtaaatggcgattggtatttcggtttttctggtcaatcaaaggcaaaaccctttagtcgagcccctattcgtgatttagccacgcaaactaattctagagattttaattatatgctcgatgagcattatcgacgattaattaaatggaaagttatcgccaatcattcacatggcacccttgatgatgtaatcgaagcctgtagggctatatttttagcagagcgtgtttcaatcacagaaggacaggatgcagatgtgcatatagcgattacacgaatggcaaaaaatagattagatgcagtagaacaagagccggttttgtggattcccacggcagcaggtgtaaaggtaacggtagaatttataaacgca

SEQ ID NO: 2814 - protein, 204 aa, Haemophilus influenzae
  Name: NTH1564
MKDILTALNDDFKQLGRERLLSQFNYSPNLNAFLSLLLLPHHEIQATLKQMLTERHIDTAIGKQLDGVGDIVGMPRPFARVNGDWYFGFSGQSKAKPFSRAPIRDLATQTNSRDFNYMLDEHYRRLIKWKVIANHSHGTLDDVIEACRAIFLAERVSITEGQDADVHIAITRMAKNRLDAVEQEPVLWIPTAAGVKVTVEFINA

SEQ ID NO: 2815 - DNA, 1035 bp, Haemophilus influenzae
  Name: NTH1565
atgaagttaaaactaatcgatttattcaaaagaattacttgggcgaaaaacggcgatttaaccgacttttctcaaactaattatgaagcaggctgggcgcatttaggcgatgatacgccaacagtgcaagactttaactatgttcaacaaatgaacgacaaaaaagaccagtggttgtttaatcaattaaaagccgtgttggaaaaagccaatatcgagccaacagaagaaaatgttaattcattgcgtgatgcgattttggcattatcaaaaggctatagcaatcctaaaagcctaacggcagacacagtgaattttattgatgagcaaggtcacactcacgaaatcgctaaagcaaccttgcaacaacaaggcatagtccaacttaccaatgacacggggcttgaaagtgaatctcttgcactcaccgcaaaagcagggaaaaaactcgctcaacaaacaacacaattacagttaaatgtctcgcaaaattacatccaaaacagcaaaaaatcctctgcagtaaatagcgaaagcgaagataacgtagcgacaagtaaagcagccaaaaccgcctatgacaaagcagtagaagccaaaactaccgcagagagcaaagtaggattaaggggcaatgaatcgattcaaggtaccaaaagttttgaatctaaaatcattgggtttcgtggcattggggtggctgattcgcaaacttatgcaaatgctaatcacctcttaaatatgggggcaaatgatggcgacggttggatagagtataaaaaaagtaaccgagttatcggcaccattcgtattcgggcaaatggggaattgtcatataacaatcaaaaaatctaccacgctggggcaaaaccccaatttaatacggatattgaaggcaagcctaatacacttgcaggctatggtattgggaattttaaagtagaacaagggcagggcgatgccaatggctataaaaccgagggcaattattacgttagcaacggtcaaaatctacccgaaatgggcatggcatat

SEQ ID NO: 2816 - protein, 345 aa, Haemophilus influenzae
  Name: NTH1565
MKLKLIDLFKRITWAKNGDLTDFSQTNYEAGWAHLGDDTPTVQDFNYVQQMNDKKDQWLFNQLKAVLEKANIEPTEENVNSLRDAILALSKGYSNPKSLTADTVNFIDEQGHTHEIAKATLQQQGIVQLTNDTGLESESLALTAKAGKKLAQQTTQLQLNVSQNYIQNSKKSSAVNSESEDNVATSKAAKTAYDKAVEAKTTAESKVGLRGNESIQGTKSFESKIIGFRGIGVADSQTYANANHLLNMGANDGDGWIEYKKSNRVIGTIRIRANGELSYNNQKIYHAGAKPQFNTDIEGKPNTLAGYGIGNFKVEQGQGDANGYKTEGNYYVSNGQNLPEMGMAY

SEQ ID NO: 2817 - DNA, 186 bp, Haemophilus influenzae
  n 177, 178, 179, 180, 181: n is any nucleotide
  Name: NTH1567
ttgttctccctacctttgattttctattccttttcttttcttccccttcttctccctttcccttttgtgttagtgttgcctttcccccttccccctccccctccccccccccccccccttctcccccccctcccccctccccccccccccccttcccccctccccccctccccctcnnnnnttaat

SEQ ID NO: 2818 - protein, 62 aa, Haemophilus influenzae
  Xaa 60, 61: Xaa is any amino acid
  Name: NTH1567
LFSLPLIFYSFSFLPLLLPFPFVLVLPFPLPPPPPPPPPLLPPLPPPPPPPSPLPPSPSXXN

SEQ ID NO: 2819 - DNA, 1185 bp, Haemophilus influenzae
  Name: NTH1568
atgactaacattaataccgttctcgcggaactaaagcgtggtactgatgaaatcctttcagaagcggatttaatcgaaaaactgaaagaaaatcgcccattaaaagtaaaattaggcgcagatccaaccgcaccagatattcatttaggacatactgttgtattaaataaattacgtcaatttcaacaactcggtcatgaagtctatttcttaattggcgattttactggaatggtgggcgatccatcaggtaaaaatgcgactcgtcctccacttagccgtgaagatgtattgcgcaatgcggaaacctataaagagcaaatttataaaattctcgatccacaaaaaaccaaaatcgtcttcaactctgaatggttaagcaaacttggtacagaaggtatgattcgtcttgcaagcaactatacggttgcgcgtatgcttgaacgcgacgacttcaaaaaacgctttggcaacaaccaacccattgccatccatgaatttatttatccattactgcaaggctacgattccgttgcattagatgcagatgtagaactaggcggtacagaccaaaaattcaacttacttgttggtcgtgaattacaaaaatcagcaggcaaaaaaccacaggttgcgattacactcccattactcgttggattagacggcgagaaaaaaatgtctaaatcacttggtaactatattggcgtaacggaagcaccaagcgatatgttcggtaaagtgatgtcaatttctgatgaactcatgtgggattggtataaccttctttcatttcgtccattaagcgaaattgcacaattaaaatcggaagtagaaaagggcaaaaatccacgtgatgtaaaaatcttattagcaaaagaattaattgcacgtttccacaatgaagaggcggcaaacgctgcagaacaagaatttattaaccgtttccaaaaaggcgcaatgcctgatgaaatgcctgaatttacgttttctggcgaaattggtttagccaccttattaaaagaagcaggccttgttccttccacttctgaagcgattcgctctgctcaacaaggcggtgtaaaaatcaatggtgaaaaagtcgataacgtaaaagataatgcaccgaaaggcacaaatgtttaccaagtgggtaaacgaaaatttgcgcgtgtgactgtggaa

SEQ ID NO: 2820 - protein, 395 aa, Haemophilus influenzae
  Name: NTH1568
MTNINTVLAELKRGTDEILSEADLIEKLKENRPLKVKLGADPTAPDIHLGHTVVLNKLRQFQQLGHEVYFLIGDFTGMVGDPSGKNATRPPLSREDVLRNAETYKEQIYKILDPQKTKIVFNSEWLSKLGTEGMIRLASNYTVARMLERDDFKKRFGNNQPIAIHEFIYPLLQGYDSVALDADVELGGTDQKFNLLVGRELQKSAGKKPQVAITLPLLVGLDGEKKMSKSLGNYIGVTEAPSDMFGKVMSISDELMWDWYNLLSFRPLSEIAQLKSEVEKGKNPRDVKILLAKELIARFHNEEAANAAEQEFINRFQKGAMPDEMPEFTFSGEIGLATLLKEAGLVPSTSEAIRSAQQGGVKINGEKVDNVKDNAPKGTNVYQVGKRKFARVTVE

SEQ ID NO: 2821 - DNA, 945 bp, Haemophilus influenzae
  Name: NTH1569
atgcctgacattaaactcttcgcgggtaatgctacacctgaacttgcaaaacgtatttctgaacgtttatatatttcactaggcgatgcaacagtcgctcgtttcagcgatggagaaattcaagttcaaattaatgaaaatgtgcgtggtgcggatgtatttatcatccaatcaacttgtgcgccaaccaatgataacttgatggaattggttgtgatggtagatgcgttacgtcgcgcatctgctggtcgtattactgccgtgattccctatttcggctatgctcgccaagatcgtcgtgttcgttctgctcgtgtgcctattactgctaaagttgtggcagatttactttcaattgttggtattgaccgtgtcttaacctgcgacctacacgcagaacaaatccaaggtttctttgatgttcccgtagacaacgtatttggttcgccagttttaattcacgatattttgaaaaaatctgatcttgaaaatccaattgttgtttccccagatattggcggcgttgtgcgtgctcgcgctgtcgctaaattattaaacgatacggatatggctattattgacaaacgtcgccctcgtgcaaatgtagcacaagtgatgcatattatcggtgatattgcagaccgtgattgtattttggttgatgatatgattgatactggcggtacgctttgtaaagcggcagaagcattaaaagaacgtggtgcaaaacgtgtttttgcttatgcaactcacgccgttttctctggtgcagcagccaaaaatttagccagcgatgccattgatgaagttgtagttactgacacgattcctctatcagaagaaatgaaagcgatcggtaaagttcgcgtgcttacgctttcttccatgctggcagaagccattcgccgcattagcaacgaagaatctatttctgcgatgtttaac

SEQ ID NO: 2822 - protein, 315 aa, Haemophilus influenzae
  Name: NTH1569
MPDIKLFAGNATPELAKRISERLYISLGDATVARFSDGEIQVQINENVRGADVFIIQSTCAPTNDNLMELVVMVDALRRASAGRITAVIPYFGYARQDRRVRSARVPITAKVVADLLSIVGIDRVLTCDLHAEQIQGFFDVPVDNVFGSPVLIHDILKKSDLENPIVVSPDIGGVVRARAVAKLLNDTDMAIIDKRRPRANVAQVMHIIGDIADRDCILVDDMIDTGGTLCKAAEALKERGAKRVFAYATHAVFSGAAAKNLASDAIDEVVVTDTIPLSEEMKAIGKVRVLTLSSMLAEAIRRISNEESISAMFN

SEQ ID NO: 2823 - DNA, 513 bp, Haemophilus influenzae
  Name: NTH1570
atgggaggcggtgttggtggcggttcatccaatgcagcaaccgcattagtctctttaaattatttatggcaagccaatttatccattgatgaactggcaaaattgggattaacattaggcgcggatgtgccaatatttgtatacggacaggctgcttttgctgaaggcgttggggaaaaaatcacttattgtgaacctgccgagaaatggtttgttatattaaaacccgatgattcaatatcgacggctgtcatctttcaagatccaaatttaccacgtaatacaccgaaaaaatccctcgaacaacttttgagtgaaccttataaaaacgattgcgaaaaagttgtgataaatcattattcaaacgttgaaaaagcgttaaactggttgctacaatatgcgccggcaagattaacaggaacgggagcctgtgtttttgctgaatttgatcatgaagcagaagcgcaagcggtatttagacaaaaaccagaagcatttttttggtttcgtcgc

SEQ ID NO: 2824 - protein, 171 aa, Haemophilus influenzae
  Name: NTH1570
MGGGVGGGSSNAATALVSLNYLWQANLSIDELAKLGLTLGADVPIFVYGQAAFAEGVGEKITYCEPAEKWFVILKPDDSISTAVIFQDPNLPRNTPKKSLEQLLSEPYKNDCEKVVINHYSNVEKALNWLLQYAPARLTGTGACVFAEFDHEAEAQAVFRQKPEAFFWFRR

SEQ ID NO: 2825 - DNA, 207 bp, Haemophilus influenzae
  Name: NTH1571
ttggaagaattttatctaaatgaatatttgcacccaattgaatattggctttttcttgtaaaagttttgcagctcgataaattagattattttccgtttttagatttggaatttctggcgttaaaacaatttgattatctttgttcccgaatactaatgtctaaccaatcgccaaaatctaaaaattggaaaagcgtttgtaattca

SEQ ID NO: 2826 - protein, 69 aa, Haemophilus influenzae
  Name: NTH1571
LEEFYLNEYLHPIEYWLFLVKVLQLDKLDYFPFLDLEFLALKQFDYLCSRILMSNQSPKSKNWKSVCNS

SEQ ID NO: 2827 - DNA, 204 bp, Haemophilus influenzae
  Name: NTH1572
atggaatcccctcaattttctcccgctctttgcccaaaatcaaccacaatcaaatggcagccattacgcttccctagccctgccaaactgaatttttttctttatatcaatggaaaattgccgaacggctatcatgaattacaaacgcttttccaatttttagattttggcgattggttagacattagtattcgggaacaaaga

SEQ ID NO: 2828 - protein, 68 aa, Haemophilus influenzae
  Name: NTH1572
MESPQFSPALCPKSTTIKWQPLRFPSPAKLNFFLYINGKLPNGYHELQTLFQFLDFGDWLDISIREQR

SEQ ID NO: 2829 - DNA, 120 bp, Haemophilus influenzae
  Name: NTH1573
ttgcaaaatatttactctgaaaaacaaccaaggcctatattcaaagaatttatgaaccctaaattatatttattactgataatttttatccttttatctaatttagatatttcttctaaa

SEQ ID NO: 2830 - protein, 40 aa, Haemophilus influenzae
  Name: NTH1573
LQNIYSEKQPRPIFKEFMNPKLYLLLIIFILLSNLDISSK

SEQ ID NO: 2831 - DNA, 123 bp, Haemophilus influenzae
  Name: NTH1574
atgaatttctacagaggttatgatattcttaagctatttttaaaggaatatgaatggcgttttaatcacagtgatttaaaaaactcaaatttctattgtaaaacaattaatttaggagagttt

SEQ ID NO: 2832 - protein, 41 aa, Haemophilus influenzae
  Name: NTH1574
MNFYRGYDILKLFLKEYEWRFNHSDLKNSNFYCKTINLGEF

SEQ ID NO: 2833 - DNA, 216 bp, Haemophilus influenzae
  Name: NTH1575
atgagagaaagtcgcttaagtcaatataagcaaaataaacttattgagatatttctggcaagtgtgacagctctagctgcagctaagttggtaaatataaataaacttcagcttattactttcatcgtctaccattatttatcactcaaagcagcctacatttggaaatgtttgaaggtgaaattcaagcgaatgaaagctattttggtggtgctc

SEQ ID NO: 2834 - protein, 72 aa, Haemophilus influenzae
  Name: NTH1575
MRESRLSQYKQNKLIEIFLASVTALAAAKLVNINKLQLITFIVYHYLSLKAAYIWKCLKVKFKRMKAILVVL

SEQ ID NO: 2835 - DNA, 1689 bp, Haemophilus influenzae
  Name: NTH1576
gtgcggttaaaatttcaattatttttaatgaaaggaaataccatgaaaaatattaacccaactcacacccaagcgtggaaatctctcgaagcacataaagctgaattatcaaacaccaccatccaagatttatttaaacaagaaaaaaatcgttttgacgattattctttaacattcaataaccaaattcttgtcgatttttccaaaaacaacatcaatcaaacaaccctttcacatcttcgccaacttgctcaagaatgcgcacttgatagtgcaaaagaagcgatgtttactggcgaaaaaatcaatcgtacagaaaatcgtgccgtgctgcatactgcacttcgcaatcgcactaatacgccagtacttgttgatggtaaagatgttatgcctgaagtcaatgctgtgttagctaaaatgaaagatttctgtcagcgtattatttctggcgaatggaaaggctatacaggcaaagccattacggatgtagtgaatattggtattggtggctctgacttaggcccttatatggtaaccgaagcacttcgcccgtataaaaatcatctaaatatgcactttgtttcaaatgtcgatggtacacatattgcggaaaccttaaaaaaagtcaatccagaaacgactcttttcttagtagcatcgaaaacttttacaactcaagaaaccatgacaaatgcacaaagtgcgcgtgattggttactaaaagcagcgaaagatgaaagtgcggttgcaaaacattttgcagcattatcaaccaatgctaaagatgtagaaaaatttggtattgataccaataacatgtttgaattttgggattgggttggcggtcgttactctttatggtcagctattggtctttcaattgcactatcaattggctttgaaaactttgaagcgttattaaatggcgcgcatgaaatggataaacatttccgcactactccaattgaaaaaaatattccaactactttagccttagttggtttatggaataccaatttccttggtgcccaaacagaagcaatcttaccttatgatcaatatttacatcgctttgcggcttatttccaacaaggtaatatggaatcaaatggtaaatatgtggatcgtgatggcaatgtcattaacaattaccaaacgggcccgattatttggggagaaccaggtacaaatggacaacacgcgttctatcaattaattcatcaaggcactactttaattccttgtgattttatcgcacctgctcaaagccataacccattggcagatcatcacaataaattgctttccaacttctttgcacaaacagaagcattagcattcggaaaaacaaaagaggaagtcgaggctgaatttgtaaaagcggggaaatctttggatgatgtgaaaaatattgttccatttaaagtatttacgggtaataagccaactaattccattctcgttcaaaaaatcacgccatttaccttgggtgcattaattgcgatgtatgaacataaaatcttcgtacaaggtgtgatttttaatatctttagcttcgatcaatggggtgtcgaactaggcaaacaacttgcaaatagaattcttcctgaattaaccgattctgaaaaagtcgcaagccacgatagttcaacaaatggattaatcaatcaatttaaagcatggcgt

SEQ ID NO: 2836 - protein, 563 aa, Haemophilus influenzae
  Name: NTH1576
VRLKFQLFLMKGNTMKNINPTHTQAWKSLEAHKAELSNTTIQDLFKQEKNRFDDYSLTFNNQILVDFSKNNINQTTLSHLRQLAQECALDSAKEAMFTGEKINRTENRAVLHTALRNRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNNMFEFWDWVGGRYSLWSAIGLSIALSIGFENFEALLNGAHEMDKHFRTTPIEKNIPTTLALVGLWNTNFLGAQTEAILPYDQYLHRFAAYFQQGNMESNGKYVDRDGNVINNYQTGPIIWGEPGTNGQHAFYQLIHQGTTLIPCDFIAPAQSHNPLADHHNKLLSNFFAQTEALAFGKTKEEVEAEFVKAGKSLDDVKNIVPFKVFTGNKPTNSILVQKITPFTLGALIAMYEHKIFVQGVIFNIFSFDQWGVELGKQLANRILPELTDSEKVASHDSSTNGLINQFKAWR

SEQ ID NO: 2837 - DNA, 1080 bp, Haemophilus influenzae
  Name: NTH1577
atgaacgtaaaaccggcgacagcgaaaatcagttcgcacgccttaaaacaaaatttagaaataattaaacaaaaagcaccaaatagcaaaattattgctgtggttaaagcaaacgcttatggtcacggcgttgtgtttgttgcatcaactttagaacaaaatgtcgattgctttggcgtggctcgtttagaagaggctttagcattacgctccaacggcatcactaaaccgattttattacttgaaggcttttttaatgaacaagatttgcctattctagccgttaataatattgaaaccgtggtacacaatcacgaacagcttgaggctttaaaacgttcaaatttaccaagtccaattaaggtttggttaaaaatagatacgggaatgcaccgtttaggcgttgctcttgatgaagtggattatttttatcaagaactgaaaaaactccctcaaattcaaccgcacttaggctttgtcagccatttcagccgagccgatgaactagaatcagattacacccaacttcaaatcaatcgttttttatccgccacaaaagataaacaaggtgaacgcactatcgcagcttctggcggcattcttttctggccaaaatctcacttagaatgtattcgcccaggcattattatgtacggcatttctccaactgatactattggcaaagagtttggcttaacgccagtgatgaatttaacctcgtcattaattgccgttcgccatcataaacaaggcgatcctgtaggttacggcggtatttggacaagtccacgagataccaaaattggcgtggtcgcaatgggttatggcgatggttatccgcgcgatgtgccagaaggtacgcctgtttatttaaatggccgtctcgtaccaattgttggacgtgtgtcaatggatatgctcactgttgatttaggcgcagatagccaagatttggtaggcgatgaagtaattttatggggcaaggaattacctattgaaaccgtagctaaattcacaggcattttaagctacgagctaattacaaaattaacacctcgtgttataactgaatacgttgat

SEQ ID NO: 2838 - protein, 360 aa, Haemophilus influenzae
  Name: NTH1577
MNVKPATAKISSHALKQNLEIIKQKAPNSKIIAVVKANAYGHGVVFVASTLEQNVDCFGVARLEEALALRSNGITKPILLLEGFFNEQDLPILAVNNIETVVHNHEQLEALKRSNLPSPIKVWLKIDTGMHRLGVALDEVDYFYQELKKLPQIQPHLGFVSHFSRADELESDYTQLQINRFLSATKDKQGERTIAASGGILFWPKSHLECIRPGIIMYGISPTDTIGKEFGLTPVMNLTSSLIAVRHHKQGDPVGYGGIWTSPRDTKIGVVAMGYGDGYPRDVPEGTPVYLNGRLVPIVGRVSMDMLTVDLGADSQDLVGDEVILWGKELPIETVAKFTGILSYELITKLTPRVITEYVD

SEQ ID NO: 2839 - DNA, 378 bp, Haemophilus influenzae
  Name: NTH1578
atgcgcgcacccgcattttcagataaccgaacactagaaatcgcagaaatttctcgttccctcaaagcactcgccaaagaattacaagtgccagtagttgccctttctcagttaaatcgtactttagaacaacgtgcagacaaacgccctgtaaattcagatttacgtgaatcaggctctattgaacaagatgcagacttgattatgtttatttaccgagacgaagtctataacgataactcggaagataaaggcgttgcagaaattattatcggtaaacagcgtaacggcccaattggtcgagtgcggttaaaatttaatggacaattctcacgctttgacaatcttgccgaacaacgtgaatatcgagatgattat

SEQ ID NO: 2840 - protein, 126 aa, Haemophilus influenzae
  Name: NTH1578
MRAPAFSDNRTLEIAEISRSLKALAKELQVPVVALSQLNRTLEQRADKRPVNSDLRESGSIEQDADLIMFIYRDEVYNDNSEDKGVAEIIIGKQRNGPIGRVRLKFNGQFSRFDNLAEQREYRDDY

SEQ ID NO: 2841 - DNA, 909 bp, Haemophilus influenzae
  Name: NTH1579
atggcatcacaacctcaaatcaaatcttcagacaaaaaaacagcacaagttagcattcctccgcactcaattgaggctgaacaagccgtgttgggtggcatcatgctgagcaatcaacattgggatggcattgctgaacgtgtgattgctgacgatttttatacttttcagcatcgtctaatttttacagaaatggaacatctaatgcgtaatcaatcgcctattgatttaattacgctagatcaagccttaagaagccacggtgtcagcgatgaagtaggtggatttgcctatctagcagagctttctaataatactccgaacgcgattaatattttggcttatgcagatattgtgcgtgagaaagccatattacgagaacttatttcggtaggaaatcgcattgctgaaaatagctattctcctaaagggcaagacattaagttaattcttgatgaggctgagcgtgaagtatttgcgattgcagaaaaacgaacaacttctagcgaaggcccacaaaatgtgatcaatgtgctagaaagtaccattgaaaaaatcgatattttaagcaaacttgaaaatcattcaggtgtaacaggtgttacgacgggctttaccgatcttgataaaaaaacggctggtttacaaccttcagacttaattatcgttgcggcacgtccgtcaatgggtaaaaccactttcgccatgaacctttgcgaaaatgccgcaatggcaagtgaaaaacccgttttagtatttagtttagaaatgccagcagaacaaattatgatgcgtatgatcgcatcgcttgctcgcgttgatcaaactaaaatccgaacaggtcaaaatttagatgaaatcgagtggaataaaattgctagcgtagtggggaatgttcaagcaaaagga

SEQ ID NO: 2842 - protein, 303 aa, Haemophilus influenzae
  Name: NTH1579
MASQPQIKSSDKKTAQVSIPPHSIEAEQAVLGGIMLSNQHWDGIAERVIADDFYTFQHRLIFTEMEHLMRNQSPIDLITLDQALRSHGVSDEVGGFAYLAELSNNTPNAINILAYADIVREKAILRELISVGNRIAENSYSPKGQDIKLILDEAEREVFAIAEKRTTSSEGPQNVINVLESTIEKIDILSKLENHSGVTGVTTGFTDLDKKTAGLQPSDLIIVAARPSMGKTTFAMNLCENAAMASEKPVLVFSLEMPAEQIMMRMIASLARVDQTKIRTGQNLDEIEWNKIASVVGNVQAKG

SEQ ID NO: 2843 - DNA, 102 bp, Haemophilus influenzae
  Name: NTH1580
atgtattttgagccaattaacacattgggggagcgtttagctaaatcagttaaatctcttacaaattgttttgaagagcttacttttaatggcttatattac

SEQ ID NO: 2844 - protein, 34 aa, Haemophilus influenzae
  Name: NTH1580
MYFEPINTLGERLAKSVKSLTNCFEELTFNGLYY

SEQ ID NO: 2845 - DNA, 222 bp, Haemophilus influenzae
  Name: NTH1581
gtgttaattggctcaaaatacattactgcaatatactgtttattaaatcgtttacctttacccgaaaactaccaagatcacgcattagtaggagagtggaaaggttatcgagattgccatattcaaggcaatttggtactgatttaccaatacgttatacacgatgaatttgatgaattgaaattttctcgtttaaatacacactcacaaaccgctttaaaa

SEQ ID NO: 2846 - protein, 74 aa, Haemophilus influenzae
  Name: NTH1581
VLIGSKYITAIYCLLNRLPLPENYQDHALVGEWKGYRDCHIQGNLVLIYQYVIHDEFDELKFSRLNTHSQTALK

SEQ ID NO: 2847 - DNA, 2973 bp, Haemophilus influenzae
  Name: NTH1582
gtgaaagagaaaaaggtaggtgaaacccaaatttctgccaaaaaattagcgaaacagcaggcgtctgattctcgtgatctcgttcgctatgaaacaggtattacggtggttgaaacaggtagaacgggcgcaagtggttatgctgttcgaggggttgatgaaaaccgtgtaggtattatggttgatgggcttcgtcaagctgaaaccttaagctctcaaggatttaaagaattatttgaaggctatggcaattttaataatactcgtaatagcattgaaattgaaaatgttaaaacagcaactattaccaaaggtgctgactccttaaaatccggtagtggtgcattgggtggctctgttatatttgaaactaaagatgctcgagattatctgatagataaagattattatctttcctataaacgtggctatcaaacaatgaataatcaaaaccttaagacacttacattagcaggacgttctaaaaaatttgatattttagtcgttgatacaaaacgtgatgggcacgaaatagaaaactacgattataaaatttatcccaataaacaggcggatttaagtgcggttggtcctacccgtgaaaaagccgatccttatcaaattacccgccaaagcacattaataaaattgggctttcagcctaatgaaaaccatcgcttgagcgtggcattagatgattccactttagaaacaaagggtatggatttgtcttatattttcaatcaatgcaaaaatactaaatgtgaggaaaaatatggcgagcgagttattaatgatcaatctaaaagaaaaaatattcaatttagttatgaaaatttcagtcaaacccctttttgggatcatattaaactaagttattcctcacaaaaaattaccaataaagcacgctctgatgagtattgtcatcaatccacttgtgctggtgtacgtaatccacaagggctacatttagtagaagaaggtggaatttataagattaaagataaagacaatcaagaatttacaggaaaatataattatggcttagaactacaaaacaaaaagggtgaagatgttagtaatgatgtagatacagaaggaggctcacttgattcggtcttaattaattgtgaaaaattaaattgtaataaaaaatttcaggtttttgttggaaaagatgaaaatgggaatgacaaatataattatgaagaccgaaatattaccattaaagaattaaatggcaaaaaatatggtgaaatctcactaaaatcagcagaaggtaattatggattaacccaatatgaaagtgctaaatttttatttccaaaaagccatggctacagcacagacttcgttaatgaccgtgatttaaacacccatacccaacaaattaaacttgatttagacaaagaatttcacctatggcatacccaacaccaactaaaatatggtggactttatgaaaaaacactaaaaagtatggtgaatcatcaatactacactgttgccaatgtgcaatggtgggctggcaattttttctgtaacaaacctgtagatggcacatatcctgtggagcatactcctgcacctgatcatagtgcttacagatgtagcttaatgaattccaataaaggtaaagatacctatttaatccctgttaccactaaaaataatgtgttgtattttggagataatgtgcaacttacctcttggctaggactagatttaaattatcgttatgaccacgtaaaatatttgcctagttatgacaaaaacattcctgttcctaatggattaattactgggctatttaagaaatttagctcaaaggaatatgtttatggtagtaaatactcaatacctccaggatatgaaaattgcacttacgacacaccgtgttataaaaaaaattttgaagacaatcttgccctgttattacgcaaaactgactataaacatcattcttacaatttagggttaaatcttgatcccacaaattggcttcgtgtacagcttaaatacgccaatggttttcgtgcgccaacctctgatgaaatttatatgacatttaaacatccacaattttccattcagcctaacacagatttaaaagctgaaacctccaaaacaaaagaagtcgcgttcactttttataaaaacagtagttatattacgttaaatgcgtttcaaaacgattaccgtaattttattgacttagtagaagtgggcgaacgtcctattgaagaaggctctgcaataaaatatccgttccatcaaaaccaaaatcgagatcgagcaagagtcagaggtatcgaaattgcttcacgtcttgagatgggcgatttatttgaaaaactacaaggtttccatttaggctataaatttacctatcaaaaaggcagaatcaaagacaatggattacatccaaaatataaagaatttttggaattgaataaagatgaacatccagaatacgaagccattgctcgtaaacctcaaccaatgaatgccttacaaccaaccacatcggtatacaatattggctatgatgcaccaagccaaaaatggggcgtggatatgtatatcactaatgttgcagcaaaaaaagcaaaagatagctttaattctcaatggacaagtatggtcgccagaaaagaaaagcaatatactgacaatgcaacagatatacctgctacaaaagcaaacggcaaagatgtaaaagattctcgcggattatggcgtaataatcgctatacagtgatcgatacgattgcctattggaaaccaattaaaaatcttacatttaccgctggtgtatataatttaaccaacaaaaaatatctcacttgggactctgctcgctctgttcgacatcttggcacaattaaccgagtaaaaacagaaactggtgaaggcttaaaccgcttttatgcacctggcagaaattacagaatgtctgttcagtttgaattt

SEQ ID NO: 2848 - protein, 991 aa, Haemophilus influenzae
  Name: NTH1582
VKEKKVGETQISAKKLAKQQASDSRDLVRYETGITVVETGRTGASGYAVRGVDENRVGIMVDGLRQAETLSSQGFKELFEGYGNFNNTRNSIEIENVKTATITKGADSLKSGSGALGGSVIFETKDARDYLIDKDYYLSYKRGYQTMNNQNLKTLTLAGRSKKFDILVVDTKRDGHEIENYDYKIYPNKQADLSAVGPTREKADPYQITRQSTLIKLGFQPNENHRLSVALDDSTLETKGMDLSYIFNQCKNTKCEEKYGERVINDQSKRKNIQFSYENFSQTPFWDHIKLSYSSQKITNKARSDEYCHQSTCAGVRNPQGLHLVEEGGIYKIKDKDNQEFTGKYNYGLELQNKKGEDVSNDVDTEGGSLDSVLINCEKLNCNKKFQVFVGKDENGNDKYNYEDRNITIKELNGKKYGEISLKSAEGNYGLTQYESAKFLFPKSHGYSTDFVNDRDLNTHTQQIKLDLDKEFHLWHTQHQLKYGGLYEKTLKSMVNHQYYTVANVQWWAGNFFCNKPVDGTYPVEHTPAPDHSAYRCSLMNSNKGKDTYLIPVTTKNNVLYFGDNVQLTSWLGLDLNYRYDHVKYLPSYDKNIPVPNGLITGLFKKFSSKEYVYGSKYSIPPGYENCTYDTPCYKKNFEDNLALLLRKTDYKHHSYNLGLNLDPTNWLRVQLKYANGFRAPTSDEIYMTFKHPQFSIQPNTDLKAETSKTKEVAFTFYKNSSYITLNAFQNDYRNFIDLVEVGERPIEEGSAIKYPFHQNQNRDRARVRGIEIASRLEMGDLFEKLQGFHLGYKFTYQKGRIKDNGLHPKYKEFLELNKDEHPEYEAIARKPQPMNALQPTTSVYNIGYDAPSQKWGVDMYITNVAAKKAKDSFNSQWTSMVARKEKQYTDNATDIPATKANGKDVKDSRGLWRNNRYTVIDTIAYWKPIKNLTFTAGVYNLTNKKYLTWDSARSVRHLGTINRVKTETGEGLNRFYAPGRNYRMSVQFEF

SEQ ID NO: 2849 - DNA, 711 bp, Haemophilus influenzae
  n 706, 707, 708, 709, 710: n is any nucleotide
  Name: NTH1583
ttgatgaaaccaggtgttggagaactttctctttctgcggttaatcaaattttttcgcgtgatccattggtaattgcaactgtgattgatgatgataaacaaggttttactggtgtatctaaccctaaagatttggaaaatttactgacattgttccgcttaaaattacgttcttcgcctatatccgatcttgccttagaaaaatatcgacgtgaaacccgtgattatttcaaacagattgatttagaaacacaatttatgcaagccgtttcaaaactgcgttttccaaatattgaaactgtctatactcaaaaacaagcacagcaattagcatttgataaaaaccaattaagtaacgcttatcaacgttatattttaaataaaacagattttacctattttattattggcgatattgagcttaatcaagtaaagaaattggcagaacgttatttagcttctgttgaatcaaaaactcagatacgtcactttgtccctactattattcatacaccaactcaatcatttattatgaatggtttgaaagaaccgagagctgatgtagaaatataccttaccgcagataatacttggcgagcggaacaaaaatacttattcaatattcttgctgatattgtgcaagaaaaattacgcttaattctacgtgaaaaagtttcaggtgtttattctgtaaatagttggtttnnnnnt

SEQ ID NO: 2850 - protein, 237 aa, Haemophilus influenzae
  Xaa 236, 237: Xaa is any amino acid
  Name: NTH1583
LMKPGVGELSLSAVNQIFSRDPLVIATVIDDDKQGFTGVSNPKDLENLLTLFRLKLRSSPISDLALEKYRRETRDYFKQIDLETQFMQAVSKLRFPNIETVYTQKQAQQLAFDKNQLSNAYQRYILNKTDFTYFIIGDIELNQVKKLAERYLASVESKTQIRHFVPTIIHTPTQSFIMNGLKEPRADVEIYLTADNTWRAEQKYLFNILADIVQEKLRLILREKVSGVYSVNSWFXX

SEQ ID NO: 2851 - DNA, 828 bp, Haemophilus influenzae
  Name: NTH1584
atgggcgaaaaaaccgtattacgtttaattccatctggtatgttacatccaaacgtaacttgcttaattggtaatggcgttgtggtttcgcctgaagcattaatgaaagaaatgggcgaacttgaaagccgaggtattaaagttcgtgaacgtttattaatttcagaagcttgtcctttgattctgccttatcacgttgcaatggatcacgcacgcgaagcagcccttggcaaaaaagctataggtacaactggtcgtggtattggcccagcttatgaagataaagtagctcgtcgtggtttacgcgtaggcgatttatttaataaagaagcctttgccgaaaaactcaaaaacatccttgaatactataatttccaattggtgaactactacaaagttgaacctgtcgattatcaaaaaaccttagatgatgtaatggcaattgccgatgtaatcacaggtatggtggcagatatcactacaattcttgatactgcgcgcaaaaatggcgaacatattttatttgaaggcgcacaagggacaatgttagatatcgaccacggtacttatccgtatgtaaccagctcaaacacaacggctggtggtgttgcaacaggctctggttttggcccgcgtaatcttgattatgtacttggtatcattaaggcttactgtactcgtgtaggtggtggcccattcacaactgaattatttgatgatgtaggtgctgaaattgcacgtaaaggtaacgaatttggtgcggtaacaggccgtccacgtcgttgcgggttggttcgatgccgtcgccattcgtcgtgcaatccaact

SEQ ID NO: 2852 - protein, 276 aa, Haemophilus influenzae
  Name: NTH1584
MGEKTVLRLIPSGMLHPNVTCLIGNGVVVSPEALMKEMGELESRGIKVRERLLISEACPLILPYHVAMDHAREAALGKKAIGTTGRGIGPAYEDKVARRGLRVGDLFNKEAFAEKLKNILEYYNFQLVNYYKVEPVDYQKTLDDVMAIADVITGMVADITTILDTARKNGEHILFEGAQGTMLDIDHGTYPYVTSSNTTAGGVATGSGFGPRNLDYVLGIIKAYCTRVGGGPFTTELFDDVGAEIARKGNEFGAVTGRPRRCGLVRCRRHSSCNPT

SEQ ID NO: 2853 - DNA, 123 bp, Haemophilus influenzae
  Name: NTH1585
ttgccacaaaactgcattaactatattaaacgtattgaagaagtaactggcgtacctattgatattctttcaactggccctgatcgtgtagaaacaatgattttacgtgatccgttcgctgct

SEQ ID NO: 2854 - protein, 41 aa, Haemophilus influenzae
  Name: NTH1585
LPQNCINYIKRIEEVTGVPIDILSTGPDRVETMILRDPFAA

SEQ ID NO: 2855 - DNA, 891 bp, Haemophilus influenzae
  Name: NTH1586
ttgcttgcccgtttaaaatatggtaaaactaatgccgttttattcacaacatatataggaagttctatgtcaaatttacaagcaattattgaagctgcatttgaaaaacgtgcagaaattacaccaaaaaccgttgatgcagaaacgcatgcggcaattgaagaagtgatcgaaggattagattctggaaaatatcgtgtagccgaaaaaattgctggcgaatgggtaacacatcaatggttaaaaaaagcggtattgctatctttccgcattaacgataaccaaatcattgacggcgcagaaacaaaatattacgacaaagtggcattaaaatttgcggattacactgaagaacgttttactgaagaaggtttccgtgttgtgccttctgcaacggtgcgtaaaggcgcatatatttctaaaaactgcgtattaatgccatcttatgtaaacattggtgcttacgttggcgaaggcaccatggtagatacttgggcgacggtaggttcatgcgcacaaattggtaaaaacgtgcatttatcgggtggtgtaggcatcggcggcgtgttagaaccattacaagctaacccaaccattatcggcgataactgttttattggcgcgcgttcagaagtggttgagggtgttatcgttgaagatggttgtgttatttcaatgggcgtattcattggtcaatcaaccaaaatttatgatcgtgaaacaggcgaaattcattacggccgtgtaccagcaggttctgtggtggtatcaggtagccttccatcaaaatgtggaaaatatagcctatattgtgccgtgatcgtgaaaaaagtggatgcaaaaactttaggaaaagtgggcatcaatgaattattacgttctattgaagaa

SEQ ID NO: 2856 - protein, 297 aa, Haemophilus influenzae
  Name: NTH1586
LLARLKYGKTNAVLFTTYIGSSMSNLQAIIEAAFEKRAEITPKTVDAETHAAIEEVIEGLDSGKYRVAEKIAGEWVTHQWLKKAVLLSFRINDNQIIDGAETKYYDKVALKFADYTEERFTEEGFRVVPSATVRKGAYISKNCVLMPSYVNIGAYVGEGTMVDTWATVGSCAQIGKNVHLSGGVGIGGVLEPLQANPTIIGDNCFIGARSEVVEGVIVEDGCVISMGVFIGQSTKIYDRETGEIHYGRVPAGSVVVSGSLPSKCGKYSLYCAVIVKKVDAKTLGKVGINELLRSIEE

SEQ ID NO: 2857 - DNA, 120 bp, Haemophilus influenzae
  Name: NTH1587
ttgctagaatgtctgcgttattttttttatgaggagaacaaaatgagcgattttggttatgcaatgattatggttgtttttagtatgtctgttgtcgtggggcttgcactttcaatcttt

SEQ ID NO: 2858 - protein, 40 aa, Haemophilus influenzae
  Name: NTH1587
LLECLRYFFYEENKMSDFGYAMIMVVFSMSVVVGLALSIF

SEQ ID NO: 2859 - DNA, 1008 bp, Haemophilus influenzae
  Name: NTH1588
atggcaacaattaaagatgtggcaaaaatggctggtgtgtccaccacaaccgtatctcacgtaattaataaaacccgtttcgttgcaaaagatacggaagaagcggtgttatccgcaattaaacaacttaattattcccctagtgctgtggcacgcagtttaaaagtcaataccaccaaatccattggtatgattgtgacaaccagtgaagcaccgtattttgccgaaataatccattctgttgaagaacattgctatcgacaaggttattctttatttttgtgtaacacacaaaatgatcctgaaaaagtcaaaaatcatttagaaatgttggcaaaaaaaagggtcgatggtttgcttgtaatgtgttctgaatatactcaggattcattggatttactttcatcattttccactattccaatggttgtaatggattggggcccaaatgcgaataccgatgtgattgatgatcatagttttgatggcggttatttagcaaccaaacatcttatagagtgcggtcataaaaaaatcgggattatctgcggcgaactcaataaaactaccgcaagaacgcgttatgaaggctttgaaaaagcaatggaagaagctaaattaacaatcaatccgtcttgggtactagagggtgcatttgagcctgaagatggctatgaatgtatgaatcgtttactgactcaagaggaattaccaaccgccctattctgctgtaacgatgtgatggcactcggtgcaatatcagcactaacagaaaaaggcttgcgtgtgccagaggatatgtcaattatcggctatgatgatattcacgcctcacgtttctacgcaccaccattaaccaccattcatcaatcaaaactacgtttaggcagacaggcagtaaatattctattagaacgaattactcacaaagatgaaggtgttcaacaatatagtcgtatcgatataacccctgagcttatcattcgaaaatccgttaaatcgatttta

SEQ ID NO: 2860 - protein, 336 aa, Haemophilus influenzae
  Name: NTH1588
MATIKDVAKMAGVSTTTVSHVINKTRFVAKDTEEAVLSAIKQLNYSPSAVARSLKVNTTKSIGMIVTTSEAPYFAEIIHSVEEHCYRQGYSLFLCNTQNDPEKVKNHLEMLAKKRVDGLLVMCSEYTQDSLDLLSSFSTIPMVVMDWGPNANTDVIDDHSFDGGYLATKHLIECGHKKIGIICGELNKTTARTRYEGFEKAMEEAKLTINPSWVLEGAFEPEDGYECMNRLLTQEELPTALFCCNDVMALGAISALTEKGLRVPEDMSIIGYDDIHASRFYAPPLTTIHQSKLRLGRQAVNILLERITHKDEGVQQYSRIDITPELIIRKSVKSIL

SEQ ID NO: 2861 - DNA, 234 bp, Haemophilus influenzae
  Name: NTH1589
atgacacaagagtacagtactctgcgcaataacattagtatgttagggcgttttctcggagaaaccatcaatgatgcacagggcgaggatattctcgagttaatcgaaaacattcgtaaactttctcgtaattctcgtgctggcgatgataaagcaagacaagcattgctcgatacgctcggtagtatttctaatgaaaatattattcccgtcgcacgtgcttcagtcaatttt

SEQ ID NO: 2862 - protein, 78 aa, Haemophilus influenzae
  Name: NTH1589
MTQEYSTLRNNISMLGRFLGETINDAQGEDILELIENIRKLSRNSRAGDDKARQALLDTLGSISNENIIPVARASVNF

SEQ ID NO: 2863 - DNA, 135 bp, Haemophilus influenzae
  n 130, 131, 132, 133, 134: n is any nucleotide
  Name: NTH1590
atgtcagaatcttttgctcaactttttgaagaatcattaaaaggccttgaaactcgtcaaggttcaatcgttagcggtactgtagtagctatccaaaaaggctttgtgcttgttgatgcaggtttaagannnnnt

SEQ ID NO: 2864 - protein, 45 aa, Haemophilus influenzae
  Xaa 44, 45: Xaa is any amino acid
  Name: NTH1590
MSESFAQLFEESLKGLETRQGSIVSGTVVAIQKGFVLVDAGLRXX

SEQ ID NO: 2865 - DNA, 732 bp, Haemophilus influenzae
  Name: NTH1591
atggtaatgaggggaaattgtctctataatgcgcaaaattttgataatgaaaggataatttgtatgggaatgattattactgttgatgggcctagtggtgctgggaaagggacgctttgttacgcgttggctgaaaagttgggctatgcactgttggatagtggggcgatttatcgcgttactgcattggcagcgttgcaacgtaaaactgatctaacaaatgaaacagatttagcagaattagcacgtcatttagatattcaatttattcctcaaaatggcgaggtaaacattttgcttgcaggaatggatgtgagccgtttaattcgcacgcaagaagtggcagatgctgcgtcaaaagtagcagtttttcaaaaagtgcggtcagctttattacaacttcagcaagattttgcgaaaaatgatggattaattgcggatggtagagatatgggaacagttgtattcccaaatgcacaagtaaaattatttttagatgcaagtgctgaagaacgtgcaaaaagacgctataaacagttgcaaaataaaggaataaatggtaactttgcacagattttagccgagataaaagagcgtgatcttcgtgatagaaatcgtgaagttgcgccgctaaaaccagcggatgatgctttattattggatagcacagccttgagtatcaatgaagtgatcgatcaggcgttgtcttatattcaagaaaaggtatcagtt

SEQ ID NO: 2866 - protein, 244 aa, Haemophilus influenzae
  Name: NTH1591
MVMRGNCLYNAQNFDNERIICMGMIITVDGPSGAGKGTLCYALAEKLGYALLDSGAIYRVTALAALQRKTDLTNETDLAELARHLDIQFIPQNGEVNILLAGMDVSRLIRTQEVADAASKVAVFQKVRSALLQLQQDFAKNDGLIADGRDMGTVVFPNAQVKLFLDASAEERAKRRYKQLQNKGINGNFAQILAEIKERDLRDRNREVAPLKPADDALLLDSTALSINEVIDQALSYIQEKVSV

SEQ ID NO: 2867 - DNA, 873 bp, Haemophilus influenzae
  Name: NTH1593
atggctgaaaatcgttatgaactaaataaaaacttagcacagatgctcaaaggtggtgttatcatggatgttcaaaaccctgaacaagctcgcatgccagaagctgctggtgcagctgcagtgatggctttggaacgaattcctgcagatattcgtgctgttggaggtgtctctcgaatgagcgatcctaagatgatcaaggaaatccaaggagcagttagcattccagttatggcaaaagttagaattggacatttcgttgaggctcagattttggaagctattgaaattgactatatcgatgagagtgaagtgctttctccagctgacaaccgtttccatgtggacaagaaagaattccaagtaccttttgtatgtggtgccaaggatttgggcgaggccttgcgtcgtatcgctgaaggggcttcaatgattcgtacaaaaggagaaccaggaacaggagatatcgtccaagctgttcgccatatgcgcatgatgagtcaagaaattcgtcgcattcaaaatttacgtgaggacgagctctatgttgcggccaaagatttacaagttcctgtagaattggttcaatacgtccataagcatgggaaattaccagttgtcaacttcgcagctggaggaattgcaactccagcagatgcggccttgatgatgcaacttggcgcagagggtgtctttgttggttcaggtatttttaagtcaggagatcctataaaacgtgctagcgctattgtcaaagctgtaactaactatcgaaatccacaaatcctagcacaaatctccgaagatttaggtgaagccatggttggtatcaatgaaaatgaaatccaaattctcatggctgagcgaggaaaa

SEQ ID NO: 2868 - protein, 291 aa, Haemophilus influenzae
  Name: NTH1593
MAENRYELNKNLAQMLKGGVIMDVQNPEQARMPEAAGAAAVMALERIPADIRAVGGVSRMSDPKMIKEIQGAVSIPVMAKVRIGHFVEAQILEAIEIDYIDESEVLSPADNRFHVDKKEFQVPFVCGAKDLGEALRRIAEGASMIRTKGEPGTGDIVQAVRHMRMMSQEIRRIQNLREDELYVAAKDLQVPVELVQYVHKHGKLPVVNFAAGGIATPADAALMMQLGAEGVFVGSGIFKSGDPIKRASAIVKAVTNYRNPQILAQISEDLGEAMVGINENEIQILMAERGK

SEQ ID NO: 2869 - DNA, 576 bp, Haemophilus influenzae
  Name: NTH1594
atgaaaatcggaatattagctctacaaggtgcctttgcggaacatgcacgaatgctagaaaaattaggaattgaaagtgtcgaactgagaaatttaaaaaattttcaacaacattacagtgatttatcaggtttgattctacctggcggtgagtccaccgccataggaaaacttttaagagagctgtatatgctggaaccgataaaacaagctatctcttctggctttcctgtctttggaacttgtgctggtttgattctgttggctaaagagattacttctcagaaagagagtcattttggaacaatggacattgtggttgagaggaatgcctatggacgccaattgggaagtttctatacagaagcagattgcaaaggggttggtaaaattcctatgacttttatcagaggacctatcatcagtagtgttggtaaaaaagtcaatattcttgcaacggtaaataataaaatcgttgcagcccaagaaaagaatatgctggtaacatcatttcatcctgaattaacaaataacttgagtttgcataagtactttatcgatatatgtaaagtagca

SEQ ID NO: 2870 - protein, 192 aa, Haemophilus influenzae
  Name: NTH1594
MKIGILALQGAFAEHARMLEKLGIESVELRNLKNFQQHYSDLSGLILPGGESTAIGKLLRELYMLEPIKQAISSGFPVFGTCAGLILLAKEITSQKESHFGTMDIVVERNAYGRQLGSFYTEADCKGVGKIPMTFIRGPIISSVGKKVNILATVNNKIVAAQEKNMLVTSFHPELTNNLSLHKYFIDICKVA

SEQ ID NO: 2871 - DNA, 1647 bp, Haemophilus influenzae
  n 129: n is any nucleotide
  Name: NTH1597
atgtggatccggtatattatactgatccaactaaacagaagctatcgaagtgttatcgattggaacaggaaacgccctagctgtgttcgccctgccactctacttgagttttggaacattgtaaaagtntgcgttgaacatgatgttattgttataaaccaagcggcgaatacaggtttaactggtggctctacaccagatggcaatgattatgatcgcgatattgtcgtcatcaatacaatgcgaattgacggaatcaaactcatcaataacgcttcccaagttatttgcttaccaggctctacactcaatgaattagaaaatcaacttaaaccgtttggtcgtgaaccccactctgttattggctcatcttgcattggcgcatcagttattggtgggatttgtaacaactcaggtggagcattagttcaacgtggaccagcctatacagaaatggcactttacgctcaacttaatgaaaaaggtgaattagaactaaaaaatcatttaggcattgatttaggagaaactcctgaagaaattttaactaatctacaagaaaaacgttatcaggttaaagatattcgacaagattgcggacatggtcacgaccattactactgcaactatgttcgtcaagttgatgaaggctcccctgctcgttttaatgccgacccagctcgccactatgaagcctcaggctgtgcaggaaaacttgctgtctttgcggttcgtttagacacctttccgcttgaaaaagagacggctgttttctatatcggcaccaatcaaacttctgtgttgagcgatattcgtcgccacatgttagtaaacttcgaagtgctacccatttcaggtgaatatatccatcgtgatgcatttgacatcgcagcaaaatatggcaaagataccttttgggtcattaaaaagtttggtacacattggctaccaaaactcttttccttaaaatcaaacgtggatcgcatcggcaaaaaattcttctttttaccacaacatttaagcgataaacttatgcaaactgtgtctaaattcatcccagaacatcttccacaaagcttatgggattatcgcaacaaatacgagcatcacttaattatcaaaatgggtggaaaaggcattcaagaagcccgtgaatatttggaatcctacattgcagatggctcaaaaggtggctattttgaatgtaatgcaatcgaaacccaagcagcaatgcttcatcgtttcgctgttgcaagtgctgcaattcgttatcgtgcaattcacgaaaaagaagtagaagaaatagttgctttagatgttgcattacgtcgcaatgatcaagattggtttgaagtgttaccgccagaaattgataacagaattatctctaaactttactacggacattttatgtgccatgtctttcaccaagattacattgtaaaaaaaggttatgattatgaagaactagaatacgaaatgttgaaattacttgacaagcgtggtgcgcaatacccagccgaacacaatgtagggcatttatacgaggctaaaccaaccttgagaaaattctataaagagttggatccaaccaatagctttaatccaggtattggtaaaacgacgaggaaaaaatactgggcggaa

SEQ ID NO: 2872 - protein, 549 aa, Haemophilus influenzae
  Name: NTH1597
MWIRYIILIQLNRSYRSVIDWNRKRPSCVRPATLLEFWNIVKVCVEHDVIVINQAANTGLTGGSTPDGNDYDRDIVVINTMRIDGIKLINNASQVICLPGSTLNELENQLKPFGREPHSVIGSSCIGASVIGGICNNSGGALVQRGPAYTEMALYAQLNEKGELELKNHLGIDLGETPEEILTNLQEKRYQVKDIRQDCGHGHDHYYCNYVRQVDEGSPARFNADPARHYEASGCAGKLAVFAVRLDTFPLEKETAVFYIGTNQTSVLSDIRRHMLVNFEVLPISGEYIHRDAFDIAAKYGKDTFWVIKKFGTHWLPKLFSLKSNVDRIGKKFFFLPQHLSDKLMQTVSKFIPEHLPQSLWDYRNKYEHHLIIKMGGKGIQEAREYLESYIADGSKGGYFECNAIETQAAMLHRFAVASAAIRYRAIHEKEVEEIVALDVALRRNDQDWFEVLPPEIDNRIISKLYYGHFMCHVFHQDYIVKKGYDYEELEYEMLKLLDKRGAQYPAEHNVGHLYEAKPTLRKFYKELDPTNSFNPGIGKTTRKKYWAE

SEQ ID NO: 2873 - DNA, 1680 bp, Haemophilus influenzae
  n 28, 39, 1675, 1676, 1677, 1678, 1679: n is any nucleotide
  Name: NTH1598
ttgatgtgcggtaattttgacattaagncgagtattaanaatcagttaaatggtttaactgaaggatttaaagatctttatagtaacgttatcgaatcagccacaggagctgtggcgagtttacctgcaatggttattcaacgagcaaatcctcagttatacgatattcttacgaatggtttatatcaaggtaaaattgattttaatagcttaaaaaccagctgtgaagaaatgtctaagaagcttgcagacgcaactttaaatggtcgttggtctcaaagttcggatatggaatcctttaaagacattacttcaactgaaccagatgctactcgagctaaaaagagacttgaggaatctcaaggtaaggaaggtaaagagtgggtcgggggtaaaaaacgcggtggccaaggacaagaaccaatcaaaattgttgaggatgttgcaaaagctggctacaacatgcaaaacaagcgtaatgtattagaatcaggtcgaatctccggtagtagttgtagcggattactttgtcaaacttgggataatcctaaagatatgacagattggttaacgaatgtgatcggtgagaagcaattaactacttgtaaaacagattgtggtactgctagtagctctcgagctggtgttggtttaacacctgaaattgaaaaagaaaatattaagacggtaactcaattacaaaaagcgcttaacatgagcactccttccgttgaagtacttgcagaattaagttctacaacagttcctgtaactcgtggcttaattgagtctttacgagaagatcccgatgctcaagtattagggcagcgtttagccagtgaaattgctgtagctaaaacaatggagaaaatgcttcttgcacgtcgagctgttttaacgggtatgcgtgagccaaatgtggccaacaataaagatgctcaagaagagttagaaaagatcctcactttaattgaccgagaaataggtcaaattagaatggagattgatctacaaaaatcacttaccgggaattccgcagttgcaatcctacaaaataaagagctacgtgaatataacactggaaccggaaatgttacacgtgacagtgtagataaacggattagcgatttagctaatggtacgaatagcaatgctgctgaattggcagatgctgacaatatcaatattcctcgtaacaatgtcactttagaagtgcctcagatgtcaaactccctgtcttacaccgggactggcggtacatccggaaatagtagaggtaacacttcttattcatcagttccagcaattaaagggactgcacttgatcaagctacagggttgttgaaaaaatttgaagggtttagtgataaagcatattgggatgtcaatgcttatcgcactggatatggttcagatactatcacaaaagcggatggtacaattgtcaaagtaacgaaagatactgtagttagtcgcgctgacgcagagcgtgatttagcacgtcgaacacaagaatttgcaaatagagcgagaaataacgtatcatcttcaacatgggataagttaccgccaaatgcccaagccgcattaacatcttatgcctataactatggctcattaacaaaagatgtgattgctgcagcccaggctctgcggggtaccgagtcgaattcgnnnnnt

SEQ ID NO: 2874 - protein, 560 aa, Haemophilus influenzae
  Xaa 10, 13, 559, 560: Xaa is any amino acid
  Name: NTH1598
LMCGNFDIKXSIXNQLNGLTEGFKDLYSNVIESATGAVASLPAMVIQRANPQLYDILTNGLYQGKIDFNSLKTSCEEMSKKLADATLNGRWSQSSDMESFKDITSTEPDATRAKKRLEESQGKEGKEWVGGKKRGGQGQEPIKIVEDVAKAGYNMQNKRNVLESGRISGSSCSGLLCQTWDNPKDMTDWLTNVIGEKQLTTCKTDCGTASSSRAGVGLTPEIEKENIKTVTQLQKALNMSTPSVEVLAELSSTTVPVTRGLIESLREDPDAQVLGQRLASEIAVAKTMEKMLLARRAVLTGMREPNVANNKDAQEELEKILTLIDREIGQIRMEIDLQKSLTGNSAVAILQNKELREYNTGTGNVTRDSVDKRISDLANGTNSNAAELADADNINIPRNNVTLEVPQMSNSLSYTGTGGTSGNSRGNTSYSSVPAIKGTALDQATGLLKKFEGFSDKAYWDVNAYRTGYGSDTITKADGTIVKVTKDTVVSRADAERDLARRTQEFANRARNNVSSSTWDKLPPNAQAALTSYAYNYGSLTKDVIAAAQALRGTESNSXX

SEQ ID NO: 2875 - DNA, 237 bp, Haemophilus influenzae
  Name: NTH1599
ttgagtatgaaattaaatcatgcactgaaagcatcttatattgctatatcgtgcgcaatcttatcctcaaccatgccagtatcagcttctaatagtaatccgtttggatttaataaagccgattctattttgtctgatatggtgttttatcaaattgggggcggtgtaggttatatggctcccccgagtcgaggtacgattcctgcagctgatttgggattggttggaaagctaact

SEQ ID NO: 2876 - protein, 79 aa, Haemophilus influenzae
  Name: NTH1599
LSMKLNHALKASYIAISCAILSSTMPVSASNSNPFGFNKADSILSDMVFYQIGGGVGYMAPPSRGTIPAADLGLVGKLT

SEQ ID NO: 2877 - DNA, 972 bp, Haemophilus influenzae
  Name: NTH1600
atggcaacgagagattacaaaagaggggacaagatgaaattgaaaaaaatgacattatccgggctttgtattgcaattgcgttgaccagtatttcaggacaagcttcggagtccggtcaatcttctttaaacactgcatcgattatggcatcaagcgcttcgacaagttgtttagattataaggtcgttggtacttgtttttggctattttgtacaaaattcggctgtaaaatccggacatctacgaaaataaaacactatattcccgaggtagtggtttcaagttataaccatcaggctcaaaatccttgggtggaaatgaatttccttagcaatggggtaaaaggtggagattatcaatcaccacacaaagactatacgcaagcaacatttaaaaatgttgatgtaatcggtcatccgcagggagcgattagtcaaatgcttaatagtacagggtattactgcaaaagtcagacaacgccttttgtgccttattacttgagtggtttggactttttagcgtggcgatttggtgttccggaaatggtttatcctgaagcgcttattccaggtatgagagaaattagagcaaatggagacacttggggaaatatttatccacgagcgggtacagtaacacaagttcatgactataaagcttcagctgtaacagcgcatcgagtagcggatgttgtgacaaatactttccaaccacatgtatatataccgattgcgaaaaaagataatcaatcgaatggtgagtggtttccccctccagtgaaagaaggggatgaaaagacacataaatggcaacagcttcacccggttacttcacagtcttgtgctattttccctgataacccgccaagtatgctatctgaaaatggtagttatgcctgggcattatggcgcccttacaagtgctgtaaaaaacgcggacaaacatttttgtatagtattgattggtctaat

SEQ ID NO: 2878 - protein, 324 aa, Haemophilus influenzae
  Name: NTH1600
MATRDYKRGDKMKLKKMTLSGLCIAIALTSISGQASESGQSSLNTASIMASSASTSCLDYKVVGTCFWLFCTKFGCKIRTSTKIKHYIPEVVVSSYNHQAQNPWVEMNFLSNGVKGGDYQSPHKDYTQATFKNVDVIGHPQGAISQMLNSTGYYCKSQTTPFVPYYLSGLDFLAWRFGVPEMVYPEALIPGMREIRANGDTWGNIYPRAGTVTQVHDYKASAVTAHRVADVVTNTFQPHVYIPIAKKDNQSNGEWFPPPVKEGDEKTHKWQQLHPVTSQSCAIFPDNPPSMLSENGSYAWALWRPYKCCKKRGQTFLYSIDWSN

SEQ ID NO: 2879 - DNA, 441 bp, Haemophilus influenzae
  Name: NTH1601
atggttatgtctataaaaaaatcactgtttcttttcggtttgttaccactatcagtgttcgcccaggggcctaatcccataattactgtttattcaacacaagattatccaattcttcacgcagagcttgcaagccaggtgtatttacttgatcaagttgagcaatgggaaaatttgattagtcagcgattgagtgcgaatcctagtgtagcagctcagcaagcatctcagatttttcagtctgctgaatggaaacagtctgaagagcaattaaagcgttcttatcagggccttataagtggttggcaaaatggaatcaagaaggtgcctgcagttttatttcaatatccgggaaaagaggatagtgtcatatatggtgaaaccaatattgctcaggcattaagtttatggcaacgagagattacaaaagaggggacaaga

SEQ ID NO: 2880 - protein, 147 aa, Haemophilus influenzae
  Name: NTH1601
MVMSIKKSLFLFGLLPLSVFAQGPNPIITVYSTQDYPILHAELASQVYLLDQVEQWENLISQRLSANPSVAAQQASQIFQSAEWKQSEEQLKRSYQGLISGWQNGIKKVPAVLFQYPGKEDSVIYGETNIAQALSLWQREITKEGTR

SEQ ID NO: 2881 - DNA, 417 bp, Haemophilus influenzae
  Name: NTH1602
atgattcccttcgggcatgtcatttttccaaggaattttttatttcacattaggagaatgactatgtcctcatccactcaattggaacactatgatgttccatcaagtaaccctcttgaaactccaacattttcatttcgtgtgggaaaacacttgggccgttttttcgttgcagctaaaaacaaagcaaccgataaatacaaacaagtgacatctggtatcaatcaaagcattgaagacgaagaagctcgtcggctttgcgaattacaaatgatgctagatagccaagcggaagaatatgaggcaattattgatgatgtgcaaagaacgtggttaaaacgaacaacgttatttagcattttatttttgattgtcggtattgttggtacagtgggtactctttactaccttatgcat

SEQ ID NO: 2882 - protein, 139 aa, Haemophilus influenzae
  Name: NTH1602
MIPFGHVIFPRNFLFHIRRMTMSSSTQLEHYDVPSSNPLETPTFSFRVGKHLGRFFVAAKNKATDKYKQVTSGINQSIEDEEARRLCELQMMLDSQAEEYEAIIDDVQRTWLKRTTLFSILFLIVGIVGTVGTLYYLMH

SEQ ID NO: 2883 - DNA, 231 bp, Haemophilus influenzae
  Name: NTH1603
atgaaagtgacattacataacagttgtttagcttatttagccaaacataatgactcagaatctctaatagaggaagttcgcactcaagcattaaatgcctgggaaaatcgaggaaaagatgtatcttctactcgtattatggtgaatatccctagtcaatacggacagaaatatcacttctttacagtttcgccatacgcaaaccgtaaagatttgttaagtgtaaggggg

SEQ ID NO: 2884 - protein, 77 aa, Haemophilus influenzae
  Name: NTH1603
MKVTLHNSCLAYLAKHNDSESLIEEVRTQALNAWENRGKDVSSTRIMVNIPSQYGQKYHFFTVSPYANRKDLLSVRG

SEQ ID NO: 2885 - DNA, 246 bp, Haemophilus influenzae
  Name: NTH1605
atgattaagcgtttactcaagcttgttagttccaattgggacaaaaaaacaatgctgctggtttctgaagattttcgtaaaatcggcacttacatcttaggtattgcgtttgtcgcaatgtttgttcagaatgacaatattccgctacttcttgccattatcattatgatatttggcggaatagcttggttctgtggtgtgttgttagctaaatattgcaacaacttaatggagacagacggagcg

SEQ ID NO: 2886 - protein, 82 aa, Haemophilus influenzae
  Name: NTH1605
MIKRLLKLVSSNWDKKTMLLVSEDFRKIGTYILGIAFVAMFVQNDNIPLLLAIIIMIFGGIAWFCGVLLAKYCNNLMETDGA

SEQ ID NO: 2887 - DNA, 156 bp, Haemophilus influenzae
  Name: NTH1606
atgaatattacgttaaactggaatgggttcctctttgcaattgtctttgtactgttttttatgggaacagttgcttttattggtgtgcgatcattaaaacgtcaacaagagcaaaaagcacaaagcaaaaaaacacattccattggtgttaattca

SEQ ID NO: 2888 - protein, 52 aa, Haemophilus influenzae
  Name: NTH1606
MNITLNWNGFLFAIVFVLFFMGTVAFIGVRSLKRQQEQKAQSKKTHSIGVNS

SEQ ID NO: 2889 - DNA, 588 bp, Haemophilus influenzae
  n 575, 576, 577, 578, 579: n is any nucleotide
  Name: NTH1607
atgaaaaaaagaactcaacctgccaaagatttataccaacaaattacagaccaaattctcgaagcattagaacaaggtgtgatgccatggcaaaaaccttgggatagtggatggccacaaatggctattccatgcaacggtgaaagtggtcgtcaatactccgggatcaacgtacttctgctttggatgagcgctattagaaaaaactttactcaacgcaagtgggtaacttttcaaggagcaaatcatctaggtggccaagtccgaacaggtgagaaaagtacagttattattttctataaacaaaatatgtttgaagaaaaagacgatagcggaaacattgtacttgatgaaaacggtgatccgaaaatgaagtcatctgtatttattcgtggtcatcacgtgtttaatattgaacagtgtgaaggcttagaaaaatactatgaagaatatcctgaaccagaaaaatcttctgaaatgcaagctcgtccggatttagatgtattacccaataaaatgggtatgcagctgtataacaaagcacagggtaccgagtccgatattcgtataccagnnnnnttaattaat

SEQ ID NO: 2890 - protein, 196 aa, Haemophilus influenzae
  Xaa 192, 193: Xaa is any amino acid
  Name: NTH1607
MKKRTQPAKDLYQQITDQILEALEQGVMPWQKPWDSGWPQMAIPCNGESGRQYSGINVLLLWMSAIRKNFTQRKWVTFQGANHLGGQVRTGEKSTVIIFYKQNMFEEKDDSGNIVLDENGDPKMKSSVFIRGHHVFNIEQCEGLEKYYEEYPEPEKSSEMQARPDLDVLPNKMGMQLYNKAQGTESDIRIPXXLIN

SEQ ID NO: 2891 - DNA, 1482 bp, Haemophilus influenzae
  n 1469, 1470, 1471, 1472, 1473: n is any nucleotide
  Name: NTH1608
atgtcagaaaatttgttacttttcagcttgttagctgttgttattatattgattttattacttattctacgccagcaaaaatatacacatcttcatcaagaattatcgaaaacgactcaagattataatcagcttgccagtaaatttgatgaactgagtagcattaaaaaccagtttgaacaacaaacaattaaagtacagactgaaaatcaaggactgcaatatcgtttaactgaacgtgatgaacaaatacatcatctcacacaagaacgacaaaatttgactgaaaaattgaccgcactttctcaagaattaacggggttacaaacaaccttaacagagaaagaaaaatatttttccgcacaacaacagaactttgaacaatctaagctgcagttgagtgtggaatttcaaaacctagcaaatcgtattttggatgaaaaaagtcgatcatttagtcaatcaaatcaaacggcattggaaaccttgctcaagcctttccgtgagcaaattgaaggtttccaaaaacgggtcaatgaaattcactccgaatccgtgaaaggcaatgctggattggaagcggaaattaaaaaagtgctggaaattggtctgaatatgtcgcaagaggcgagtaatttaacttctgcgctgaaaggcgaaaagaaaacgttaggcaactggggcgaagtgcaattagaacgagcattgcaactggcaggacttgaagaaaatgtacattaccgtgctcaagctcattttaaagatgaacaaggcgggcgtaattaccctgattttgtgttgaatttacctgatgaaaaacacttaattatcgacagcaaaatgtcgctcgtggcttacgaaagtgcggtgaattctgaggatgattttgaacgagagcgtttactcaaagagcatatttccgcattaaaaacccatattaacgatctgcataaaaaagattacagcaatctgattggcatgcgtagtccgaattttgttcttatgtttattgcggtggaacctgcgtatattgaggctttaaaagctgatcctgccttatttaattacggttatgaacgcaatgtaattatggtttctcacactacgctaatgccgattttacgcaccgtggcaaacctctggcgtatcgaacgtggtaatgctgaagccaaagaaattgctgaaaaagcgggcgaaatctataaccaaatttgcttggtggcagaacgtttaagtaaactcggcaatacgctttccactgtcagcaaccaatacaacagcaccgtcaccgcacttgttggccaacaaggtttagttggcaaagtagaacgatttaaaaccctttccgcaaaagccaataaaacaatgcccgatgtggacttattgaataatcagctggatttggctagattgaatgtcttaaatcaagaaattctcaataatttatggggtaccgagtcgatatcgtnnnnnttaattaat

SEQ ID NO: 2892 - protein, 494 aa, Haemophilus influenzae
  Xaa 490, 491: Xaa is any amino acid
  Name: NTH1608
MSENLLLFSLLAVVIILILLLILRQQKYTHLHQELSKTTQDYNQLASKFDELSSIKNQFEQQTIKVQTENQGLQYRLTERDEQIHHLTQERQNLTEKLTALSQELTGLQTTLTEKEKYFSAQQQNFEQSKLQLSVEFQNLANRILDEKSRSFSQSNQTALETLLKPFREQIEGFQKRVNEIHSESVKGNAGLEAEIKKVLEIGLNMSQEASNLTSALKGEKKTLGNWGEVQLERALQLAGLEENVHYRAQAHFKDEQGGRNYPDFVLNLPDEKHLIIDSKMSLVAYESAVNSEDDFERERLLKEHISALKTHINDLHKKDYSNLIGMRSPNFVLMFIAVEPAYIEALKADPALFNYGYERNVIMVSHTTLMPILRTVANLWRIERGNAEAKEIAEKAGEIYNQICLVAERLSKLGNTLSTVSNQYNSTVTALVGQQGLVGKVERFKTLSAKANKTMPDVDLLNNQLDLARLNVLNQEILNNLWGTESISXXLIN

SEQ ID NO: 2893 - DNA, 1386 bp, Haemophilus influenzae
  Name: NTH1609
ttgcgtgcgcgcagtatagcattttttctaaaaggtttgacatatttccctttcggggtaagattttgccagttttttcctaagggattttttatgcttaattttgcctatcaagaacacgttcgctcttattatttcgactctcgtaaccaagattttcaattcccgccgctcactcaaattgaacatgctgatgtatgtgtgatcggggctggattttttggtttatctgcagcattagaactggcggagaaaggaaaaaaagtcattgtcttagagggtgcaagagtaggctttggtgcttctggtcgcagtggtgggcaggcaattaatggctttgaagaaggcattgatgaatacgttaaacaagttggcgaagataaagcacataaactttggaatatgtcattagagaccattgatattattgatgaacgtattgaaaaatatagcattcaatgcgactggaaaaaaggctatgccacattagcattaaatgaacgccgaatggatgacttaattgaaatggaaaaagaaagtcataaaaattttggctatcagaatatgcaactttgggataaaactaaattaaaacagcacttaggcagtgatatttatgtgggggggctatttgatagtaattcagggcatttgcatccacttaattattgcttaggtttagcgaaagcttgtgtcgatctgggtgttcagatttttgaacaatctcctgtcgtggatatggttgagaaaaatggttgcattgaggttaaaacagctaaaagtgcggttatttctcaagacgttattttagccaccaatgcttatattgatgcgctcccgaaatctattcatcacggcattaatcgtaaaatattacctgtggaaagttttattatcgccacagagccgttaagccaagcggttgctgattctgtcattaataatggcatgtcggtgtgtgataacaatttattattagactattatcgtttaagtgctgacaatcgcttgctttttggtagtgattctagctcagaaaaagatatggtcgcgattatgcggaaaaatatgttgtgtgtattcccgcaacttgaaaatgtaaaaatcgattatggctgggctggcccgattgatatgaccttaaactcaacgccacattttggtcgtatttctccgcatatttattttgctcatggttattctggtcacggtgttgctttgactggtcttgcggggcgaattgtagcggaggcgattttgggtgacgatgaacgtttatctatttttgaaggactgaaagtcccttctgtttatggtggtcgaattatcaaagatcttgcgacaaagattggtgtgcggtattacaagtttttagataaataccgt

SEQ ID NO: 2894 - protein, 462 aa, Haemophilus influenzae
  Name: NTH1609
LRARSIAFFLKGLTYFPFGVRFCQFFPKGFFMLNFAYQEHVRSYYFDSRNQDFQFPPLTQIEHADVCVIGAGFFGLSAALELAEKGKKVIVLEGARVGFGASGRSGGQAINGFEEGIDEYVKQVGEDKAHKLWNMSLETIDIIDERIEKYSIQCDWKKGYATLALNERRMDDLIEMEKESHKNFGYQNMQLWDKTKLKQHLGSDIYVGGLFDSNSGHLHPLNYCLGLAKACVDLGVQIFEQSPVVDMVEKNGCIEVKTAKSAVISQDVILATNAYIDALPKSIHHGINRKILPVESFIIATEPLSQAVADSVINNGMSVCDNNLLLDYYRLSADNRLLFGSDSSSEKDMVAIMRKNMLCVFPQLENVKIDYGWAGPIDMTLNSTPHFGRISPHIYFAHGYSGHGVALTGLAGRIVAEAILGDDERLSIFEGLKVPSVYGGRIIKDLATKIGVRYYKFLDKYR

SEQ ID NO: 2895 - DNA, 597 bp, Haemophilus influenzae
  Name: NTH1610
gtgccttctgatttagtcgcacagttctctaaagaaactggcatcgaggtaatttattctacctttgaaagtaacgaagaaatgtatgcgaaacttaaacttactcagaatactggttctagctatgatttggtgtttccatcaagttactacataaataaaatgattaaggaaaagatgcttcaaccgattgatcaaagtaaattgaccaatattcatcaaatccctaaacatttattaaataaagaattcgacccagaaaataaatattcattaccttacgtttacggcttaactggtattgaagttaatgcggatgagattgatcctaaaaccatcactagctgggcggatttatggaaacctgaatttaaaggcaaagttctcatgaccagtgatgcgcgtgaagtgttccacgtagcattattactggatggtaaatcgccaaataccaccaatgaagaagacatcaaaacagcttatgagcgtttagaaaaactgttaccaaatgtagcgacttttaactctgattctcctgaagtcccttacgtacaaggcgaagttgcaattggtatgatttggaatggttcagcttat

SEQ ID NO: 2896 - protein, 199 aa, Haemophilus influenzae
  Name: NTH1610
VPSDLVAQFSKETGIEVIYSTFESNEEMYAKLKLTQNTGSSYDLVFPSSYYINKMIKEKMLQPIDQSKLTNIHQIPKHLLNKEFDPENKYSLPYVYGLTGIEVNADEIDPKTITSWADLWKPEFKGKVLMTSDAREVFHVALLLDGKSPNTTNEEDIKTAYERLEKLLPNVATFNSDSPEVPYVQGEVAIGMIWNGSAY

SEQ ID NO: 2897 - DNA, 111 bp, Haemophilus influenzae
  n 57, 70, 77, 99, 106, 107, 108, 109, 110: n is any nucleotide
  Name: NTH1611
ttggaatggttcagcttattagcgcagaaagaaaatcaatctcttcaatttgtgtanccaaggggatctntagagtncaaaccgcgaggcatgcaacgncatggcnnnnnt

SEQ ID NO: 2898 - protein, 37 aa, Haemophilus influenzae
  Xaa 19, 24, 26, 36, 37: Xaa is any amino acid
  Name: NTH1611
LEWFSLLAQKENQSLQFVXPRGSXEXKPRGMQRHGXX

SEQ ID NO: 2899 - DNA, 96 bp, Haemophilus influenzae
  n 83, 84, 85, 86, 87: n is any nucleotide
  Name: NTH1612
ttgccattacgccttgatccactaaaaatccatcatttacatcatatacccagccgtgtaatgagagtttttgtccgcgttcnnnnnttaattaat

SEQ ID NO: 2900 - protein, 32 aa, Haemophilus influenzae
  Xaa 28, 29: Xaa is any amino acid
  Name: NTH1612
LPLRLDPLKIHHLHHIPSRVMRVFVRVXXLIN

SEQ ID NO: 2901 - DNA, 123 bp, Haemophilus influenzae
  Name: NTH1613
gtggatcaaggcgtaatggcaaccagcagagaaacccttgaaatttcttatcgaaacgctatcgctcgtttatcaatacttgatgaagaaaatattttgaaaaaagatcatcttgaaaataca

SEQ ID NO: 2902 - protein, 41 aa, Haemophilus influenzae
  Name: NTH1613
VDQGVMATSRETLEISYRNAIARLSILDEENILKKDHLENT

SEQ ID NO: 2903 - DNA, 1941 bp, Haemophilus influenzae
  Name: NTH1614
gtggcattaattagtttaaccaatggatacctttcctttagtgatgcacctttgttggatcacgcagaactacatattgaaccgaatgaacgtgtttgtttagttgggcgtaacggcgcaggtaaatcaactttattgaaaatcatcgcaggcgatgtgcttatggatgatggcaaaatccaatacgaaaaagatcttgtggtttctcgtttagaacaagacccaccgcgtaatgcgcaaggcaatatttttgattatgtcgcggaaggtgtcgggcatttaacggatttattgaaagaatatcatcagatttctgttcaattggaagaaaattacagtgatcaaattttaagtcaattagagcaagttcaggataaattagaacacgctgatggctggcgatttgaaaataaaatcaatgaagtgttgttaaaactaggtttgaatccaaacacaaaattatccgcactttcgggcggttggttacgcaaagcggctctcgcacgcgcattggtatgcgatcctgatgtgttattacttgatgaaccaaccaaccacttagatgtggaagctattgaatggctggaaaatttcttactggatttccaaggtagccttgtatttatttcccatgaccgttcttttattcgcaaaatggcaacacgcattgtggatttagatcgcggtcaattgcagtcttatctaggcaattacgatttatatttaaccacgaaagaagaaaatctacgcgttgaagccttgcaaaatgaattatttgataaacgacttgcacaggaagaagtatggattcgccaaggtatcaaggctcgccgtacaagaaatgaagggcgagtgcgcgcattaaaagcgatgcgtgaggaacgccgccaacgccgtgatgtaatgggaatagccaaattacagttagatacctcaagtcgttctggcaaaattgtctttgaaatggaagatgtgagctatgaaatcgcaggaaaaaccttgttaaaagatttttcaacaacgattttacgtggagacaaaattgcgcttgttgggccaaatggctgtgggaaaaccacgttcattaaattattgctgggtgaaattcagccaacatcaggcaaaatccgttgtggtactaaattagatattgcttattttgaccaataccgtgctgatttagatcctgaaaaaactgtaatggataatgtggcggatggcaaacaagatattgaagtcaatggtgtaaaacgccatgtgctagggtatttgcaagagttcttgttcccaccaaaacgagcaatgaccccagttaaagccttatcggggggagaacgaaatcgtttattactcgcaaaattgttgctccaaccaaataatttattgattcttgacgaaccaaccaatgaccttgatgtagaaacattggagcttttagaagaaattttgacggattatcaaggcacattgttaattgtgagccatgaccgtcaatttatcgataatactgcgacagaatgttatttattcgaaggtgaagggcatttgaataagtatgtgggaggattctttgatgcgaaacagcaacaagccaatttctgggcaagtaaagcagtggaagagcaggctaaagcgaagaaaactgaaccgctaaaagaagaaagtgcggtgaaaaatgaccgcacttctaagccgaaatccgtgaaactttcttataaagaacaacgtgagttagaacagctgccacaactattggaagagttggaaactaaaatcaccgtacttcaagctgaaatagccgatccagcatttttccaacaggctcacgatattaccgacgctaaattaaaagcattggcggatactgaagccgaattagaaacagcatttttacgctgggaagaattagaagaaaagaaaaatttggctgacggtaaagct

SEQ ID NO: 2904 - protein, 647 aa, Haemophilus influenzae
  Name: NTH1614
VALISLTNGYLSFSDAPLLDHAELHIEPNERVCLVGRNGAGKSTLLKIIAGDVLMDDGKIQYEKDLVVSRLEQDPPRNAQGNIFDYVAEGVGHLTDLLKEYHQISVQLEENYSDQILSQLEQVQDKLEHADGWRFENKINEVLLKLGLNPNTKLSALSGGWLRKAALARALVCDPDVLLLDEPTNHLDVEAIEWLENFLLDFQGSLVFISHDRSFIRKMATRIVDLDRGQLQSYLGNYDLYLTTKEENLRVEALQNELFDKRLAQEEVWIRQGIKARRTRNEGRVRALKAMREERRQRRDVMGIAKLQLDTSSRSGKIVFEMEDVSYEIAGKTLLKDFSTTILRGDKIALVGPNGCGKTTFIKLLLGEIQPTSGKIRCGTKLDIAYFDQYRADLDPEKTVMDNVADGKQDIEVNGVKRHVLGYLQEFLFPPKRAMTPVKALSGGERNRLLLAKLLLQPNNLLILDEPTNDLDVETLELLEEILTDYQGTLLIVSHDRQFIDNTATECYLFEGEGHLNKYVGGFFDAKQQQANFWASKAVEEQAKAKKTEPLKEESAVKNDRTSKPKSVKLSYKEQRELEQLPQLLEELETKITVLQAEIADPAFFQQAHDITDAKLKALADTEAELETAFLRWEELEEKKNLADGKA

SEQ ID NO: 2905 - DNA, 96 bp, Haemophilus influenzae
  Name: NTH1615
atgccacagctgccccataaaaattcagtgaaaattaaccgcactattctatacggtttgcataaaaaatcccatcaattcaatgggattctctct

SEQ ID NO: 2906 - protein, 32 aa, Haemophilus influenzae
  Name: NTH1615
MPQLPHKNSVKINRTILYGLHKKSHQFNGILS

SEQ ID NO: 2907 - DNA, 1383 bp, Haemophilus influenzae
  Name: NTH1616
atgcagaaaaacgaaataaaacaaagcgatatgaaaccacttatcattgattcttcttggacagaacgttttcttcctgatcctccacgcgaaaaagataatcgcccaccatttcgtcgggatcgtgggcgaattttacattctgccgcttttcgttgcttacaagcgaaaacccaaattcacgcaattggcgaaaatgatttttaccgtactcgcttaactcactctttagaagttgcacagattggcagcagcctcgttgcacagcttaaatttttagaaacctttgaaagcctttcgcaaacattaaatattgataaaaacgagttgcaaaaacaattaaaacctttattgccgagtaacgatcttattgagagtttgtgttttgctcatgatattgggcatccgccttttgggcatggtggcgaaacggcattaaattatatgatggcagagcagggagggtttgaaggcaatgcacaaacctttagaattttaacgaaacttgagccttacactgaaaatgcagggatgaatctaacgcgccgaacactattgggtgtagtgaaatatcccgcgttgttaggtgtggcttcgcctcaatatgcagaacttaatttttctcgcaacattgatcctcgttttgtgcgtattcatgattggattccaggaaaaggcattttccgcgatgatttaaaaatgtttaattggttgctggaaaatctttctgaaaatgaccgcactttattctgtcaatttaaaaaagtgcgggaaaatccagctgaatctttacatactcggtttaaatcactggattgcagcattatggaattggcggatgatattgcctatggcgtacatgatttagaagatgcgattgtaactggcgtggtaaatcctcatcaatggcaagcggcacatgttgcattgaaacaaattccgtcagcttggttacatgaaaatattgattcaattagccaacgacttttctcggataaacattttgagcgcaaacaggcgattggtgcattggtgaacttttttattactaatgtgcggtggaaattaacggcaaattttgatgaacctttgttacgttataacgcagagttgccacctgaagtgattgctgcgcttggtgtatttaaaaaattcgtttgggattatgttattcgcaatgtggatacccaacgaatcgaatataaagggcagagaatgctaacagaaatgttccagatttttgaatctgatccggagcgtttattaccaagaaatacagaaaatcgttggcgtaatgcaccaaaagaagggaagaagcgaattatttgcgattatattgcaggcatgtcagatgcacacgcattgcgggtatatcaacaactt

SEQ ID NO: 2908 - protein, 461 aa, Haemophilus influenzae
  Name: NTH1616
MQKNEIKQSDMKPLIIDSSWTERFLPDPPREKDNRPPFRRDRGRILHSAAFRCLQAKTQIHAIGENDFYRTRLTHSLEVAQIGSSLVAQLKFLETFESLSQTLNIDKNELQKQLKPLLPSNDLIESLCFAHDIGHPPFGHGGETALNYMMAEQGGFEGNAQTFRILTKLEPYTENAGMNLTRRTLLGVVKYPALLGVASPQYAELNFSRNIDPRFVRIHDWIPGKGIFRDDLKMFNWLLENLSENDRTLFCQFKKVRENPAESLHTRFKSLDCSIMELADDIAYGVHDLEDAIVTGVVNPHQWQAAHVALKQIPSAWLHENIDSISQRLFSDKHFERKQAIGALVNFFITNVRWKLTANFDEPLLRYNAELPPEVIAALGVFKKFVWDYVIRNVDTQRIEYKGQRMLTEMFQIFESDPERLLPRNTENRWRNAPKEGKKRIICDYIAGMSDAHALRVYQQL

SEQ ID NO: 2909 - DNA, 693 bp, Haemophilus influenzae
  Name: NTH1617
atgcagcagtacattatttatctttatacatttttaacaattttcgggttttggctcgcactacaaattagcaaacgttggaagtcaatgatttttaatacttttgttttaacagtattaattttggcggcgattttagtgataggaaagattccttatgatgattatatggcaggaaatgcgcctattaataatttacttggcttgagtatcgttgctctcgcattgcctctttatgaacaacttcgccaaattgccagacaatggaaaattattctttcaacggtggttatagcctcttttttggcgatgttaagtggcgggcttttagcatttcttttaggtgcaacgcccgaaatggtcgctacggttttacctaaatccatcacaatgcctattgcgatggaagtttcccgtcatttaggcggcattcctgccgtaactgcagttggtgttgtggttgcaggtttgcaaggatcgatatttggttatcttgtattaaaaaaattgggtgttaaacatcaagaagctattgggctttctgttggttcggtttctcacgcgctcggtacagtaagttgtatggaaacgaatccaacagcgggaagttacagttctatttctcttgtgctttgtgggattattagttctattctcgcgccatttgtatttaagctgatttatttctttgtt

SEQ ID NO: 2910 - protein, 231 aa, Haemophilus influenzae
  Name: NTH1617
MQQYIIYLYTFLTIFGFWLALQISKRWKSMIFNTFVLTVLILAAILVIGKIPYDDYMAGNAPINNLLGLSIVALALPLYEQLRQIARQWKIILSTVVIASFLAMLSGGLLAFLLGATPEMVATVLPKSITMPIAMEVSRHLGGIPAVTAVGVVVAGLQGSIFGYLVLKKLGVKHQEAIGLSVGSVSHALGTVSCMETNPTAGSYSSISLVLCGIISSILAPFVFKLIYFFV

SEQ ID NO: 2911 - DNA, 867 bp, Haemophilus influenzae
  Name: NTH1618
atgaccgcactttgcgttgtattcttaggaacgttgttaccactcgttcacaaacaacttggtttaggctctatttctattggtgcgccgttctttgatcaaatgttcttaattattatgacaccatttgcattattgcttggtattggacctttagtgaaatggcgtagagaccaattttctgcaattcgtacgcctgttgttatcagcgtatttgttatgctgattgcaggttttgcgttaccttatttcttgcaagataaaattaccgtgagttcagtgcttggttcaatgatgactgtgattattgtgttacttgtgctttatgaattgcaacaacgtgcgacgcatcgtgaatcattctttgttggcgtacgcaaactatctcgttctcattggggaatgatgttagctcacttaggcgtagctatgactgtttgggggatcgcatttagccaaaactttagcgtagaacgtgatgtgagaatgaaagttggcgagaacgcacaaattggtcgttacgattttaaattcgctggtgtgacggatgaaaatggtccaaactatattggtggaaaagctcaaattgatatttcgaaagatgggcaaccagagacaagtttattcgcagaaaaacgtttttacacagtaagtcggatgtctatgacagaagccgcaattgctggtggtttaactcgtgacctttatgtggcacttggcgaaaaacttgaggacaattcttgggcgttacgcttatattacaagccatttattcgctggatttggattggcggcttatttatggcgttaggtggattgttgtgcatgttcgatcgacgctatcggtttaatgtgttgttgaagaaa

SEQ ID NO: 2912 - protein, 289 aa, Haemophilus influenzae
  Name: NTH1618
MTALCVVFLGTLLPLVHKQLGLGSISIGAPFFDQMFLIIMTPFALLLGIGPLVKWRRDQFSAIRTPVVISVFVMLIAGFALPYFLQDKITVSSVLGSMMTVIIVLLVLYELQQRATHRESFFVGVRKLSRSHWGMMLAHLGVAMTVWGIAFSQNFSVERDVRMKVGENAQIGRYDFKFAGVTDENGPNYIGGKAQIDISKDGQPETSLFAEKRFYTVSRMSMTEAAIAGGLTRDLYVALGEKLEDNSWALRLYYKPFIRWIWIGGLFMALGGLLCMFDRRYRFNVLLKK

SEQ ID NO: 2913 - DNA, 543 bp, Haemophilus influenzae
  Name: NTH1619
atgaaaaaaaaattactcgttcctcttattctctttttatcgataacaattgcctttttagtgcaattaaaacgtaatgcacaaggcgaagatattaaagcattagagtcagctttggttggaaagcctgtgccagaaaaaaatttgacggagttgtttgaaaataaagcttacacgaacgaattgtttcaacaaggtaagccagttttgcttaacgtatgggcgacttggtgtccgacttgttatgccgaacatcaatatttaaacaaacttgctaaagagggtgtgagaattatcggtttagattataaagatgaatcacctaaagcaatgaagtggttaaaagatcttggcaatccttatcaagttgttttaaaagatgaaaaaggttctttcggtttggatttaggggtatatggtgcgccagaaacgttcattgtagatggaaaaggcgtgattcattatcgttatgctggagatgtaaacgaaaaagtttggactcagactttaaaaccaatttatgacaaactttcggagcaacaa

SEQ ID NO: 2914 - protein, 181 aa, Haemophilus influenzae
  Name: NTH1619
MKKKLLVPLILFLSITIAFLVQLKRNAQGEDIKALESALVGKPVPEKNLTELFENKAYTNELFQQGKPVLLNVWATWCPTCYAEHQYLNKLAKEGVRIIGLDYKDESPKAMKWLKDLGNPYQVVLKDEKGSFGLDLGVYGAPETFIVDGKGVIHYRYAGDVNEKVWTQTLKPIYDKLSEQQ

SEQ ID NO: 2915 - DNA, 459 bp, Haemophilus influenzae
  Name: NTH1620
atgaaaaaaacatggttatttttgaccgcatttttgtttagctcagtggcgttttcagctattgacgcattaaattttagttctccacagcaagagagtgattaccaccaattaacacaatctttgcgttgtcctcaatgtcaaaataacaatattgcggattccaatgcgactatcgctgtggatatgcgtggcaaagtatttgagcttttacaagaaggcaaatcgaaaaatgacgtagtggattatatggtggcacgttacggcaattttgtaacctatgatcctcctataacagcgagtacattagtgctatggattgcgccattattgcttgtgttgttaggcgtggtgtttttattaagacgccaacctaaaacccaaagtgcggtgaaatcccaagaggttttaacggatgaagataatgcgcgtttggcagaattattaaccagggataaa

SEQ ID NO: 2916 - protein, 153 aa, Haemophilus influenzae
  Name: NTH1620
MKKTWLFLTAFLFSSVAFSAIDALNFSSPQQESDYHQLTQSLRCPQCQNNNIADSNATIAVDMRGKVFELLQEGKSKNDVVDYMVARYGNFVTYDPPITASTLVLWIAPLLLVLLGVVFLLRRQPKTQSAVKSQEVLTDEDNARLAELLTRDK

SEQ ID NO: 2917 - DNA, 780 bp, Haemophilus influenzae
  Name: NTH1621
ttggaagaaattgagcaagataattcccaaggtttagttgaaaatgttgagcaactcaaacaagaattacagaaacccttgcttgatgatgtaccgagcaaggttcaagagaatgtggattattctggcaaatcttatggaaaaatttggtttgtctctggtgtattagcgttaggaattatcgcaggttcttcttattttatggtgggatcttggcaagccgaatcaatgttagagcaaacttatgcgaaattgccctatttctttgaccgaatgaaagatgaagataaaaatccattttctgatgcagaaatgcagcaattttctaccgcacttcgaatcgatttgcaaaaaaatccaactgatgctaaaaaatggtggatgctcggtcaaattgggatgaatttaggtgatgcacgtttggcattcgatagctatcaaaaggctaataaacttgaaccagataatgtgcaatataaattaggctatgctcgtatattgatgttttctgaagatgcgactgataaacttaaaggtggcaatttattgcgtgaagtgattcgtcaagaacacactaacattgaagcattgagtttactcgcattccgttattttgaaacagaagattataaaatggcggcagtgacttgggcgatgatgctacgcttaatgccgaaagatgatgagcgagttccattaattgaaaaaagtattcgtaccgcgcgtgatgctttagaagcgcaaaatgaagaaaaatcaaaaagtatcactcccgaaaaa

SEQ ID NO: 2918 - protein, 260 aa, Haemophilus influenzae
  Name: NTH1621
LEEIEQDNSQGLVENVEQLKQELQKPLLDDVPSKVQENVDYSGKSYGKIWFVSGVLALGIIAGSSYFMVGSWQAESMLEQTYAKLPYFFDRMKDEDKNPFSDAEMQQFSTALRIDLQKNPTDAKKWWMLGQIGMNLGDARLAFDSYQKANKLEPDNVQYKLGYARILMFSEDATDKLKGGNLLREVIRQEHTNIEALSLLAFRYFETEDYKMAAVTWAMMLRLMPKDDERVPLIEKSIRTARDALEAQNEEKSKSITPEK

SEQ ID NO: 2919 - DNA, 489 bp, Haemophilus influenzae
  Name: NTH1622
ttgttctgcgtcattattggaagtttatttacttcacaattttcgattgcagaaaatgattctagtgcagttgattctgaagataaaaaagcatttaattccgatgtttcaaataatgatgctcaaaaactagctcaaagtattgaatttaaagtttataaaatagatgaaaccacttcatcagaaagtatttatgaatctccagctggaatttgtcagggatttaagattacaagaggtgtagattacacaaattcgacttaccattatctttatccagacaatagaggagaattctatggcagtgtggttggtgcaaccatttataaccaaaaagatcctcaaaatttaagttatgtgcctgtttattcaattacagacaaagatttgtctaagtgtattcaggcacaagaaaataaaaaattaaaggaaaaagcagcgaattatgtatcagaaggtagggctgtattaactgacgtaatttgtaaa

SEQ ID NO: 2920 - protein, 163 aa, Haemophilus influenzae
  Name: NTH1622
LFCVIIGSLFTSQFSIAENDSSAVDSEDKKAFNSDVSNNDAQKLAQSIEFKVYKIDETTSSESIYESPAGICQGFKITRGVDYTNSTYHYLYPDNRGEFYGSVVGATIYNQKDPQNLSYVPVYSITDKDLSKCIQAQENKKLKEKAANYVSEGRAVLTDVICK

SEQ ID NO: 2921 - DNA, 306 bp, Haemophilus influenzae
  Name: NTH1623
atgtatttaatgagaaaaatagtttttgttagttgtgtaattttaggtttagcagcatgttcatctcaaccagaacaaattggtggcggtgtttacgatatgaaaactgtgcaagaatataatgctcgagttattagtggtaatactgttacacaaactcaaaaggataaaataacgcaacaaattgatacaagtttaaaattaaaccaaagtgacaataaagttaaaacgagaacaagacgtgtattgcctgttcttccagttacaccaagcgtcgggtatcattataattatcactattttaga

SEQ ID NO: 2922 - protein, 102 aa, Haemophilus influenzae
  Name: NTH1623
MYLMRKIVFVSCVILGLAACSSQPEQIGGGVYDMKTVQEYNARVISGNTVTQTQKDKITQQIDTSLKLNQSDNKVKTRTRRVLPVLPVTPSVGYHYNYHYFR

SEQ ID NO: 2923 - DNA, 456 bp, Haemophilus influenzae
  Name: NTH1624
gtgaagtgggcgaagcccactgcattaaatcttgctaatcatttcaaaactttagatgcgcttaaagacgcaaatcttgaagaacttcaacaagtgcctgatgtaggggaagttgtagcgaaccgaatttttatattttggcgtgaagcgcataatgttgcagtcgtggaggatttaatcgcacaaggtgtgcattgggaaactgtagaagtgaaagaagcgagtgaaaacttgttcaaagataaaactgtagtactgacaggcactcttacacaaatggggcgtaatgaagcaaaagccttattacaacagcttggtgcaaaagtaagtggttcggtatccagtaaaacagatttcgttatcgcaggtgatggggcaggctctaaacttgcaaaagctcaagaactaaatattacagtattaacagaagaagaatttttagcacagataacaaga

SEQ ID NO: 2924 - protein, 152 aa, Haemophilus influenzae
  Name: NTH1624
VKWAKPTALNLANHFKTLDALKDANLEELQQVPDVGEVVANRIFIFWREAHNVAVVEDLIAQGVHWETVEVKEASENLFKDKTVVLTGTLTQMGRNEAKALLQQLGAKVSGSVSSKTDFVIAGDGAGSKLAKAQELNITVLTEEEFLAQITR

SEQ ID NO: 2925 - DNA, 3081 bp, Haemophilus influenzae
  Name: NTH1625
atgacccaatacaaaactatcgctgaatccaataattttatcgttttagatcaatataataaatttgtggaagaacctaatgctggttaccaaacggaagggagccttgagcgtgagtttattcgtgatttacaggctcaaggctatgagtatttacaagggcttaataatcacgatgaactgattaaaaacttacgtgttcaattacaacggttgaataatgttattttctccgatgcagaatggcaacgttttttagaggaatatttggataaaccgagcgataatctgattgagaaaacccgcaaaattcacgatgattatatttatgattttgtgttcgataacggacgcattcagaatatctatttgctagataagaaaaatcttgccaataattctctgcaagtcatcaatcaatttgagcaaacaggcagctatgataatcgttatgatgtgacaattttggtgaatggtttaccccttgtgcatattgaactgaaaaaacgtggcgtggcgattcgtgaagcctttaaccaaattcaccgttacagcaaagaaagtttcaataaagaaaattctctctttaaatatattcagatttttgtcatttctaatggcacggatactcgctattttgctaatacgactaaacgcaataagaatagctacgacttcacaatgaattgggcaacggcaaaaaatactctgattaaagatttaaaggattttaccgcaactttcttgcaaaagaatactttgctcaatgtgttggtaaattactgcgtgtttgatgtttccgacactctattgattatgcgtccgtatcaaattgccgccactgagcgtattttatggaaaatcaaaagttcatatcacgccaaaaattggagcaacaaagaaagtggtggctatatttggcataccacaggctcaggcaaaaccctcaccagttttaaagcatctcgtcttgcgactgaacttgattttattgataaagtcttttttgtggtcgatcgtaaagacttagactaccaaacgatgaaagaatatcagcgtttttcgcctgatagcgtgaatgggtcggaaagtaccgctgggcttaaacgcaatattgaaaaagatgataacaaaattatcgtaaccaccattcaaaaattgaataatttaatgaaaagtgaagaaaacctgtctatttatcaaaaacaggtggtctttattttcgatgaagcacatcgctcccaatttggcgaagcacaaaaaaatctaaaacgtaaattcaaaaaattctatcaatttggttttactggcacacctattttccctgaaaacgcattaggtgcggaaacgacaacaagtgtgttcggtacggaattgcattcttatgtgattaccgatgctattcgtgatgacaaagtactgaaattcaaggtcgattacaacgatgtccgcccacaatttaaagccttagaaacagaaaaagatcctgaaaaattaaccgcacttgagcagaaacaagcctttttacaccctgagcgtattaaagaaatctcgcaatatttgcttaacaattttaaacaaaaaacccaccgcttgaatgccacaggtaaaggctttaatgcaatgtttgcggtaagcagtgtggaagcagcaaaacgttattacgaaaccttacaaaatttacaggcagagcaggagcatccgttaaaaattgcaacaatcttttcgtttgccgccaatgaagaacaagatgcaattggcgatattccagatgagacctttgaacccactgctctaaacagtacggcaaaagaatttttaacaaaagccattgatgattacaatcactactttggcacgaattatggcgtagatagtcaatcattccaaaattactatcgcgatcttgccaaacgtgtgaaaaatcaggaagtggatttactgattgtagtcggaatgttcttaacaggctttgatgcccctacgttgaatactcttttcgtggacaaaaacttgcgttatcacggattaatgcaggctttttctcgcaccaaccgcatttatgacacaactaaaacctttgggaatatcgtcactttccgcgatttggaacaaaataccattgatgcaatcacgctatttggcgatgacaataccaaaaatatggttttagagaaaagctacgaaacctattttaatggtgatgaaaatcaacgtggttatttagaggttgttcaagagctacaaaatcgctttcctaatccaacagaaatcgaaacagagcaagataaaaaagagtttgtaaaattatttggcgaatatctacgtgtcgaaaatattttgcagaattacgatgagtttgcagcattgcaagccttacaagcggtcgatttaaatgatccgattgcaatggagaaattcaagcaagtacattatgtgaatgatgaacaaattgcagaaatgctgaaagtacccactttaccagtaagagcggagcaagattatcgttcaacttataatgatattcgcgattggctacgccaaagaaaagaagggaatgataaagataattcgccgataaattgggacgatgtcgtatttgaagtggatttattaaaatctcaagaaatcaatttggattatattcttgcgttaattttcgagcatcataagaaaaaccaagacaaagaggtgttaattgatgaaatccgccgcacagttcgttcaagtttaggtaaccgtgctaaagagagcttgattgtcgattttatcaaccaaacaaatttagatgatattcccgataaagcgactttaattgactcattcttcctatttgctcaagcagaacagcgaaaagaagcagaatccttaattcaagaagaaaatttgaatgtcgatgcagcaaaacgctatatcagcacttcattaaaacgcgaatatgccagtgaaaacggcacagcgttaaatgaagtattgccaaaaatgagtccacttactccacaatatctcactaaaaagcagacaattttccaaaaaattgctgcatttgtagagaaatttaaaggggttggtggaaagatt

SEQ ID NO: 2926 - protein, 1027 aa, Haemophilus influenzae
  Name: NTH1625
MTQYKTIAESNNFIVLDQYNKFVEEPNAGYQTEGSLEREFIRDLQAQGYEYLQGLNNHDELIKNLRVQLQRLNNVIFSDAEWQRFLEEYLDKPSDNLIEKTRKIHDDYIYDFVFDNGRIQNIYLLDKKNLANNSLQVINQFEQTGSYDNRYDVTILVNGLPLVHIELKKRGVAIREAFNQIHRYSKESFNKENSLFKYIQIFVISNGTDTRYFANTTKRNKNSYDFTMNWATAKNTLIKDLKDFTATFLQKNTLLNVLVNYCVFDVSDTLLIMRPYQIAATERILWKIKSSYHAKNWSNKESGGYIWHTTGSGKTLTSFKASRLATELDFIDKVFFVVDRKDLDYQTMKEYQRFSPDSVNGSESTAGLKRNIEKDDNKIIVTTIQKLNNLMKSEENLSIYQKQVVFIFDEAHRSQFGEAQKNLKRKFKKFYQFGFTGTPIFPENALGAETTTSVFGTELHSYVITDAIRDDKVLKFKVDYNDVRPQFKALETEKDPEKLTALEQKQAFLHPERIKEISQYLLNNFKQKTHRLNATGKGFNAMFAVSSVEAAKRYYETLQNLQAEQEHPLKIATIFSFAANEEQDAIGDIPDETFEPTALNSTAKEFLTKAIDDYNHYFGTNYGVDSQSFQNYYRDLAKRVKNQEVDLLIVVGMFLTGFDAPTLNTLFVDKNLRYHGLMQAFSRTNRIYDTTKTFGNIVTFRDLEQNTIDAITLFGDDNTKNMVLEKSYETYFNGDENQRGYLEVVQELQNRFPNPTEIETEQDKKEFVKLFGEYLRVENILQNYDEFAALQALQAVDLNDPIAMEKFKQVHYVNDEQIAEMLKVPTLPVRAEQDYRSTYNDIRDWLRQRKEGNDKDNSPINWDDVVFEVDLLKSQEINLDYILALIFEHHKKNQDKEVLIDEIRRTVRSSLGNRAKESLIVDFINQTNLDDIPDKATLIDSFFLFAQAEQRKEAESLIQEENLNVDAAKRYISTSLKREYASENGTALNEVLPKMSPLTPQYLTKKQTIFQKIAAFVEKFKGVGGKI

SEQ ID NO: 2927 - DNA, 996 bp, Haemophilus influenzae
  Name: NTH1626
atgaacgacttaatcatctacaacaccgatgacggcaaatctcacgttgctttattggttgtcgaaaatgatgcttggctgactcaaaatcagcttgcggaactttttgacacctctgtaccaaatataaccactcatataaaaaacatattacaagacaaagagttagatgagttttcagttattaaggattacttaataactgcccaagatagcaaacaatatcaagtaaaacattattcccttgatatgattctcgccatcggctttcgtgtgcgcagccctcgtggtgtacagtttcgtcgttgggcgaatacgcaattacgtacttatttagataaaggttttctattagataaagagcggttgaaaaatcctcaaggtcgatttgatcattttgatgaattactggaacaaattcgcgaaattcgagccagtgaattgcggttttatcaaaaagtacgagagttatttaaattatccagtgactacgataaaacagataaagtcactcaaatgttttttgcagaaacacaaaataagttgatttatgccattacacaacaaaccgccgcagagcttatttgtacgcgtgcaaatgccaaattgcctaatatgggtcttacctcttggaaaggtgctgttgtacgtaaaggcgatattattaccgctaaaaactatttaactcatgatgaattagattctttgaatcgtttagtgatgatctttttagaaagtgctgaattacgcgttaaaaatcgtcaagatctcacattaaatttctggcgtaataatgtcgataatttaattgaatttaacggttttccgttgcttatcggtaatggaacccgaaccgtaaaacaaatggaaacctttaccaaagaacaatatgccttatttgatcaggtcagaaaacaacaaaaacgcatacaagctgataatgaagatttagaaattttagaaaactggcagaaagatctgaaaaagcaaaagcat

SEQ ID NO: 2928 - protein, 332 aa, Haemophilus influenzae
  Name: NTH1626
MNDLIIYNTDDGKSHVALLVVENDAWLTQNQLAELFDTSVPNITTHIKNILQDKELDEFSVIKDYLITAQDSKQYQVKHYSLDMILAIGFRVRSPRGVQFRRWANTQLRTYLDKGFLLDKERLKNPQGRFDHFDELLEQIREIRASELRFYQKVRELFKLSSDYDKTDKVTQMFFAETQNKLIYAITQQTAAELICTRANAKLPNMGLTSWKGAVVRKGDIITAKNYLTHDELDSLNRLVMIFLESAELRVKNRQDLTLNFWRNNVDNLIEFNGFPLLIGNGTRTVKQMETFTKEQYALFDQVRKQQKRIQADNEDLEILENWQKDLKKQKH

SEQ ID NO: 2929 - DNA, 369 bp, Haemophilus influenzae
  n 318: n is any nucleotide
  Name: NTH1627
gtgaaacaaggtggttcaaacaagagtttctcctatcatctttttctaaaaaatctacttgaagaagttaaatctaaagatattcaaaaatatcatttcatgttactgagaaatttatatgaaaaaactgctaactttcttggttattcaggatggtcaaatctattacccaatgatgatgcaagacaaagctattacactcgtataatcaattttactagtcactctacgttatcaaatgagataatcgctgaaccaacagatgccgaaaagaagattgttaaatatttacttgaacatctaattaataattatggnttctatatatattataatattaaagagccacaaactgataatataacagag

SEQ ID NO: 2930 - protein, 123 aa, Haemophilus influenzae
  Name: NTH1627
VKQGGSNKSFSYHLFLKNLLEEVKSKDIQKYHFMLLRNLYEKTANFLGYSGWSNLLPNDDARQSYYTRIINFTSHSTLSNEIIAEPTDAEKKIVKYLLEHLINNYGFYIYYNIKEPQTDNITE

SEQ ID NO: 2931 - DNA, 105 bp, Haemophilus influenzae
  Name: NTH1628
atggaaatttgctcggcgcggattttattcaattcagcattcggtaaattaactaattttttccctttaaaatggcagagccttcacttaaccgttggctggcaa

SEQ ID NO: 2932 - protein, 35 aa, Haemophilus influenzae
  Name: NTH1628
MEICSARILFNSAFGKLTNFFPLKWQSLHLTVGWQ

SEQ ID NO: 2933 - DNA, 531 bp, Haemophilus influenzae
  Name: NTH1629
atgggcatgtatccgcacgagttttctggcggtatgcgtcaacgggtgatgattgcgatggccctattatgccgtcccaaactactcattgcagatgaaccaacaaccgctttggatgtgaccgttcaagcacaaatcatgaccttgttaaatgagttaaaacacgaatttaatactgcgattattatgattacccatgatcttggggtagtggctggtatctgcgatcaagtcatggtgatgtatgctggacgaaccatggaatacggcacagcggaacaaattttctatcatccaacccatccctattccataggcttaatggatgcgattcctcgcttagacggcaatgaagaacacttggtcaccattcctggcaatccaccgaatttattgcatttgccaaaaggttgtccattctcacctcgttgccaatttgctaccgaacaatgccaaattgcgccaaaactgactacatttaatcacggtcaattacgtaattgttggttatcagcggagaaatttaaccta

SEQ ID NO: 2934 - protein, 177 aa, Haemophilus influenzae
  Name: NTH1629
MGMYPHEFSGGMRQRVMIAMALLCRPKLLIADEPTTALDVTVQAQIMTLLNELKHEFNTAIIMITHDLGVVAGICDQVMVMYAGRTMEYGTAEQIFYHPTHPYSIGLMDAIPRLDGNEEHLVTIPGNPPNLLHLPKGCPFSPRCQFATEQCQIAPKLTTFNHGQLRNCWLSAEKFNL

SEQ ID NO: 2935 - DNA, 1068 bp, Haemophilus influenzae
  n 707, 752, 924, 927: n is any nucleotide
  Name: NTH1630
atgacagtctcaaacaacaaagaattactccttgaagtcaatcacttaggcgtcagttttaaaattaaaaatgataaatcccttttcttcgccaaaccgcaaaccttaaaagcggtgaaggatgtgtcttttaaactttacgcaggtgaaactctcggcgtagtaggtgaatctggttgtggtaaatccacacttgcacgcgctattatcggtttagtcgaagcgagtgaaggggaaatcttgtggcttggtaaacatttacgaaaacaatcagcgaaacaatggaaagaaacgcgtaaagatattcaaatgattttccaagatccgctcgcctctctcaatccgcgaatgaatattggcgaaatcattgctgagccattaaagatctaccaaccgcacttaagtgccgccgaagtgaaagaaaaagtgcaagctatgatgttgaaagttgggcttttaccgaacttgattaaccgctacccacatgaattttctggtggtcaatgtcagcgtatcggtattgctcgtgcgttaatcattgagcccaaaatgatcatttgtgatgagcccgtttcagcgttagatgtgtcgattcaggctcaagtggtgaatttattgaaatccctgcaaaaagaaatggggctttccttaatttttatcgcccatgatttagcggtggtaaaacatatttctgaccgtttattagngatgtatttattctatgcaatggaattatgcatcgatgtggaagnatataacgataccaaacatccttataccacagccttaatgtctgctgttccgatccccgatccaaaattggaacgcaataaatccatcgaattacttgaaggtgatttgccttcgccaattaatccaccgtctggttgcgtatttcgtactcgctgtctaaaggctaataanaantgtgcgaaccaaaaacccccccttcaccagccaaacaaccaagccatttgtggcttgcttgaaagtcttataaaacaaaaagtgcggttaaaattcaccgcactttttacttttacaatcctaacttttcttcaattacct

SEQ ID NO: 2936 - protein, 356 aa, Haemophilus influenzae
  Xaa 236, 251, 308, 309: Xaa is any amino acid
  Name: NTH1630
MTVSNNKELLLEVNHLGVSFKIKNDKSLFFAKPQTLKAVKDVSFKLYAGETLGVVGESGCGKSTLARAIIGLVEASEGEILWLGKHLRKQSAKQWKETRKDIQMIFQDPLASLNPRMNIGEIIAEPLKIYQPHLSAAEVKEKVQAMMLKVGLLPNLINRYPHEFSGGQCQRIGIARALIIEPKMIICDEPVSALDVSIQAQVVNLLKSLQKEMGLSLIFIAHDLAVVKHISDRLLXMYLFYAMELCIDVEXYNDTKHPYTTALMSAVPIPDPKLERNKSIELLEGDLPSPINPPSGCVFRTRCLKANXXCANQKPPLHQPNNQAICGLLESLIKQKVRLKFTALFTFTILTFLQLP

SEQ ID NO: 2937 - DNA, 876 bp, Haemophilus influenzae
  Name: NTH1631
atggcaatccagatgacaacaaaaacaacttaccaatggcctcaatctaaggatatttatccatatcgaccagggcgttttgatgcaccaaaacattggcgttataacttacgtagctttttaaatcgtggttcaattcgtcgctttgaacaatttatcaatcaatatccttttctcgtcgatatttttaatacgcacttggattatagttatcctgttgcttgtcgttttttagataagcgttttaacgcatcacaacgttttcatgccgtttgtgagaatcttttatttttacccgaaaaacttaccgcactttctacgccgttatgggaaaaacctctaagttttggcgaagtcattcctgattttgaaatgacattaagcatgacaacccatcaaccgatggaaggatattgggtattggagctatggcataaaccaagaaacgaattagtctatttgcttacctttgccaaattaggcgatgcgttgcttattgctgttgtacaagggccaaattttgaaggctcaaaggaaatggtgaaacaactaaccaaattatgccacggtttacgccctgcctatttaatggttgaaaccatgaaatcactcacaaaaatactaggctacgataaattgcttggcattccgcaaaaataccaaaataaatctcgcttcattcaaagtaaacaatatactgtggattatgatgcaatttttggcgaatcaggcggagaattaaaagattactgggaattgcctttagaaatggatagaaatctggatgatattccaagtaaaaaacgttccatgtatcgtaaacgttatgcgatgctagatgatttggctaaggtaattgaagaaaagttaggattg

SEQ ID NO: 2938 - protein, 292 aa, Haemophilus influenzae
  Name: NTH1631
MAIQMTTKTTYQWPQSKDIYPYRPGRFDAPKHWRYNLRSFLNRGSIRRFEQFINQYPFLVDIFNTHLDYSYPVACRFLDKRFNASQRFHAVCENLLFLPEKLTALSTPLWEKPLSFGEVIPDFEMTLSMTTHQPMEGYWVLELWHKPRNELVYLLTFAKLGDALLIAVVQGPNFEGSKEMVKQLTKLCHGLRPAYLMVETMKSLTKILGYDKLLGIPQKYQNKSRFIQSKQYTVDYDAIFGESGGELKDYWELPLEMDRNLDDIPSKKRSMYRKRYAMLDDLAKVIEEKLGL

SEQ ID NO: 2939 - DNA, 351 bp, Haemophilus influenzae
  Name: NTH1632
atgtctgaaattaaacttaattaccacaaaacccactttttaacgagcgcgccgaatattcgttccattcctgaagatacgggcattgaaattgcgtttgcgggtcgttcaaatgcgggaaaatcgaccgcacttaatgcactaaccaatcaaaaaaatttagcgcgcacctcaaaaacaccggggcgcacgcaattgattaacttatttgaagtggaaccaaattgtaaattggtagatttaccgggctatggctatgccgccgtgccagagcaaatgaaaatccaatggcacaaatcccttgggcgaatatttgcaaaaacgcgaatgtttgcaagaattggtttgggt

SEQ ID NO: 2940 - protein, 117 aa, Haemophilus influenzae
  Name: NTH1632
MSEIKLNYHKTHFLTSAPNIRSIPEDTGIEIAFAGRSNAGKSTALNALTNQKNLARTSKTPGRTQLINLFEVEPNCKLVDLPGYGYAAVPEQMKIQWHKSLGRIFAKTRMFARIGLG

SEQ ID NO: 2941 - DNA, 171 bp, Haemophilus influenzae
  n 66, 162, 163, 164, 165, 166: n is any nucleotide
  Name: NTH1633
ttgggcgaatatttgcaaaaacgcgaatgtttgcaagaattggtttgggttgatgggatattcgtncaccctcttaaagatcttgaccaacaaatgattgaatggggcgggttcagcaaatttaccgggaccttttattggttactaaagccgataaataannnnnttaat

SEQ ID NO: 2942 - protein, 57 aa, Haemophilus influenzae
  Xaa 54, 55, 56: Xaa is any amino acid
  Name: NTH1633
LGEYLQKRECLQELVWVDGIFVHPLKDLDQQMIEWGGFSKFTGTFYWLLKPINXXXN

SEQ ID NO: 2943 - DNA, 741 bp, Haemophilus influenzae
  Name: NTH1634
atgttagaactcggaaaacttcttaccacacttatcgcaccacctcttaatacctttgtattactgattattgcagcgattatttattgtgttcatttcaaaaaattagccaaatttcttgcgattataagtttcacttggctttatatcatgagtgtgccttttactggtttattgctaacaaataatgatgattctccagcccttacgctagatgagtataaacaagctcaagccatcgtcatattaggcggtggatcttaccaaaccaaagagctgtatgcagaaacggcttctggtgcaccacaactagaacgtttacgttatgcggcatttttacaaaaggaaacgggcttgcctattttaaccacgggctattctttgataggcatttctgaaggcgatttaatggcaaaagaacttaaccaattctttaatgtgccaacacaatggatcgaaaataaagcccgtaatacggaagaaaatgccagtttcactaaaaatattttagtgaaagatcatattcaaaaaattattttagtaacaaatcaatggcatatgaaacgagccaaatatctttttgaaaaacaaggatttgatgttcttcctgctgcagcggcaagctatggcagcaaaggaaatctatctgcaaaatcttttattcctgacttaggtgcgttaaatagcaatatggttttattaaaagagtggattggttattggaaagcccattatgtagaa

SEQ ID NO: 2944 - protein, 247 aa, Haemophilus influenzae
  Name: NTH1634
MLELGKLLTTLIAPPLNTFVLLIIAAIIYCVHFKKLAKFLAIISFTWLYIMSVPFTGLLLTNNDDSPALTLDEYKQAQAIVILGGGSYQTKELYAETASGAPQLERLRYAAFLQKETGLPILTTGYSLIGISEGDLMAKELNQFFNVPTQWIENKARNTEENASFTKNILVKDHIQKIILVTNQWHMKRAKYLFEKQGFDVLPAAAASYGSKGNLSAKSFIPDLGALNSNMVLLKEWIGYWKAHYVE

SEQ ID NO: 2945 - DNA, 2049 bp, Haemophilus influenzae
  Name: NTH1635
gtggcaacaggggcaattcctgctcgttttggttttgatagccaaaatttaacccttgatcaatatttccaacttgcacgtggtaacaaagatcaattcgcaattgaaatgaccaaatggtttgatacgaactatcactatcttgtgcctgagttccaaaaatcgaccgctttcaaagctaatccagcacattatgtaaaccaaatccgtgaagcaaaagccttaggcttaaacttcaaacctgtgattgttggcccattaacattcttatggttaggtaaagaaaaaggcgaagcatttaaccgtttcgatttattaaatcaattagtgcctgtttatgttgaaattttaaatgcattagtggctgaaggggcagaatggattcaaattgatgaacctgcattagcattagatttaccagcagaatgggttgaagcctataaatctgtttacgctgaattaagcaaagtgaacgcaaaattattattagccacttattttggttcagttgcagaacacgctgaattattaaaagccttacctgttgcaggcttgcatttagatttagttcgtgcaccagaacaacttgcggcatttgaagattacagcaaagtgttatcagctggtgtgattgaaggtcgtaatatctggcgtgcaaacttaaacaaagtgttagatgtattagagccattaaaagcaaaattaggtgagcgtttatggattgcaccaagctgttcattattgcataccccatttgatttagaagtggaagtacaattaaaagaaaaaaataccgcactttacagctggttatctttcacgctacaaaaagtagaagaattaaacgtattaaaacaagcgttaaataatggcagagcgtctgtacaagcagcattagatgcaagccaagcggcagcagatgcacgtgcaacctcaaaagaaattcatcgccctgaagtggcagaacgtttagcaaacttgccaaaaggtgcggatcaacgtaaatcgccatttgcagaacgtatcgttaagcaaaatgcgtggttaaatttaccgcttctgccaactacaaacattggttcattcccacaaactactgaaattcgtcacgcacgtgcaagtttcaaaaaaggcgagttatctcttgcagattacgaagcggcaatgaaaaaagagatcgaatatgtagtacgtcgccaagaagaattagatttagatgtgttagttcacggtgaagcagaacgtaacgacatggtggaatactttggggaattattagatggtttcgcattcactaaatttggttgggtacaaagctatggttcacgttgtgtaaaaccaccagtgatttacggtgatgtaactcgcccagagccaatgacagtacgctggtctcaatatgcacaaagcctcacaaaccgtgtaatgaaaggaatgctcacaggccctgtgactattttacaatggtcattcgtgcgtaacgatattccacgttcaaccgtatgtaaacaaatcggcgtagcattatctgatgaagtgttagatttagaagcagcaggcattaaagtcattcaaattgacgaaccagccattcgtgaaggtttaccgcttaaacgtgcagattgggacgcatacttacaatgggcaggcgaagcattccgtttaagctcaatgggcgtgcaagatgatacgcaaattcacactcacatgtgttattccgagtttaacgacatcttacctgccattgcggcattagatgcagacgtgattaccatcgaaacttcacgttcagatatggaattattaacggcatttgcagatttcaaatatccaaatgatattggcccaggtgtttacgatattcacagccctcgtgtaccaacggcggcggaagtggaacatttattacgtaaagcattaaatgtaattccaaaagaacgcttatgggtaaacccagactgcggtttaaaaacgcgtggctggacagaaaccatcgaccaattaaaagtgatggtggatgtaaccaaaaaattacgtgcggaattagcg

SEQ ID NO: 2946 - protein, 683 aa, Haemophilus influenzae
  Name: NTH1635
VATGAIPARFGFDSQNLTLDQYFQLARGNKDQFAIEMTKWFDTNYHYLVPEFQKSTAFKANPAHYVNQIREAKALGLNFKPVIVGPLTFLWLGKEKGEAFNRFDLLNQLVPVYVEILNALVAEGAEWIQIDEPALALDLPAEWVEAYKSVYAELSKVNAKLLLATYFGSVAEHAELLKALPVAGLHLDLVRAPEQLAAFEDYSKVLSAGVIEGRNIWRANLNKVLDVLEPLKAKLGERLWIAPSCSLLHTPFDLEVEVQLKEKNTALYSWLSFTLQKVEELNVLKQALNNGRASVQAALDASQAAADARATSKEIHRPEVAERLANLPKGADQRKSPFAERIVKQNAWLNLPLLPTTNIGSFPQTTEIRHARASFKKGELSLADYEAAMKKEIEYVVRRQEELDLDVLVHGEAERNDMVEYFGELLDGFAFTKFGWVQSYGSRCVKPPVIYGDVTRPEPMTVRWSQYAQSLTNRVMKGMLTGPVTILQWSFVRNDIPRSTVCKQIGVALSDEVLDLEAAGIKVIQIDEPAIREGLPLKRADWDAYLQWAGEAFRLSSMGVQDDTQIHTHMCYSEFNDILPAIAALDADVITIETSRSDMELLTAFADFKYPNDIGPGVYDIHSPRVPTAAEVEHLLRKALNVIPKERLWVNPDCGLKTRGWTETIDQLKVMVDVTKKLRAELA

SEQ ID NO: 2947 - DNA, 219 bp, Haemophilus influenzae
  Name: NTH1636
ttgggagttattatgacaacatcacatattttaggctttcctcgtgtaggggcaaaacgtgaattaaaatttgcacaagaacgttattggcgtaaagaattagcagagcaagatttattagatttagcgaaagcattgcgtgaaaaaactggaaacatcaagcggctgccaatgcggatttcgttgcagtgggcgatttcacgttctacgatcatattt

SEQ ID NO: 2948 - protein, 73 aa, Haemophilus influenzae
  Name: NTH1636
LGVIMTTSHILGFPRVGAKRELKFAQERYWRKELAEQDLLDLAKALREKTGNIKRLPMRISLQWAISRSTIIF

SEQ ID NO: 2949 - DNA, 1074 bp, Haemophilus influenzae
  Name: NTH1637
atgataaatacccttgatcgttatattggaaaaagtattcttggcacgatttttgctactttaatgactttagtgggattgtcggcgattattaaatttgtcgaacaatttcgtagtgtaggtaaaggcacttatgatatttggcaagcggtaatttttactggtttaactataccgaaagatattgaaactttctttcctatggcagcattgcttggggcattaattgcactaggtaatcttgctagcagaagcgaacttgttattatgcaatcagctggattttctcgctttaaaataggtatagcggtaatgaaaactgcattaccattagtagtatttacaatgattattggggagtggggaattccacaaacagaacaatttgcacgagatatgcgcgctaaggctctttctggtggttcaatactttcaattaaaaatggtgtgtgggcgaaagatggtcatcattttgtatttgttaggcgtgtgacggatgatacaaaattagacgatatttatatttatacctttgatcaacagcataatttaataaaattaaaacatgcaaaccaggcgagttattctgaagatgaagctaaatggacattgcgtcaagttaatcattcaacgattatgaaagatgaaatcatcacaacgaatcatttatcagaaacttgggaaactagtttgacgccagataaattaggtgcggtttctttgcgtccgacatcattatctatctcaggtttatatcattacatttcatttctgcgtgaaacagggcaagatgtgagtcgttttgaactcacgttttggcgtaaaattttccagcctgtatccgttggcgtaatgatgttattagccttatcttttatttttggctcgctacgcagtgtgactgcaggtgcaaggatagttactgggatttgtgtaggattcttattttatgttgttaatgaaattttaggacaaacgagtgtagtttacggtattcctgctatttttggtgcattgatcccgagcttgcttttcattgtaatgatttggtggttattaagtcgtaagcgagat

SEQ ID NO: 2950 - protein, 358 aa, Haemophilus influenzae
  Name: NTH1637
MINTLDRYIGKSILGTIFATLMTLVGLSAIIKFVEQFRSVGKGTYDIWQAVIFTGLTIPKDIETFFPMAALLGALIALGNLASRSELVIMQSAGFSRFKIGIAVMKTALPLVVFTMIIGEWGIPQTEQFARDMRAKALSGGSILSIKNGVWAKDGHHFVFVRRVTDDTKLDDIYIYTFDQQHNLIKLKHANQASYSEDEAKWTLRQVNHSTIMKDEIITTNHLSETWETSLTPDKLGAVSLRPTSLSISGLYHYISFLRETGQDVSRFELTFWRKIFQPVSVGVMMLLALSFIFGSLRSVTAGARIVTGICVGFLFYVVNEILGQTSVVYGIPAIFGALIPSLLFIVMIWWLLSRKRD

SEQ ID NO: 2951 - DNA, 507 bp, Haemophilus influenzae
  Name: NTH1638
ttgctgcctgcggtcgactctgggagaccccaatacaaacgggttgaaggaacctccgctttgccagattttcgcattacgcattttgatgaatatcacgcctatttaggttatcaatccgcagaaaataccaatgatgaagtagcagaattaacattgtctcaacttatcgatttagattcttcttctgcgaaagctgaattgcattggcgtattaccttaattttggcagtgccattaatggcattgattgctgtaccattaagtcgcgtaaatcctcgacaaggtagatttgccaaaattttacccgcacttttactctatttaatttatttcttgttacaaagctcttttaaatctgcaggttcagcgggaaaattagaggctgaacttttaatgccgcttgttaatatcggatttttcttacttgctgtggtgttgaatagctgggacagtgaaataatgtataaatttcgctatttattcagtaagaaaggatcggcaaaa

SEQ ID NO: 2952 - protein, 169 aa, Haemophilus influenzae
  Name: NTH1638
LLPAVDSGRPQYKRVEGTSALPDFRITHFDEYHAYLGYQSAENTNDEVAELTLSQLIDLDSSSAKAELHWRITLILAVPLMALIAVPLSRVNPRQGRFAKILPALLLYLIYFLLQSSFKSAGSAGKLEAELLMPLVNIGFFLLAVVLNSWDSEIMYKFRYLFSKKGSAK

SEQ ID NO: 2953 - DNA, 1089 bp, Haemophilus influenzae
  Name: NTH1639
atgggattcaaatgtggtattgtgggattgccaaatgtgggcaaatctactctttttaacgcactcactaaagctggcattgaagccgcaaactatccattctgtactatcgaaccaaatacgggtgtcgtgccaatgccagatccacgtttagacgcattggcagaaatcgttaagcctgaacgcatattacctactacgatggaattcgtggacatcgcaggcttagttgcgggagcaagtaaaggcgagggcttgggtaataaattcctcgctaatattcgtgaaaccgatgcgataggtcacgtagtgcgttgttttgaaaacgatgacattgtacacgttgcagggaaaattgatccgcttgatgatattgaaactatcaacactgaattagctttagcagacttagacagctgtgaacgagcaatccaacgtttacaaaaacgtgcaaaaggtggcgataaagaagctaaatttgaactttccgttatggaaaaaatccttcctgtgcttgaaaatgctggaatgattcgttctgttgggttagataaagaagaattgcaagcaatcaagagttacaacttcttaacgttaaaaccaacaatgtatatcgcaaacgtaaatgaagatggttttgaaaataatccatacttagattgcgttcgtgaaattgctgaaaaagaaggggcagtggtcgttccagtatgtgctgcgattgaatctgaaattgcagaacttgacgatgaagaaaaagtcgagtttttacaagatttaggcattgaagaaccaggattgaaccgagtaattcgtgctggttatgcacttttaaatcttcaaacttatttcactgctggcgtaaaagaagtacgagcttggacagtttcagtcggtgcaaccgcaccaaaagcagcagctgtaatccacactgactttgaaaaaggctttatccgagcagaagttatcgcttatgaagactttatccaattcaacggtgaaaacggtgcaaaagaagcaggtaaatggcgtttagaaggcaaagattacatcgtgcaagatggcgatgtaatgcatttccgattcaacgta

SEQ ID NO: 2954 - protein, 363 aa, Haemophilus influenzae
  Name: NTH1639
MGFKCGIVGLPNVGKSTLFNALTKAGIEAANYPFCTIEPNTGVVPMPDPRLDALAEIVKPERILPTTMEFVDIAGLVAGASKGEGLGNKFLANIRETDAIGHVVRCFENDDIVHVAGKIDPLDDIETINTELALADLDSCERAIQRLQKRAKGGDKEAKFELSVMEKILPVLENAGMIRSVGLDKEELQAIKSYNFLTLKPTMYIANVNEDGFENNPYLDCVREIAEKEGAVVVPVCAAIESEIAELDDEEKVEFLQDLGIEEPGLNRVIRAGYALLNLQTYFTAGVKEVRAWTVSVGATAPKAAAVIHTDFEKGFIRAEVIAYEDFIQFNGENGAKEAGKWRLEGKDYIVQDGDVMHFRFNV

SEQ ID NO: 2955 - DNA, 582 bp, Haemophilus influenzae
  Name: NTH1640
atgtcagaaataaaactcattgttggtttaggcaatcctggcgaaaaatatgccgatacacgccataatgcaggcgaatggcttattgaacgcttggctcgtcgttttaacgtttcactaaatccagaaagtaaattcttcggaaaaactgcccgcactttagtgaatggaaaagaagtacgccttttagtgccaacaacttttatgaatttaagcggtaaagcagttggcgcgttggcaagtttttaccgtattaaacctgaagaaattttggttattcacgatgaactagatttgcctgctggcacagcgaaactcaaacaaggcggtggacatggtgggcataacggcttaaaagatattgtggctcaattaggcaataacaataatttctaccgtttacgtattggcattgggcatcctggtcatcgtgatttagtggcaggttatgttttaaataaaccatctccagcagatcgcgatgcacttgaaaaagtgttagatgaggcaactgattgtgtagaaataattttcaaagatggaatgatcaaagcgaccaatcgtttaaacagttttaaaatt

SEQ ID NO: 2956 - protein, 194 aa, Haemophilus influenzae
  Name: NTH1640
MSEIKLIVGLGNPGEKYADTRHNAGEWLIERLARRFNVSLNPESKFFGKTARTLVNGKEVRLLVPTTFMNLSGKAVGALASFYRIKPEEILVIHDELDLPAGTAKLKQGGGHGGHNGLKDIVAQLGNNNNFYRLRIGIGHPGHRDLVAGYVLNKPSPADRDALEKVLDEATDCVEIIFKDGMIKATNRLNSFKI

SEQ ID NO: 2957 - DNA, 306 bp, Haemophilus influenzae
  Name: NTH1641
atgaatcagattaacattgaaatcgcttatgcttttcccgaacgttattatttgaaatcttttcaagttgatgaaggaatcaccgtgcaaacggcgattacgcaatcagggattttaagccaatttccagagattgatttgagcacaaataaaattgggattttcagtcgtccaataaaattgactgatgtattaaaagagggcgatcgtattgaaatttatcgtccattacttgctgatccgaaagaaattcgccgtaaacgtgcagcagagcaagctgcagccaaagacaaagaaaaaggagct

SEQ ID NO: 2958 - protein, 102 aa, Haemophilus influenzae
  Name: NTH1641
MNQINIEIAYAFPERYYLKSFQVDEGITVQTAITQSGILSQFPEIDLSTNKIGIFSRPIKLTDVLKEGDRIEIYRPLLADPKEIRRKRAAEQAAAKDKEKGA

SEQ ID NO: 2959 - DNA, 408 bp, Haemophilus influenzae
  Name: NTH1643
atgaccgcactttcatccgttgatttttgtttacctgaacatatcacgccagaaatttttctacgtgattattggcagaaaaagccacttgtgattcgtaacggtttgcctgaaattgttgggcagtttgagccacaagatattattgaacttgcacaaaatgaagatgtcaccgctcgtttagtgaagacattttctgatgatgattggaaagttttttttagccctttgagcgaaaaggatttccaaaaattgccagaaaaatggtcggtgttggttcaaaacttggagcaatggtcgcctgaattaggacaactttggaacaaatttggctttattcctcaatggcaacgtgatgatattatggtgtcttacgcaccgaaaggtgggctctgtcggcaagcatta

SEQ ID NO: 2960 - protein, 136 aa, Haemophilus influenzae
  Name: NTH1643
MTALSSVDFCLPEHITPEIFLRDYWQKKPLVIRNGLPEIVGQFEPQDIIELAQNEDVTARLVKTFSDDDWKVFFSPLSEKDFQKLPEKWSVLVQNLEQWSPELGQLWNKFGFIPQWQRDDIMVSYAPKGGLCRQAL

SEQ ID NO: 2961 - DNA, 828 bp, Haemophilus influenzae
  Name: NTH1644
gtgggctctgtcggcaagcattatgatgagtatgatgtatttttagtgcaaggctatggccatcgtcgttggcaagtgggtaaatggtgtgatgcaagcactgaatttaaacccaatcaatcgatccgaatttttgatgatatgggcgaattagtcattgatgaagtaatgaatccaggggatattctctatattccagcccgtatggcgcattatggcgtggctgaagatgattgtttaaccttttcttttggcttgcgttatccaaatttaagcaatttgattgatggcataagcaaaggtttttgtcatcaagatcctgatttgaatttaagcgagtttgatttaccgctacgtttaagccagtctgaacaacgtacaggtaaacttgcagatgaaaatattcaagcgatgaaacagcttttattagataaattggctcattcagaagcttttgatacgttgtttaagcaagccgtagcaagtgcggtaagttctcgtcgttatgagttattagtctctgatgaaatgtgtgatcctgatgaagtgcggtcaattttagaagaagatggcgcattcctttctcaagacaacaattgtaaattgctttacaccgaaaatccgttgcgaatttatgcgaacggcgaatggttagatgaacttaatataattgagagcgaagtattaaaacgcttgtctgacggcgaaagtttagattgggcgtttttatctgatttagccaataaaacagaagatcccgaaacctcaatggatttgctgttagattcaatttgtaactgggttgatgatggttgggcgttaattgaa

SEQ ID NO: 2962 - protein, 276 aa, Haemophilus influenzae
  Name: NTH1644
VGSVGKHYDEYDVFLVQGYGHRRWQVGKWCDASTEFKPNQSIRIFDDMGELVIDEVMNPGDILYIPARMAHYGVAEDDCLTFSFGLRYPNLSNLIDGISKGFCHQDPDLNLSEFDLPLRLSQSEQRTGKLADENIQAMKQLLLDKLAHSEAFDTLFKQAVASAVSSRRYELLVSDEMCDPDEVRSILEEDGAFLSQDNNCKLLYTENPLRIYANGEWLDELNIIESEVLKRLSDGESLDWAFLSDLANKTEDPETSMDLLLDSICNWVDDGWALIE

SEQ ID NO: 2963 - DNA, 489 bp, Haemophilus influenzae
  n 365, 419: n is any nucleotide
  Name: NTH1645
ttgaataatatgtcagacaatatttattccgtctctcaactaaattctgccgcacgtcagatgttggagggtaatttttcccaaatttggctaacgggggaaatttccaattttacccaacctgtgtctgggcattggtatttaacgctgaaagatgaaaatgcacaggtgcgttgtgcaatgtttcgtatgaaaaatttgcgtgtagcttttcgtccacaaaatggaatgcaagtgcttgtgcgtgccaatgtgagtttatatgagcctcgcggcgattatcaacttattattgattctatgcacccagcaggcgagggattattgcaacagcaatttgaagcgttaaaaatgaagttggctgncgaaggattgttgctcaaaactttaagaaactctaccgcactttataaagcagnggggataataacttcttctacggtgcggcattgcaagatattttgctattctggcccgcccggatccagt

SEQ ID NO: 2964 - protein, 163 aa, Haemophilus influenzae
  Xaa 122, 140: Xaa is any amino acid
  Name: NTH1645
LNNMSDNIYSVSQLNSAARQMLEGNFSQIWLTGEISNFTQPVSGHWYLTLKDENAQVRCAMFRMKNLRVAFRPQNGMQVLVRANVSLYEPRGDYQLIIDSMHPAGEGLLQQQFEALKMKLAXEGLLLKTLRNSTALYKAXGIITSSTVRHCKIFCYSGPPGSS

SEQ ID NO: 2965 - DNA, 549 bp, Haemophilus influenzae
  Name: NTH1646
gtgttgcatatttatggttcacacccaatggcttgcgatcgtatcgaagattatccaaaaatttttgatgataaagatcttaatccgaaatatggttatttaaattgctatgtgtcgtctattaagaaaaccgatgaatttttaaaacgtgtatatgatcagcttgaagaaaatgcgaagaaaaatcaccgcactttctcaatgatttatttctcagatcacggtttgtgccaccaacaagatgaaaaaaacaatatacttttgttcaatcaaaactgtttcagccgagagcaccataatattccgctattcaaaatttcatcagatgatatggaacgcaaagaatataaggtgtttaaatcaggtttaaatttcttagaagggattgcaaattggataggaattcaaaatcctcaattaacgcaaacagaagatttattttctaacgaatcggataaaaatgactttggattgcaaaaacgaattgatgaaaaatatcgtaaagatgacgatccagccattgatattcgtcctaaacacggagcatat

SEQ ID NO: 2966 - protein, 183 aa, Haemophilus influenzae
  Name: NTH1646
VLHIYGSHPMACDRIEDYPKIFDDKDLNPKYGYLNCYVSSIKKTDEFLKRVYDQLEENAKKNHRTFSMIYFSDHGLCHQQDEKNNILLFNQNCFSREHHNIPLFKISSDDMERKEYKVFKSGLNFLEGIANWIGIQNPQLTQTEDLFSNESDKNDFGLQKRIDEKYRKDDDPAIDIRPKHGAY

SEQ ID NO: 2967 - DNA, 96 bp, Haemophilus influenzae
  Name: NTH1647
ttggaaggggagggcttaacctttactggaagaccgattagttttctactgagtctttggggggaaatgaatggccgcctttatggggaagggact

SEQ ID NO: 2968 - protein, 32 aa, Haemophilus influenzae
  Name: NTH1647
LEGEGLTFTGRPISFLLSLWGEMNGRLYGEGT

SEQ ID NO: 2969 - DNA, 726 bp, Haemophilus influenzae
  Name: NTH1648
ttggtgtatttattttcagcaacaaattacaaaattactatggcaaaaaaagattactacgaagtccttggcctacaaaaaggggcgagtgaggacgacatcaaacgtgcgtataaacgtttagcgtctaaacatcatcccgataaaaaccaaggcagtaaagaagcagaagaaaaattcaaagaaattaatgaagcttatgaagtattaggcgacgatcaaaaacgcgcagcctacgatcaatatggccacgcagcctttgaacaaggtggtggcactggtggcttcggtggcggctttggcggtgctgattttggtgatatgttcggtgatatttttggcgatattttcggtggtggacgtggtcgtcagcgcgttgttcgtggcgaagacttacgttatgacttagaaattagcctagaagaagccgtaaaaggtacaaccaaagatattcaaatcaatactcttgcacattgtgatagctgtggtggctctggggctgaaaaaggttctaaagtggaaacttgtccgcattgccacggttctggtcgaattcgtcgtcagcaaggtttcttcgtatctgaaagtatttgtccaacttgtcacggtagcggtaagaaaattgaaaaaccttgtcgcagttgtcatggagaaggacgagttcataagaaagataatctttcattaaaaattcctgcaggcgtagatacgggcaaccaacttcgc

SEQ ID NO: 2970 - protein, 242 aa, Haemophilus influenzae
  Name: NTH1648
LVYLFSATNYKITMAKKDYYEVLGLQKGASEDDIKRAYKRLASKHHPDKNQGSKEAEEKFKEINEAYEVLGDDQKRAAYDQYGHAAFEQGGGTGGFGGGFGGADFGDMFGDIFGDIFGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRSCHGEGRVHKKDNLSLKIPAGVDTGNQLR

SEQ ID NO: 2971 - DNA, 960 bp, Haemophilus influenzae
  Name: NTH1650
ttgagtctagtgaaagcggtattaaaagatgcagataaaggtgtaagcgaaatccacgatattattcatgtgggtggccaaactcgtatgccacttgtacaacaaaaagttgctgagttctttggtaaagaagcgcgtaaagatgtaaaccctgatgaagcggtggcaatcggtgcggcagttcaaggtggtgtattaaaaggtgatgtgaaagatgttcttttattagacgtaactccattatctttaggtatcgaaaccatgggcggtgtgatgaccactttaattgagaaaaataccactattccaactaaaaaatcgcaagtattctcaacagcagaagataaccaaagtgcggtaactattcacgttcttcaaggtgaacgtaaacgtgcggcagacaataaatctttaggtcaattcaatctagaaggtattaatcctgcaccgcgtggtatgccacaaattgaagtaacatttgatatcgatgcaaacggcgtaatcaacgtatcagcaaaagataaaaatacgggtaaagagcaacaaattcgtattcaagcatcatctggtttatctgatgaagaaattcaacaaatggtgcgtgatgcagaagcaaatgctgatgcagaccgtaaatttgaagaagttgttcaagctcgtaaccaagcagatggtattgctcacgcaacacgtaaacaaattgcagaagctggcgatgcattgagtgtcgcagacaaagagaaaattgaagctgcagtcgctgagcttgaaacagcagcaaaaggcgaagataaagcagaaattgaagcaaaaattgaagcggtaattaaagcctctgaaccattaatgcaagcagtgcaagcaaaagctcaacaagctggtggcgagcaaccacaacaatcatcagcaaaagatgatggcgtggtagatgctgaatttgaagaagtgaaagataataaa

SEQ ID NO: 2972 - protein, 320 aa, Haemophilus influenzae
  Name: NTH1650
LSLVKAVLKDADKGVSEIHDIIHVGGQTRMPLVQQKVAEFFGKEARKDVNPDEAVAIGAAVQGGVLKGDVKDVLLLDVTPLSLGIETMGGVMTTLIEKNTTIPTKKSQVFSTAEDNQSAVTIHVLQGERKRAADNKSLGQFNLEGINPAPRGMPQIEVTFDIDANGVINVSAKDKNTGKEQQIRIQASSGLSDEEIQQMVRDAEANADADRKFEEVVQARNQADGIAHATRKQIAEAGDALSVADKEKIEAAVAELETAAKGEDKAEIEAKIEAVIKASEPLMQAVQAKAQQAGGEQPQQSSAKDDGVVDAEFEEVKDNK

SEQ ID NO: 2973 - DNA, 981 bp, Haemophilus influenzae
  Name: NTH1651
atgggaaaaattattggtattgacttaggtacaacaaactcttgtgtagctgtaatggacggcgataaagcgcgcgtaattgaaaatgcagaaggggcacgtactactccgtcaatcattgcatatacagataatgaaaccttagttggtcagccagcaaaacgtcaagcaatcactaacccaaaaaatacattgtttgcgattaaacgtttaattggtcgtcgttttgaaagtgaagaagttcaacgcgatattaaaattatgcctttcgaaattactcgtgccgacaatggcgatgcttgggtaaacgtgaaaggtgataaattagccccaccgcaaatttcagcagaagtgttgaaaaaaatgaaaaaaactgcagaagatttcttgggtgaatctgtaactgaagcagtaattactgtgcctgcatacttcaacgacgcacaacgtcaagcaacgattgatgcaggtaaaatcgcaggtttagatgttaaacgtatcattaatgaaccaacagcggctgcgttagcgtttggtttaggttcaagcaaagagaaccaagtgatcgctgtttatgacttaggtggtggtacatttgatatttcaatcatcgaaattgataactttgatggcgaacaaactttcgaagtattggcaaccggtggtaacactcacttaggtggtgaagactttgataaccgtgtaattgattacattattgatgagttcaaaaaagaacaaaatatcgatttacgtaatgatgcaatggcattacaacgtgtgaaagaagctgcagagaaagcaaaaattgaactttcatcagctcaatctactgaagtgaaccttccgtacatcactgcagatgcgacaggtcctaaacacttagcattaaatatcactcgtgcaaaattagaagcattagtagaagatttagtggcaagctcaattgagtctagtgaaagcggtattaaaagatgcaga

SEQ ID NO: 2974 - protein, 327 aa, Haemophilus influenzae
  Name: NTH1651
MGKIIGIDLGTTNSCVAVMDGDKARVIENAEGARTTPSIIAYTDNETLVGQPAKRQAITNPKNTLFAIKRLIGRRFESEEVQRDIKIMPFEITRADNGDAWVNVKGDKLAPPQISAEVLKKMKKTAEDFLGESVTEAVITVPAYFNDAQRQATIDAGKIAGLDVKRIINEPTAAALAFGLGSSKENQVIAVYDLGGGTFDISIIEIDNFDGEQTFEVLATGGNTHLGGEDFDNRVIDYIIDEFKKEQNIDLRNDAMALQRVKEAAEKAKIELSSAQSTEVNLPYITADATGPKHLALNITRAKLEALVEDLVASSIESSESGIKRCR

SEQ ID NO: 2975 - DNA, 942 bp, Haemophilus influenzae
  n 933, 934, 935, 936, 937: n is any nucleotide
  Name: NTH1652
atgaaaaaatcaaaaattgctgcaggcgtagtcatttctcttgctgccgtttggtgtgcaggtgcatggtttacagggaaaaaagctgaagaagaatatttacatcaactaaaacagttaaatcaactatttaccaaaactgaggcattagaagaaagtaaaattttttataaaaatataaaatttgaaagaggattatttgcctctcacattcaagatcaaatagaaattcacaaggcaaatgaaacgatcattattcctttatcatcaacactttatcacgggcctttgccgcttgatcgtgtggcaaaactgaatttcgttccagccattttttcaagccaaacattgttaggaaaaaatgcaacaactcaggcattctttgatatcacagaatcagagaaaccgttacaactgaatttcgcaatgaattattcattaagcggtaatgcggaattaaaacttgcatcggggcaatatcacaatgagcaatctaagacagattttgattggtcaaatgtcgtattaaatattgatttaaaccaaaatacaccaaataactatgtgctatctgtcgatacatttaattcaaatgcccctaatcatgcagtttcaaccgcttcatcaattaaaataaaagatcttgtcgtacaaggctcgttgcaaagcacaaaatggccatttatttatagtgggaatatcaatagtaaaataggctattttgagcaaaataccgaatctccagagactggcgaaaaattctctcttattcagaaaaatagccaagcaaatttaactacacaagttgagggtgatacagtaaatatcatcaataaaacgaatctggatgaattacatattaacggtaacaacttaggtaaagtgaccaacaatgtagaatccaaccgggtaccgagtccgaatcgtaaacannnnnttaat

SEQ ID NO: 2976 - protein, 314 aa, Haemophilus influenzae
  Xaa 311, 312, 313: Xaa is any amino acid
  Name: NTH1652
MKKSKIAAGVVISLAAVWCAGAWFTGKKAEEEYLHQLKQLNQLFTKTEALEESKIFYKNIKFERGLFASHIQDQIEIHKANETIIIPLSSTLYHGPLPLDRVAKLNFVPAIFSSQTLLGKNATTQAFFDITESEKPLQLNFAMNYSLSGNAELKLASGQYHNEQSKTDFDWSNVVLNIDLNQNTPNNYVLSVDTFNSNAPNHAVSTASSIKIKDLVVQGSLQSTKWPFIYSGNINSKIGYFEQNTESPETGEKFSLIQKNSQANLTTQVEGDTVNIINKTNLDELHINGNNLGKVTNNVESNRVPSPNRKXXXN

SEQ ID NO: 2977 - DNA, 1233 bp, Haemophilus influenzae
  Name: NTH1653
ttggggggcgttaatcgttgctattcttcctcatttatgaaaaaagtctcaccagcttatggtatgttggtgggagctttggttggagggttaattggtggtgcggatttatcgcaaacagtgagcctaatgatcggtggcgcacagggtattactactgcagttatgcgtatcttagctgctggtgtgttggcaggcgtgctgattgaatcgggtgcagcaaattccatcgcggaaaccattactaataaattgggtgaaactcgagctttactcgccttggcactagcgacgatgattttaactgcggtgggtgtgttcgtggatgtggcagtgattactgtttcaccaattgctttagcgttatcgcgtcgcagcgatttatcgaaagctgcaattttgctcgccatgattggcggtggtaaagctggtaatattatgtcgccaaacccaaatgccattgcggcagcagatacttttcatttgccactcacttcagtgatgatggctggtataattcccgcgctatttggtttgattctcacctacttcttagcaaaacgcttaatcaacaaaggttctaaagtgactgacaaagaggtaatcgtgcttgaaacgcaaaatttaccttcatttctgaccgcacttgtcgcacctttagtggcaattttgctattggcacttcgtccattgtttgatattaaagttgatccattaattgcattgccgttaggtggtttgattggtgcgctttgtatgggcaaacttcgcaatataaatagttatgctatcaatggattgagtaaaatgacacccgtggcaattatgttacttggtacaggcgcgcttgctggcatcattgctaattctggtttaaaagaagtattgattcaaggtttggaacattcaggtttgccatcatacattcttgcaccaatttcaggggtgttgatgtctttagcgacagcttctaccacggcaggtactgcggtggcatccaatgtgttcagtagtaccttgttagaacttggagttagcagtcttgctggtgcagcaatgattcatgcaggggcgaccgtatttgatcatatgccacatggttctttcttccatgccacaggcggtagtgtgaatatggatatcaaagaacgtttaaaacttattccttatgaaagtgcggtcggtttgatgatgaccatcgtttctaccttaatttttggcgtatttaaattc

SEQ ID NO: 2978 - protein, 411 aa, Haemophilus influenzae
  Name: NTH1653
LGGVNRCYSSSFMKKVSPAYGMLVGALVGGLIGGADLSQTVSLMIGGAQGITTAVMRILAAGVLAGVLIESGAANSIAETITNKLGETRALLALALATMILTAVGVFVDVAVITVSPIALALSRRSDLSKAAILLAMIGGGKAGNIMSPNPNAIAAADTFHLPLTSVMMAGIIPALFGLILTYFLAKRLINKGSKVTDKEVIVLETQNLPSFLTALVAPLVAILLLALRPLFDIKVDPLIALPLGGLIGALCMGKLRNINSYAINGLSKMTPVAIMLLGTGALAGIIANSGLKEVLIQGLEHSGLPSYILAPISGVLMSLATASTTAGTAVASNVFSSTLLELGVSSLAGAAMIHAGATVFDHMPHGSFFHATGGSVNMDIKERLKLIPYESAVGLMMTIVSTLIFGVFKF

SEQ ID NO: 2979 - DNA, 1134 bp, Haemophilus influenzae
  Name: NTH1654
atgaaatttgtgattgcacctgattcttttaaagaaagtttgaccgcacttgaagtcgctaccgccattgaaacaggcttcaaacgtgtattccccgatgcggactatgtaaaattgccaatggcagatgggggcgaaggtacagttcaatcccttgtggatgccacgcaaggcaagctcattgaatgtgaagtcaccgcgcctttgggtgacaaagtgaaaagtttcttcggtttatcgggagatggaaaaaccgcgattatcgaaatggcagcagcttctggtttacatcttgttccgcctgaaaaacgcaatcccttgcttaccaccagttacggcacaggggagttgattaaattggcattagatttaggcgtagagagtttcattcttggcattggcggtagcgcaaccaacgatggtggtgtaggaatgttgcaagctctagggatgcaatgtttagattcgcaagataagcctatcggttttggtggagcagagctagcaaatattgtgaagattgacgttcaacaattagatccacgtttgcaacaagttcacattgaagtagcgtgcgatgtgaataatccgctctgtggtgaatgtggtgcatctgccatttttggaccacaaaaaggcgcaacgcctgaaatggtgaaacaacttgatgctgcactttcgcattttgctgaaattgccgaacgcgattgcggtaaacaaattcgtgatcaggctggcgcaggtgctgctggtggtatgggtggtggcttgctattattaccaagcgtacaactgaaagcaggcatacaaattgtgttagagcggttacatttaattgaccatgtaaaagatgctgatgtagtgattacgggtgaagggcgaatagatgcacaaagtattatgggtaaaacgccaattggtgtggcacgtacggcaaaacagttcaataagccagtgatcgccatcgcagggtgtttgcgtgaagattatgatgtggtgtttgatcacggtattgatgcggtgttccctattattcaccaacttggcgatttatcggatattctcaaacaaggcgaacaaaatttaatttctaccgctcaaaatgtggcgagagtactggcatttaaatttcat

SEQ ID NO: 2980 - protein, 378 aa, Haemophilus influenzae
  Name: NTH1654
MKFVIAPDSFKESLTALEVATAIETGFKRVFPDADYVKLPMADGGEGTVQSLVDATQGKLIECEVTAPLGDKVKSFFGLSGDGKTAIIEMAAASGLHLVPPEKRNPLLTTSYGTGELIKLALDLGVESFILGIGGSATNDGGVGMLQALGMQCLDSQDKPIGFGGAELANIVKIDVQQLDPRLQQVHIEVACDVNNPLCGECGASAIFGPQKGATPEMVKQLDAALSHFAEIAERDCGKQIRDQAGAGAAGGMGGGLLLLPSVQLKAGIQIVLERLHLIDHVKDADVVITGEGRIDAQSIMGKTPIGVARTAKQFNKPVIAIAGCLREDYDVVFDHGIDAVFPIIHQLGDLSDILKQGEQNLISTAQNVARVLAFKFH

SEQ ID NO: 2981 - DNA, 711 bp, Haemophilus influenzae
  Name: NTH1655
atgaatatccagcataatctcaacctaattcagcaaaaaattgaaacggcttgtaaagaagaaaatcgcaatcaaaataccgtaaaattacttgccgtatctaagaccaaacctatttccgagattctttcagcttatcaagcgggacaaacggcttttggggaaaattacgtgcaagagggggtagaaaagatccaatattttgaatcgcaaggagttaaccttgaatggcattttatcggcccattacaatcgaataaaacccgtctcgttgcagaacattttgattggatgcaaacgcttgatcgagcaaaaattgcagatcgtttaaatgaacaacgaccgaccaacaaggctccattgaatgtattaattcagattaatatcagcgatgaagaaagtaaatcaggtattcaacctgaggaaatgctaacactagcaaaacacatcgaaaatttaccgcacttatgcctacgtggcttaatggcaatacccgcaccaaccgataaaatcgctgaacaagaagccgtgttcagaaaaatgtcagacctatttgaacaactgaaacaagccttacccaatcaacaaattgatacactttctatgggaatgacggatgatatgccgagcgcaataaaatgcggttctacaatggtacgcattggcactgcgatttttggtgcgagaaattattcaacatcacaaaataaa

SEQ ID NO: 2982 - protein, 237 aa, Haemophilus influenzae
  Name: NTH1655
MNIQHNLNLIQQKIETACKEENRNQNTVKLLAVSKTKPISEILSAYQAGQTAFGENYVQEGVEKIQYFESQGVNLEWHFIGPLQSNKTRLVAEHFDWMQTLDRAKIADRLNEQRPTNKAPLNVLIQINISDEESKSGIQPEEMLTLAKHIENLPHLCLRGLMAIPAPTDKIAEQEAVFRKMSDLFEQLKQALPNQQIDTLSMGMTDDMPSAIKCGSTMVRIGTAIFGARNYSTSQNK

SEQ ID NO: 2983 - DNA, 93 bp, Haemophilus influenzae
  Name: NTH1656
atgcgtaaagaaataccgaaatttcccgagcttgtcaaacagaaagtgacaaatttttcagaaattttcttagtcaataaatttcgtgtaaac

SEQ ID NO: 2984 - protein, 31 aa, Haemophilus influenzae
  Name: NTH1656
MRKEIPKFPELVKQKVTNFSEIFLVNKFRVN

SEQ ID NO: 2985 - DNA, 90 bp, Haemophilus influenzae
  Name: NTH1657
ttgactaagaaaatttctgaaaaatttgtcactttctgtttgacaagctcgggaaatttcggtatttctttacgcattcatttttcaaga

SEQ ID NO: 2986 - protein, 30 aa, Haemophilus influenzae
  Name: NTH1657
LTKKISEKFVTFCLTSSGNFGISLRIHFSR

SEQ ID NO: 2987 - DNA, 120 bp, Haemophilus influenzae
  Name: NTH1658
ttggttattttggctggtgcagataaaacacctgcagcctgctcttctaaagagcttgttcgatcaatttcgccgcttgggaaaaacgttccggatttgcaagcgaagtgccgccaaatt

SEQ ID NO: 2988 - protein, 40 aa, Haemophilus influenzae
  Name: NTH1658
LVILAGADKTPAACSSKELVRSISPLGKNVPDLQAKCRQI

SEQ ID NO: 2989 - DNA, 807 bp, Haemophilus influenzae
  n 794, 795, 796, 797, 798: n is any nucleotide
  Name: NTH1659
atgcaatccattcctatcaagaacgtaggagagtctcgcttagtcgatcctttccaacgtcaatattactatctacgactgtcgattactgatcagtgtaattttcgttgtacctattgtttacctgatggttatcaacccgaagctaacaaaccaagtttcttaaccttaaaagaaattatccatcttgctcaagcgtttgctgaaatgggcacagagaaaatccgtttaacgggtggcgaaccgactttacgcaaagattttatttctattgccgaaagcattgctaacattgatggcattcgtcaattagccgtcacgacaaacggctatcgcatggcaaaagatgtggctgattggaagcaagcagggattacgtctattaacgttagtgttgatagccttgatccgaaaatgttccatcaaattacaggtatcaataaatttgatgacgtgatgcgtggtatcgatcgtgcatttgaagtgggttacaataaagtcaaagttaattcagttttaatgaaaaatctgaatgacaaagagtttgagcaattccttgcttgggtaaaacatcgcccaattcaaatgcgctttattgagttgatgcaaacgggcgaaatggatagtttctttgatagataccatctttctggacaaatcttagcggataaattgctgaaaaatggttggacattacagcataaatcccacacggatggccctgctaaagtctttacacatcctgattatgcgggcgaaattggtttaattatgccttatgaaaagaattttgnnnnnttaattaat

SEQ ID NO: 2990 - protein, 269 aa, Haemophilus influenzae
  Xaa 265, 266: Xaa is any amino acid
  Name: NTH1659
MQSIPIKNVGESRLVDPFQRQYYYLRLSITDQCNFRCTYCLPDGYQPEANKPSFLTLKEIIHLAQAFAEMGTEKIRLTGGEPTLRKDFISIAESIANIDGIRQLAVTTNGYRMAKDVADWKQAGITSINVSVDSLDPKMFHQITGINKFDDVMRGIDRAFEVGYNKVKVNSVLMKNLNDKEFEQFLAWVKHRPIQMRFIELMQTGEMDSFFDRYHLSGQILADKLLKNGWTLQHKSHTDGPAKVFTHPDYAGEIGLIMPYEKNFXXLIN

SEQ ID NO: 2991 - DNA, 471 bp, Haemophilus influenzae
  Name: NTH1660
atgtcttttgcccaacaaaaacttagcgaactcgctgtttcaattccaggtgcaactaaaatttttcgtgaatatgatttagatttttgctgcggaggttctgtattattagaagtcgcagcacaacaaaagaatcttaaccttgctgaaattgaaaaacgtttaactgatttacaacaaaataaagcagaaaataatgataaagattggacttcggcatcttatgcggagatgatcgatcacattattactcgttttcataatcgccaccgtgaacaactccctgaattaattacattggcggagaaagtagaaaatgtacatagtgatcgtgatgactgtcctatcggcgtaaccgcacagttagaaaaaatttatgctgaacttagccagcatttaatgaaagaagaacaaattttgttcccaatgatcaaaatgggaattatgctatggcctcaatgccaattcgtg

SEQ ID NO: 2992 - protein, 157 aa, Haemophilus influenzae
  Name: NTH1660
MSFAQQKLSELAVSIPGATKIFREYDLDFCCGGSVLLEVAAQQKNLNLAEIEKRLTDLQQNKAENNDKDWTSASYAEMIDHIITRFHNRHREQLPELITLAEKVENVHSDRDDCPIGVTAQLEKIYAELSQHLMKEEQILFPMIKMGIMLWPQCQFV

SEQ ID NO: 2993 - DNA, 219 bp, Haemophilus influenzae
  Name: NTH1661
atggcctcaatgccaattcgtgtaatggaaatggaacacgatgaagcgggacaagatgtggaagtgatcaaatcacttactaacaattgcacgccacctgcagatgcttgtttcagttggaaagctttatatagcggtattaatgaatttattgatgatttaatgcaccatattcatttggaaaataatattttatttccacgtgtattaaacgaaaaa

SEQ ID NO: 2994 - protein, 73 aa, Haemophilus influenzae
  Name: NTH1661
MASMPIRVMEMEHDEAGQDVEVIKSLTNNCTPPADACFSWKALYSGINEFIDDLMHHIHLENNILFPRVLNEK

SEQ ID NO: 2995 - DNA, 1011 bp, Haemophilus influenzae
  Name: NTH1662
atgcctaatttttcattcgtatttttttatgattccgctaaaataacgccaatttcaaccgcacttttaggaagaaaaatgaactatctaaaaattgcacaggattccctttcagtggaaagtaacgcacttttgcaactcagccagcgtttaggcgaggattttaatcaagtcatcgatcttattttagcctgcgaaggacgtttggtaatcggagggataggaaaatcgggtttaatcggcaaaaaaatggtggctacctttgcctctacgggtacaccaagtttctttttacatcctacagaagccttccacggcgatttaggtatgttaaaaccaattgatatcgtgatgttaatttcctatagcggtgaaaccgatgatgtcaataaactgattccaagtttaaaaaatttcggtaataaaattattgctgtgacgagtaacaaaaattccacgctcgcacgccatgcagattatgttctagatataactgttgagcgtgaagtgtgtccaaataatctcgcgccaacaacatccgcacttgtcacactggcacttggtgatgcactcgccgtatcgcttattacggcacgcaatttccaaccagctgactttgctaaattccatccaggtggcagtcttggtcgtcgtttattatgtaaagtgaaagatcaaatgcaaactcgcctaccaaccattttacccaataccaattttacagattgtctgaccgtgatgaatgaagggcgaatgggcgttgccttagtgatggaaaatgaacaacttaaaggcattatcactgatggcgatattcgccgcgcgcttacagccaatggtgcagaaacactgaataaaacagccaaagactttatgacaagttcaccaaaaactattcatcaagacgaatttttatcaaaagcagaagactttatgaaagcgaaaaaaattcactcgctagtggttgttaatgatgaaaatcacgtggtgggtttagtggaattttcaagc

SEQ ID NO: 2996 - protein, 337 aa, Haemophilus influenzae
  Name: NTH1662
MPNFSFVFFYDSAKITPISTALLGRKMNYLKIAQDSLSVESNALLQLSQRLGEDFNQVIDLILACEGRLVIGGIGKSGLIGKKMVATFASTGTPSFFLHPTEAFHGDLGMLKPIDIVMLISYSGETDDVNKLIPSLKNFGNKIIAVTSNKNSTLARHADYVLDITVEREVCPNNLAPTTSALVTLALGDALAVSLITARNFQPADFAKFHPGGSLGRRLLCKVKDQMQTRLPTILPNTNFTDCLTVMNEGRMGVALVMENEQLKGIITDGDIRRALTANGAETLNKTAKDFMTSSPKTIHQDEFLSKAEDFMKAKKIHSLVVVNDENHVVGLVEFSS

SEQ ID NO: 2997 - DNA, 399 bp, Haemophilus influenzae
  Name: NTH1663
atggatgcaggtattcaagtggcagtgctttctggtcgcgactcccctattttacgtcgtcgcattgccgatcttggtattaaattattctttcttggcaaacttgaaaaagaaaccgcttgttttgatcttatgaaacaagcaggcgtcactgccgatcagaccgcttatattggcgatgatagtgtagatctccccgcctttgctgtttgtggtgcttcttttgcagtggctgatgcccctatttatgtgaaaaatactgttgatcatgtactttccaccaatggcggcaaaggggctttccgtgaaatgtccgatatgattttacaagcgcagggaaaatcctctgtgtttgataccgcccaaggtttcctaaaatcagtgaaaaatatggggcaa

SEQ ID NO: 2998 - protein, 133 aa, Haemophilus influenzae
  Name: NTH1663
MDAGIQVAVLSGRDSPILRRRIADLGIKLFFLGKLEKETACFDLMKQAGVTADQTAYIGDDSVDLPAFAVCGASFAVADAPIYVKNTVDHVLSTNGGKGAFREMSDMILQAQGKSSVFDTAQGFLKSVKNMGQ

SEQ ID NO: 2999 - DNA, 1593 bp, Haemophilus influenzae
  Name: NTH1664
gtgaaaaaacttatcaaacgccgtgaaattccagttggaaattctgtttcaaaccatcccttattagatcgcctttatcgtgctcgtcatattaaaaacaccaaagaattagaccgcactttgaaatcaatgctcaatccaaatcaattatatggcattgatcaagctgtaaatttattagttgaagcctatcaacaacagcaaaaaattgtgattgttggggattttgatgctgacggtgcaaccagcacagcattgagtgtgctggctttaagacaacttggcttttctgatgtggattaccttgtgccaaatcgatttgaacaaggttatggcttgagtattcctgtggctgaaatggcgattgaaaagggcgttcagcttttaatgacggtggataatggcgtttcgtcttttgacggtgtggcatttttgaaagaaaaaggcattcgagttttagtcacggatcatcatttaccccccgaaactttgccgccagccgatgctattgttaatcctaatttaagtcagtgtcatttcccttcaaaatccttggcaggtgtgggtgtggcattttatttgatgttagccgtacgagcaaaatttcgtgaactcggtatttttacggcagaaacacaacctaattttactgatttgctcgatctggtggcactaggcactatagctgatgttgtgcctttagatcaaaataatcgtatccttgcttatcaaggtttaatgcggattcgtgcacggcgttgccgtcccggtattgttgcgttggcagaagtggctaaccgtaacgtagagcagtttacttcaagtgatctcggtttttgtattgggccgcgtttaaatgcagcagggcgtttagataatatgtcgattggggtagagcttttgctggcgaacgaaatgtcaaaagctagagaattagctttagatctcgatcagcttaaccaaactcgtaaagaaattgaagcaggtatgaagcttgaggcaataaaaatttgtcaaaatcttaccgcactttttaaagagttaccctatggtattacgctttatcaacctgattggcatcaaggcgtattaggcattgtatcatcaaggattaaggatcaatatcatcgtccagtgattgcctttgcacaagatagtgagggaattttgaaaggttctgctcgttctattgaaggtttacatatgcgtgatgttctggagcgtattcattcgcaacatcctaatatgattttaaaatttggcggacacgcaatggcggcaggcttgagtattcgcgaagaacattttgccgatttccaacatatttttaatcaaaccgttgccgattggcttgatgaagaacatatgcaaagcataatttggacagatggcgaactaaattcaaatgaatttaatcttgaaacggcagagctgataaaatcggtaggcacttgggggcaagagtttcctgagccttgctttgatggcgaatttaaaattttagaccagcgcgcaattgggcaaaataaaaatcatctaaaaatgttgctagaaccgaaacaagggcggggttttattagatgcgattgcatt

SEQ ID NO: 3000 - protein, 531 aa, Haemophilus influenzae
  Name: NTH1664
VKKLIKRREIPVGNSVSNHPLLDRLYRARHIKNTKELDRTLKSMLNPNQLYGIDQAVNLLVEAYQQQQKIVIVGDFDADGATSTALSVLALRQLGFSDVDYLVPNRFEQGYGLSIPVAEMAIEKGVQLLMTVDNGVSSFDGVAFLKEKGIRVLVTDHHLPPETLPPADAIVNPNLSQCHFPSKSLAGVGVAFYLMLAVRAKFRELGIFTAETQPNFTDLLDLVALGTIADVVPLDQNNRILAYQGLMRIRARRCRPGIVALAEVANRNVEQFTSSDLGFCIGPRLNAAGRLDNMSIGVELLLANEMSKARELALDLDQLNQTRKEIEAGMKLEAIKICQNLTALFKELPYGITLYQPDWHQGVLGIVSSRIKDQYHRPVIAFAQDSEGILKGSARSIEGLHMRDVLERIHSQHPNMILKFGGHAMAAGLSIREEHFADFQHIFNQTVADWLDEEHMQSIIWTDGELNSNEFNLETAELIKSVGTWGQEFPEPCFDGEFKILDQRAIGQNKNHLKMLLEPKQGRGFIRCDCI

SEQ ID NO: 3001 - DNA, 117 bp, Haemophilus influenzae
  Name: NTH1665
ttgtatcctgatctttcaattaaacaggctcgtttagcctataaattagatattaacgaatttcgtggcaatcgtagcctacaattattggtagattatattgagccgatagatgag

SEQ ID NO: 3002 - protein, 39 aa, Haemophilus influenzae
  Name: NTH1665
LYPDLSIKQARLAYKLDINEFRGNRSLQLLVDYIEPIDE

SEQ ID NO: 3003 - DNA, 705 bp, Haemophilus influenzae
  Name: NTH1666
atgagtgatagaatgaaattaaagggaatattggcattttgtttgctttttttatcgtcgtttgttttagcagaagtcaatcagaaagaattttcagtgcaaaattctccgcacttgccatcaagggacacaatctattttgaagacgggcgtgattatttttcttataaagaacctattgaacaagtgtctcgagcggataaaaaaatccgcattcaattcttttttgattatgattgtcgagtgtgttcttcagcgcaggatattttagaactttatagccaaatacgcacatataaagttgtgttggaacaatatcctattgcaactgccgatagccagtttagcgcacgtattttttatactttgcaagcattaagtgcgagcgaattatccaatgttttgttatttgaaacttcagaaaaatcccgttatacagaattgtccacatcaaataaaattcagcaatgggcggaagaacaagggctagataagcagttatttattcaaactgaaaattcacaaagcgtaaaagaacagatccaaaatgcgattgaattgacggaagaatatggtgtttttacctatccttacgttgttatcggtggaaaatatgtactcactgcaagtacgctttataacgatgattatagcgtagcagtgttagattttttggtaaataaaatagaacaggaacaaaaacaa

SEQ ID NO: 3004 - protein, 235 aa, Haemophilus influenzae
  Name: NTH1666
MSDRMKLKGILAFCLLFLSSFVLAEVNQKEFSVQNSPHLPSRDTIYFEDGRDYFSYKEPIEQVSRADKKIRIQFFFDYDCRVCSSAQDILELYSQIRTYKVVLEQYPIATADSQFSARIFYTLQALSASELSNVLLFETSEKSRYTELSTSNKIQQWAEEQGLDKQLFIQTENSQSVKEQIQNAIELTEEYGVFTYPYVVIGGKYVLTASTLYNDDYSVAVLDFLVNKIEQEQKQ

SEQ ID NO: 3005 - DNA, 690 bp, Haemophilus influenzae
  Name: NTH1668
atgaaaataggaattgttggtgcaatggcacaagaagtcgaaattttaaaaaatttaatggctgatagaacggaaactcgagtagcaagtgcggtcatttttgaaggcaaaattaatggtaaagatattgcattattgcaatcaggcattggcaaagtggcagctgcaattggcacgacggcgttattgcaattagccaagccagattgtgtgatcaatactggttctgcaggtggggtagcaaaaggcttgaaagtgggggatattgtgatttctgatgaaacacgctatcacgatgcggatgtgacagcttttggctatgaaaaagggcagttgcctgctaatcctgctgcatttttatcggataaaaaattggcagatctcgctcaagaaatggcagaaaagcaagggcaatcagtaaaacgtggtttaatttgttctggcgatagttttattaatagcgaagacaaaattgcacaaattcaagcagatttcccgaatgtaatgggcgttgaaatggaagccacagcgattgcacaagtttgttatgcttttaatgtgccttttgtggtggttcgtgctatttctgatggcggcgatggcaaagcaagtatgtcttttgaagagtttttaccattggcggcgaagcagtcttcggcattagtattagggatgattgacagactgtcg

SEQ ID NO: 3006 - protein, 230 aa, Haemophilus influenzae
  Name: NTH1668
MKIGIVGAMAQEVEILKNLMADRTETRVASAVIFEGKINGKDIALLQSGIGKVAAAIGTTALLQLAKPDCVINTGSAGGVAKGLKVGDIVISDETRYHDADVTAFGYEKGQLPANPAAFLSDKKLADLAQEMAEKQGQSVKRGLICSGDSFINSEDKIAQIQADFPNVMGVEMEATAIAQVCYAFNVPFVVVRAISDGGDGKASMSFEEFLPLAAKQSSALVLGMIDRLS

SEQ ID NO: 3007 - DNA, 1695 bp, Haemophilus influenzae
  Name: NTH1670
ttgcaatcacgctcgcgtagccatttattaaaatttgaatatggcgatgatcaccaaaatttaggagcacaaatacgtacattggataataaaattggttctcgcaaaattgaaaaccgtaattaccaagtcaattataacttcaataataacaactatctcgatcttaatttaatggctgcacataacattggtaaaaccatttatcctaagggtggtttttttgctggctggcgagtggcagacaaacttattaccaaaaatgtggcaaatattgttgatataaacaacagccatactttcttgttgccaaaagaaatcgatttaaaaaccacattaggttttaactattttaccaatgaatacagtaaaaaccgttttccagaagaattaagtttgttttataacgatgattcacatgatcaaggtaactatagtaatttaggacgatttagaggtaatcgtaatttactgccacaacgttcagtgattttacaaccttctggcaagcaaaaatttaaaacggtgtattttgataccgcactttctaaaggtatttaccatttaaattacagcgtgaattttacccattatgcgtttaatggtgagtatgttggatatgaaaatacagcgaatcaaattaatgaaccgattttgcataaatcagggcataaaaaggcattcaatcattccgctacattaagtgcagagctaagcgattattttatgccatttttcacttattcacgcacacacagaatgccgaatattcaagagatgtttttctctcaagtgtctaatgcaggggtaaacacggcattaaaacctgaacaatctgatacctatcaactaggctttaatacttataaaaaaggtctcttcactcaagacgatgtgctaggcatcaaattagtgggttatcgtagctttattaaaaactatatccataatgtttacggtgtttggtggcgagatggcgttgtacctacgtgggcagacagtactggttttcgctttactatcgcacatcaaaattatcaacctatcgtgaaaaaaagcggggcggagttagagcttaattatgatatgggacgtttttttgcgaatgtctcttacgcttatcaacgtactaatcagccaaccaattatgccgatgccagctcacgtccgaataatgcttcaaaagaagacattttgaaacaaggttatggcttatctcgtgtttcaatgctaccaaaagactacggcagattagagattggtacacgttggtttgatcaaaaattaaccttaggtatggcagctcgttattatggaaaaagtaaacgtgcgacaattgaagaagaatatatcaatggatctcactttgaattaaagacctcaggtaaaagaacttactacgttgtgaaaaaaacagaagagattaaaaaacaaccgattattttagatttacacgtcagctatgaaccaatcaaagatttgattattaaagcggaagtacaaaatctattagataaacgttatgttgatccgttagatgctggaaatgatgcggcttcgcaacgttattattcaagtttaaatgattcaatttgtagtaaaagtcaggattgtgaagatggaggaaaagataaaaccgtgctttataactttgcacgtggaagaacttatattctgagtttaaactataaattc

SEQ ID NO: 3008 - protein, 565 aa, Haemophilus influenzae
  Name: NTH1670
LQSRSRSHLLKFEYGDDHQNLGAQIRTLDNKIGSRKIENRNYQVNYNFNNNNYLDLNLMAAHNIGKTIYPKGGFFAGWRVADKLITKNVANIVDINNSHTFLLPKEIDLKTTLGFNYFTNEYSKNRFPEELSLFYNDDSHDQGNYSNLGRFRGNRNLLPQRSVILQPSGKQKFKTVYFDTALSKGIYHLNYSVNFTHYAFNGEYVGYENTANQINEPILHKSGHKKAFNHSATLSAELSDYFMPFFTYSRTHRMPNIQEMFFSQVSNAGVNTALKPEQSDTYQLGFNTYKKGLFTQDDVLGIKLVGYRSFIKNYIHNVYGVWWRDGVVPTWADSTGFRFTIAHQNYQPIVKKSGAELELNYDMGRFFANVSYAYQRTNQPTNYADASSRPNNASKEDILKQGYGLSRVSMLPKDYGRLEIGTRWFDQKLTLGMAARYYGKSKRATIEEEYINGSHFELKTSGKRTYYVVKKTEEIKKQPIILDLHVSYEPIKDLIIKAEVQNLLDKRYVDPLDAGNDAASQRYYSSLNDSICSKSQDCEDGGKDKTVLYNFARGRTYILSLNYKF

SEQ ID NO: 3009 - DNA, 1704 bp, Haemophilus influenzae
  Name: NTH1671
ttggtaattcaagattttcctttagaaccagtggatttctgggcgttacaaccgaatgctacacagggtatcgatttatttttacgtcatccgacacgttccttactaatgatgaaagtgggcgaacctgttgaatatgcggagttattacaaaattttatatcgcaaaatcatcataaagtgcggtcaatttttggtgtaaattatgtgatagagcagggcgactctttttcttttcctcatgtttatactgagccagcaaaatctttagatgataattttgctagtcaaggagaggcgttaagtgcattgtattgcgatcaattccagcttttcggtagttttcggattcatccaagttcacaagatattcaattagtgccgggattggtgcataaggctaatggtggcgttttgattttaagtgcggcaacattgttatctcaatttgatttatgggggcgattaaaacaaattctgcaaacccagacttttgactggtattcagcccatccatttaaaaatttaccttgtgatataccaagctatgcgctgaacttaaaagtgattgtacttggtaatcgtactgaattagccactttggctgagttagaagaaaatctttattctttcgccgattatgctgaaattgaaagttatatttctgtagctgaagtggaggaacaaaaaacttgggcgagttatgtacaacaaatggctcaagagcaaaatattgagctagattttcttgctttaaataaactctatcaattattagttcgtgaaagtgaaaatcgctttttaattaatgcatctcctctcaaattaaaagaaatattacaggatgcttcaacttttgctgaaaaaactgcattaagtgcggtggattttgagggtatttttcaacaaaaattagcacaatatggtttcttaaaagaacaaacttatgccgatattttaaacgagcaagtttatgtcgaaacgcaaggcgaaattgttggacaaattaatgggctttcggtaattgaatatcctggtacgccagtatgtttcggcgaaccttcgcgtattagttgtattgtgcaatttggcgatggggaagtgattgatgttgaaagaaaaaatgaactagcgggaaatattcacggtaaaggcatgatgattgcgcaagcttgcctttccaatatcttagatttgccctcgcaattgccattttctgcctcattagtgtttgaacagtcttatggtgaaattgatggtgatagtgcatctttggcgattttctgtgtgctagcaagcgctttagctgatttgcctttgcctcaacatatcgcaattacaggatcgattgatcaatttggacttgttcattctgttggtggtgtaaatgataaaattgaaggcttttttactatttgccaacgtcgcggtttgactggaaaacaaggtgtaatcattccaatgacgactattcagcaactgagtttgtctaatgaagtgaaaagtgcggtaaaaaatggcgagttttttatttatcctgtggaagatatttatcaggcttgtgaattgttatttgggcgtgatttgttagatgaaaacaaagattatacagaaaaaactgagcctttatctcgtcttattcaacgtcgtattgagggacgtgccgattctgaacgaaaaagtttttggcattttttccgctcc

SEQ ID NO: 3010 - protein, 568 aa, Haemophilus influenzae
  Name: NTH1671
LVIQDFPLEPVDFWALQPNATQGIDLFLRHPTRSLLMMKVGEPVEYAELLQNFISQNHHKVRSIFGVNYVIEQGDSFSFPHVYTEPAKSLDDNFASQGEALSALYCDQFQLFGSFRIHPSSQDIQLVPGLVHKANGGVLILSAATLLSQFDLWGRLKQILQTQTFDWYSAHPFKNLPCDIPSYALNLKVIVLGNRTELATLAELEENLYSFADYAEIESYISVAEVEEQKTWASYVQQMAQEQNIELDFLALNKLYQLLVRESENRFLINASPLKLKEILQDASTFAEKTALSAVDFEGIFQQKLAQYGFLKEQTYADILNEQVYVETQGEIVGQINGLSVIEYPGTPVCFGEPSRISCIVQFGDGEVIDVERKNELAGNIHGKGMMIAQACLSNILDLPSQLPFSASLVFEQSYGEIDGDSASLAIFCVLASALADLPLPQHIAITGSIDQFGLVHSVGGVNDKIEGFFTICQRRGLTGKQGVIIPMTTIQQLSLSNEVKSAVKNGEFFIYPVEDIYQACELLFGRDLLDENKDYTEKTEPLSRLIQRRIEGRADSERKSFWHFFRS

SEQ ID NO: 3011 - DNA, 417 bp, Haemophilus influenzae
  Name: NTH1672
atgttgatgatggatcgtatagttgaaatgaatgaagaaacaggtgctttcggtaaaggatacattgaagccgaacttgatattaagcctgaattgccattttttggctgccatttcattggcgatccagtaatgcccggttgtttaggattggatgcgatgtggcagcttgttgggttttatttaggctggattggtggcaaaggaaaagggcgagcattaggggttggcgaagtgaaattcactgggcaaattttgccgacagcgaaaaaagtagtttacagaatccatatgaaacgagtaattaatcgtaaactagttatgggaatggctgatggcgaagttgaagtagatggtcgtgttatttataccgcgacagatttaaaagtaggactattccaagatacctcagcattt

SEQ ID NO: 3012 - protein, 139 aa, Haemophilus influenzae
  Name: NTH1672
MLMMDRIVEMNEETGAFGKGYIEAELDIKPELPFFGCHFIGDPVMPGCLGLDAMWQLVGFYLGWIGGKGKGRALGVGEVKFTGQILPTAKKVVYRIHMKRVINRKLVMGMADGEVEVDGRVIYTATDLKVGLFQDTSAF

SEQ ID NO: 3013 - DNA, 726 bp, Haemophilus influenzae
  Name: NTH1673
atgatggcaaatgatgattttcaagaatatgtgaagcaactggtaacaaaacatcgagatgaacgaatttatccttttcaatatgaaggaaaaaaatattggttgaaacaacctgaaaaattgaaagggatttggctattattaaaaccccatcctaaaaaatcttttaaaaatgaattacatactttattgaagcttgctgaacaaaatgcgccagtgccaaaagtctcttattatagtgatcatttttttgtgttggaaaatgtgggactgactgtatcacaatggctatgcaataaaaatatagatgaacaacagaaatttttaattatttatgatgcttgtctcgctttgattgatttgcacgctaaaaatttgatacacggtcgtcctgctattagagatattacttgggataaagggaaggttacttttcttgattttgaatctcgtgcaaatagtcaaaatcaaaattgggtagttattcgggatatgttatttttctttgatagtttatgtcgagaagaagatatttcagacgattttattcaaaaagtagcgttgtattatcaagcttattgtagagtagaaaattggcagaatatgatcgtatttttgcagcgttttcgctgggtttattatcttttattgccttttaaaccttttgcaaagaaagatttaattgcagtttatcgcttatttgaaattttattaataaagaaaaaa

SEQ ID NO: 3014 - protein, 242 aa, Haemophilus influenzae
  Name: NTH1673
MMANDDFQEYVKQLVTKHRDERIYPFQYEGKKYWLKQPEKLKGIWLLLKPHPKKSFKNELHTLLKLAEQNAPVPKVSYYSDHFFVLENVGLTVSQWLCNKNIDEQQKFLIIYDACLALIDLHAKNLIHGRPAIRDITWDKGKVTFLDFESRANSQNQNWVVIRDMLFFFDSLCREEDISDDFIQKVALYYQAYCRVENWQNMIVFLQRFRWVYYLLLPFKPFAKKDLIAVYRLFEILLIKKK

SEQ ID NO: 3015 - DNA, 135 bp, Haemophilus influenzae
  Name: NTH1675
atgatgaagaaaatattttttatttttgtattatcaggcatattagctgcttgtgccatgggtggtggtattcgtgctggtggtggaagtaatggtgtaggattaggtgtggggattggatctggcattcgcttc

SEQ ID NO: 3016 - protein, 45 aa, Haemophilus influenzae
  Name: NTH1675
MMKKIFFIFVLSGILAACAMGGGIRAGGGSNGVGLGVGIGSGIRF

SEQ ID NO: 3017 - DNA, 108 bp, Haemophilus influenzae
  n 64, 88, 103, 104, 105, 106, 107: n is any nucleotide
  Name: NTH1676
gtgtggggattggatctggcattcgcttctaataatgaaaagtgcggcaagtttgatctttatnctgccatgggtaccgaaggcccgntattcgtataccagnnnnnt

SEQ ID NO: 3018 - protein, 36 aa, Haemophilus influenzae
  Xaa 22, 30, 35, 36: Xaa is any amino acid
  Name: NTH1676
VWGLDLAFASNNEKCGKFDLYXAMGTEGPXFVYQXX

SEQ ID NO: 3019 - DNA, 99 bp, Haemophilus influenzae
  n 49: n is any nucleotide
  Name: NTH1677
gtgattgaaattcattctcaattatattctcaaaaaaatttctcaaatnaacaaggaaaaaaaatggtacaacttttgatgggtaccgagtccgaatcg

SEQ ID NO: 3020 - protein, 33 aa, Haemophilus influenzae
  Xaa 17: Xaa is any amino acid
  Name: NTH1677
VIEIHSQLYSQKNFSNXQGKKMVQLLMGTESES

SEQ ID NO: 3021 - DNA, 465 bp, Haemophilus influenzae
  Name: NTH1678
atgaatccattatctgttggtaatcaagcacctgcttttaccttattaaatcaacaagaaaaatttgtttctttaagtgattttcgtggtaaaaaagttttaatttatttttatccaaaggctctcactccaggctgtaccacacaagcctgcggattgcgcgacagtaaatctgaattagatgcactaggcttagttgtacttggtattagtcctgatgccccgaaaaaattagctcaatttattgagaaaaaagcacttaatttcacattgctttctgatcctgatcatcaagttgcggagcaatttggcgtatggggcgaaaaaaaatttatggggagaacttacgacggtattcatcgaattagttttttaatcaatgaaagcggaactattatgcaagtatttgataaatttaagataaaagaccatcatcaaatgatcattgattatcttcgttcccta

SEQ ID NO: 3022 - protein, 155 aa, Haemophilus influenzae
  Name: NTH1678
MNPLSVGNQAPAFTLLNQQEKFVSLSDFRGKKVLIYFYPKALTPGCTTQACGLRDSKSELDALGLVVLGISPDAPKKLAQFIEKKALNFTLLSDPDHQVAEQFGVWGEKKFMGRTYDGIHRISFLINESGTIMQVFDKFKIKDHHQMIIDYLRSL

SEQ ID NO: 3023 - DNA, 858 bp, Haemophilus influenzae
  n 147: n is any nucleotide
  Name: NTH1679
ttgcccttgttacgccaaatgaatcattatggcgaagtcgatttttcctgtttagaaaaattagtagaacatcacattgaagctggttctaatgcgcttgtttctgtgggtacaacgggagaatccgccacgctaagtattgaaganaatgtaaaagtcattgaaaagactgttgaatttgccaaaggacgtattcctattattgcgggagcgggtgcaaatgcgacgagtgaagcaattacaatgaccaaattattacgagacagtggtgtagcaggatgtttatctgttgtgccttattataataaaccaacccaagagggaatgtatcaacattttaaagccattgcggaatgtactgatttaccacagattctttataatgttcctagtcgcacaggcagtgatatgaaaccagaaacagttgctcgtttagctgaaattgaaaatattgtaggcattaaggaagcaacgggagatgttagccgaatagttaaaattaagcagcttgcaggtaagaattttattgttttaagtggcaatgatacaacaggcttagaagcaataaaattaggtgctgaaggagtaatatcagtaacaaataacattgcagcaaaagatatggctgatatgtgccgttatgcacttgcgggagattttgataaagcggaagaaattaatgctcgtttaatgcgtttacatcacgacctgttcattgaatctaatccaattccagtgaagtgggcagcttatcgcttaggcttaattaaatcgccacatttacgcttgccacttacaacacttagtgaagaaattcaaccaaaagtagaagatgcgctaaaaatcgcaggattgtta

SEQ ID NO: 3024 - protein, 286 aa, Haemophilus influenzae
  Xaa 49: Xaa is any amino acid
  Name: NTH1679
LPLLRQMNHYGEVDFSCLEKLVEHHIEAGSNALVSVGTTGESATLSIEXNVKVIEKTVEFAKGRIPIIAGAGANATSEAITMTKLLRDSGVAGCLSVVPYYNKPTQEGMYQHFKAIAECTDLPQILYNVPSRTGSDMKPETVARLAEIENIVGIKEATGDVSRIVKIKQLAGKNFIVLSGNDTTGLEAIKLGAEGVISVTNNIAAKDMADMCRYALAGDFDKAEEINARLMRLHHDLFIESNPIPVKWAAYRLGLIKSPHLRLPLTTLSEEIQPKVEDALKIAGLL

SEQ ID NO: 3025 - DNA, 627 bp, Haemophilus influenzae
  Name: NTH1680
atgaaaaaaataatattgaatttagtaacggctattattctagctggttgttcgtctaatcctgaaaccttaaaagcaaccaacgattcatttcaaaaatctgagacgagcattccccatttttcccctttggctactggaggtgtacagttaccaaaagctgatgatgcctattcattacctaatattgaagtgaaaaaaggggaagatattgatattcgcccaccattaatccctctcgctattattcaaaattcaataacaaaatttgatggcgaacgttcgttgattgtctatccaaaacaacaggcaaaactatataatcttcagcaagttaagcgtttattgaaagatgagggtatttcatcaacaacagatggttcgattttaacaactgattgggcaaaaacagaacgaattggcgataaatctatagaaataaaatatcaaatagaacaagttatgacagctgatgtaagtgtgcttaccgtatctattttacatatgcgccgagatggtattatttttacaccaaatgtatcagataaacaatattatacttcggaacgtttaaatcgcattgttttaacactcactaccgcgtataacaaacaattacaggattta

SEQ ID NO: 3026 - protein, 209 aa, Haemophilus influenzae
  Name: NTH1680
MKKIILNLVTAIILAGCSSNPETLKATNDSFQKSETSIPHFSPLATGGVQLPKADDAYSLPNIEVKKGEDIDIRPPLIPLAIIQNSITKFDGERSLIVYPKQQAKLYNLQQVKRLLKDEGISSTTDGSILTTDWAKTERIGDKSIEIKYQIEQVMTADVSVLTVSILHMRRDGIIFTPNVSDKQYYTSERLNRIVLTLTTAYNKQLQDL

SEQ ID NO: 3027 - DNA, 321 bp, Haemophilus influenzae
  Name: NTH1681
atgacacttaatattaccagtaaacaaatggacatcactcctgcaattcgtgaacacttggaggaaagacttgcgaagttaggtaagtggcaaacgcagttaattagcccacattttgttttaaacaaagtacctaatggatttagtgtcgaagcctctattggcacacccttaggcaatttattagccagtgcaacttcagatgatatgtataaagcaattaatgaagtggaagaaaaattagaacgtcagcttaataaacttcaacataaaagtgaatctcgccgagctgatgaacgtttaaaggattcttttgaaaac

SEQ ID NO: 3028 - protein, 107 aa, Haemophilus influenzae
  Name: NTH1681
MTLNITSKQMDITPAIREHLEERLAKLGKWQTQLISPHFVLNKVPNGFSVEASIGTPLGNLLASATSDDMYKAINEVEEKLERQLNKLQHKSESRRADERLKDSFEN

SEQ ID NO: 3029 - DNA, 936 bp, Haemophilus influenzae
  Name: NTH1682
atgacagacagacagacagacagacagacagacagacagacaataaatattatattttcatctgacaaccattatgcaccttatttagctgtaagtatttttagcattattaaaaatacacctgaaaaaataaatttttatattcttgatatgaaaataaatcaggaaaataagacaataataaataatttagcaactgcatatttttgtaaagtatttttcttgcctgtcagtgaggcagattttcaaaactttccaaaaacaatagattacatatctttagcgacttacgctagactaaatttaactaaatatataaagaatatagaaaaagctatttatattgatgtggacacattaacaaactcttcacttcaagaactttggaatatagatataatgaactattatttggcaggatgtcgagatacttttattgatgtaaaaaatgaagcttataaaaaatccattggtttagaaggatattcttattttaatgcaggtatattattaattaatttaaataaatggaaagaagaaaatattttccaaaaatcaataaattggatgaataaatacaataatgttatgaaataccaagatcaagatattctaaatggtatctgtaaaggaaaagtaaaatttattaataatagatttaattttacaccaacggatcgaggtttgattaaaaagaaaaatttattacacgtaaaaatgccaatagttatttctcattattgtggtccaaataaattttggcacaaaaaatgcagtcacttaaattgtcatataggaaatttacttttaaaagaaatggataaaattattgatataccatcatcttggtatgatcattttgagaaaatcccttttttaattaaaataaaaagattaagaaagagaataaaagataaattaatatatggtatttat

SEQ ID NO: 3030 - protein, 312 aa, Haemophilus influenzae
  Name: NTH1682
MTDRQTDRQTDRQTINIIFSSDNHYAPYLAVSIFSIIKNTPEKINFYILDMKINQENKTIINNLATAYFCKVFFLPVSEADFQNFPKTIDYISLATYARLNLTKYIKNIEKAIYIDVDTLTNSSLQELWNIDIMNYYLAGCRDTFIDVKNEAYKKSIGLEGYSYFNAGILLINLNKWKEENIFQKSINWMNKYNNVMKYQDQDILNGICKGKVKFINNRFNFTPTDRGLIKKKNLLHVKMPIVISHYCGPNKFWHKKCSHLNCHIGNLLLKEMDKIIDIPSSWYDHFEKIPFLIKIKRLRKRIKDKLIYGIY

SEQ ID NO: 3031 - DNA, 585 bp, Haemophilus influenzae
  Name: NTH1683
atgaaacaaaaaatcgtacttgctacaggcaataaaggcaaagtgaaagaaatggctgatgtcctatctgattttggctttgaagtgattgcgcaaacagatttaggcattgaaagcccagaagaaacaggcttaactttcgttgagaatgcgttattaaaagcacgttatgcatcagaaaaatcaggtttacctgctattgcggatgattcaggcttggtggtttccgcacttaatggcgcaccaggtctgtattctgctcgttatgctggtgaagagggcaatgatgctaaaaaccgtgagaaattattggcagagcttgctcatgttgcaaaagatcaacgccaagctaaatttgtgagctgtatcgtgtttttacagcatccaacagatccatcgccaattatagccgaaggcgagtgttgtggcgtgattggttttgaagaaaaaggcgaaaatggttttggttatgacagtttattctttagtccagaacaaggttgcacatttgctgaattagaaacagctgagaagaaaaaaatttctcatcgagcaaaggcattgaatattttaaaaaataaatta

SEQ ID NO: 3032 - protein, 195 aa, Haemophilus influenzae
  Name: NTH1683
MKQKIVLATGNKGKVKEMADVLSDFGFEVIAQTDLGIESPEETGLTFVENALLKARYASEKSGLPAIADDSGLVVSALNGAPGLYSARYAGEEGNDAKNREKLLAELAHVAKDQRQAKFVSCIVFLQHPTDPSPIIAEGECCGVIGFEEKGENGFGYDSLFFSPEQGCTFAELETAEKKKISHRAKALNILKNKL

SEQ ID NO: 3033 - DNA, 426 bp, Haemophilus influenzae
  Name: NTH1684
atgaagcggggtttacctgtgcctaaacccattgccgcgcgtattcaaaaaggcaagttaggtatttgctatcaagcggatattttgactgagaaaatcgaaaacgcgcaggatttaaccgcacttttacaaacacaaacattgccaaaagaaacttggaggcaaattggtcgtttgattcgaaaactacatgatttacagatttgtcatactgacttgaatgcacacaatattttgcttcaacaagctgaacaagagcaaaaatgttggttgattgattttgataagtgcggtaaaaaatcaggggatttttggaaagcacaaaatctgaaccgtttaaaacgttcctttgaaaaagaagttggacgaatgaatattcaatttaccgagcaaaactgggctgatttaacggcagcttatcatcaa

SEQ ID NO: 3034 - protein, 142 aa, Haemophilus influenzae
  Name: NTH1684
MKRGLPVPKPIAARIQKGKLGICYQADILTEKIENAQDLTALLQTQTLPKETWRQIGRLIRKLHDLQICHTDLNAHNILLQQAEQEQKCWLIDFDKCGKKSGDFWKAQNLNRLKRSFEKEVGRMNIQFTEQNWADLTAAYHQ

SEQ ID NO: 3035 - DNA, 102 bp, Haemophilus influenzae
  Name: NTH1685
gtgagcgaagatcggtatggtttttctgttcttgaaactacccgtagttttgctgagtttcatttgttgcaacgtttgtatgaagcggggtttacctgtgcc

SEQ ID NO: 3036 - protein, 34 aa, Haemophilus influenzae
  Name: NTH1685
VSEDRYGFSVLETTRSFAEFHLLQRLYEAGFTCA

SEQ ID NO: 3037 - DNA, 273 bp, Haemophilus influenzae
  Name: NTH1686
gtggaaatttatatgtcagtatttaatacatttgttgaatttgtcgcgagaattgttgcaccaatgcagcgtcaatttattaattttatccgtattgctatttttattgtaatggcatggatcggtggtttgaaagtttgtcaatatgaggcagatggaattgcccactttgtatcaaatagcccatttgttagctatatgtatgaaaaagggccaaatttagtgccgaatgataaaggagagttagtgatggatatccactaccccaactcc

SEQ ID NO: 3038 - protein, 91 aa, Haemophilus influenzae
  Name: NTH1686
VEIYMSVFNTFVEFVARIVAPMQRQFINFIRIAIFIVMAWIGGLKVCQYEADGIAHFVSNSPFVSYMYEKGPNLVPNDKGELVMDIHYPNS

SEQ ID NO: 3039 - DNA, 90 bp, Haemophilus influenzae
  Name: NTH1687
atgggaaaatcaaattttattttaattagtaaaacttttcaaatttctccgttatttacctttatattaaagggaattgattttgctttt

SEQ ID NO: 3040 - protein, 30 aa, Haemophilus influenzae
  Name: NTH1687
MGKSNFILISKTFQISPLFTFILKGIDFAF

SEQ ID NO: 3041 - DNA, 1839 bp, Haemophilus influenzae
  Name: NTH1688
atgcacaggtttttttataacgataataatgttttaggagatttgatgaaaaatttcaaatattttgctcagagttatgtggattgggttattcgtcttgggcgtcttcgtttttctcttttaggcgtgatgattctcgcggttttagccctttgtactcagattttatttagtctatttattgttcatcagatatcttgggtagatatttttcgttctgtaacttttggcttactcactgcgccttttgttatttattttttcactttattagtagaaaaacttgaacattctcgtcttgatctttctagctcggttaatcgattggaaaatgaggtcgccgagcgaattgctgctcagaaaaaattatcccaagcattggaaaagttagaaaaaaatagccgtgataaaagtaccttacttgccacaataagccatgaatttcgcacgccattgaatgggattgtcgggcttagtcaaattttacttgatgatgaattggatgatctccagcgtaattatttaaaaactatcaacataagtgcggtcagtttaggctatatttttagcgatattattgatttggaaaaaattgatgccagccgaattgaattaaatcgccagccaacagatttccccgccttattaaacgatatttataattttgctagtttcctcgccaaagaaaaaaatcttattttttctttagagcttgaacctaatttgcctaattggttgaatcttgatcgtgttcgcttgagccaaattttgtggaacttaattagtaatgcggtgaagtttacggatcagggaaatattattcttaaaattatgagaaatcaggattgttaccattttattgtgaaagatacaggaatggggatttcacctgaagaacaaaaacatatttttgaaatgtattatcaagtgaaagaaagccgtcagcaaagtgcgggtagcggtattgggttggctatttctaaaaatctcgctcagttaatggaaggggatttaacagttgaaagtgagcgaggaaaaggcgcgactttccatcttactctccacgctcaggaaatttctgaaaaagaatctgttaagaaaaatataccatccttgaatattcttttagtggaagatgttgatctcaatattatggttgcaaaaactattttagaaaaacttgggcatcatgttgatgttgcgacaaatggcaagcaggcgattactttatttgagaaaaatgtttacgacattctattgctcgatattaaattaccagatatgagtggttttgaaattgcccaatatttgcgagagaactatgaaaacggtatttatgattttttaccgccaatgattgcttttaccgcgaatgttatgcaaagcgagcaagaatatttagaaatgggcatggatggcgtattacgtaaacccatttcaattaaggatttacaccattgtctacagcaattttttgcagatgaaagcgaatctattatagaaatgaatgatgataatgagctttcagaacagtttgatttagcgctgatagaaacacttggaaaaaaacaaattttagaaaatttatctttattcaaacaaactatgccaaattatctggctcaattatcaaaagataatatgaaagaaacagaagataccgcccataaaattaaaggcgcagcggcatcggtagggttaaatcatttacgtcaattagcggatactttagaaagtgcggctaaaaattctgatgtttttaattgtggagaattgattgatgaaattggaaatctttggttagaagatgtggaggatttgcttaaattttgtaaattt

SEQ ID NO: 3042 - protein, 613 aa, Haemophilus influenzae
  Name: NTH1688
MHRFFYNDNNVLGDLMKNFKYFAQSYVDWVIRLGRLRFSLLGVMILAVLALCTQILFSLFIVHQISWVDIFRSVTFGLLTAPFVIYFFTLLVEKLEHSRLDLSSSVNRLENEVAERIAAQKKLSQALEKLEKNSRDKSTLLATISHEFRTPLNGIVGLSQILLDDELDDLQRNYLKTINISAVSLGYIFSDIIDLEKIDASRIELNRQPTDFPALLNDIYNFASFLAKEKNLIFSLELEPNLPNWLNLDRVRLSQILWNLISNAVKFTDQGNIILKIMRNQDCYHFIVKDTGMGISPEEQKHIFEMYYQVKESRQQSAGSGIGLAISKNLAQLMEGDLTVESERGKGATFHLTLHAQEISEKESVKKNIPSLNILLVEDVDLNIMVAKTILEKLGHHVDVATNGKQAITLFEKNVYDILLLDIKLPDMSGFEIAQYLRENYENGIYDFLPPMIAFTANVMQSEQEYLEMGMDGVLRKPISIKDLHHCLQQFFADESESIIEMNDDNELSEQFDLALIETLGKKQILENLSLFKQTMPNYLAQLSKDNMKETEDTAHKIKGAAASVGLNHLRQLADTLESAAKNSDVFNCGELIDEIGNLWLEDVEDLLKFCKF

SEQ ID NO: 3043 - DNA, 642 bp, Haemophilus influenzae
  Name: NTH1689
ttgatttttcatatttttcaaatagactttatatattcatttctaatctccttcattatgcttaaaaatttagacgaaataacttcaagtattatcgctgatcctcaaaataaagattttacagaacgtggaattttccctttattttcggcgcctaaaacagctcgaattaatattgttggtcaagctcctgggttaaaagctgagcaatctcgtttgtattggaatgataaaagcggtgatcgtctgcgagaatggttgggagtagattacgattatttttataattctgggatatttgcggttcttcccatggatttctattatcctggaaaaggtaaatcgggtgatttaccacctcgtcaaggttttgcagaaagatggcatccaatgattttagggaatctacctaatattcagctcactattcttattgggcaatatgcacagaaatattatttacccgaaaataaagataatgtaactaacactgttaaaaattatcgtcaattcttaccgcactttatgcctctcgtgcacccttccccacgtaatcagctttgggcaacaaagaatccttggtttgaagagcaagttattcctgaattacaaattttagtcaaacagataattaataaagat

SEQ ID NO: 3044 - protein, 214 aa, Haemophilus influenzae
  Name: NTH1689
LIFHIFQIDFIYSFLISFIMLKNLDEITSSIIADPQNKDFTERGIFPLFSAPKTARINIVGQAPGLKAEQSRLYWNDKSGDRLREWLGVDYDYFYNSGIFAVLPMDFYYPGKGKSGDLPPRQGFAERWHPMILGNLPNIQLTILIGQYAQKYYLPENKDNVTNTVKNYRQFLPHFMPLVHPSPRNQLWATKNPWFEEQVIPELQILVKQIINKD

SEQ ID NO: 3045 - DNA, 435 bp, Haemophilus influenzae
  Name: NTH1690
atggtgaatgttcacgttgcacacgattgccaaattaaaaataactgtattctggcaaacaatgcaacgcttgcaggtcacgtagaattagatgatttcgtgattgttggcggtatgtcagcgattcatcaatttgtgattgttggtgcacacgttatgttaggcggtggttctatggtaagccaagatgtaccaccttatgttatggcgcaaggcaaccacgcccgtccatttggcgtaaacttagagggtttgaaacgtcgtggttttgataaaccaaccatgcacacaatccgtaacatttataaaatgctctatcgtggcggtaaaacacttgaagaagtgttaccagaaattgagcaaattgcggaaaccgattcagcgatcagtttttttgttgaatttttcaaacgttcaactcgcggaattattcgt

SEQ ID NO: 3046 - protein, 145 aa, Haemophilus influenzae
  Name: NTH1690
MVNVHVAHDCQIKNNCILANNATLAGHVELDDFVIVGGMSAIHQFVIVGAHVMLGGGSMVSQDVPPYVMAQGNHARPFGVNLEGLKRRGFDKPTMHTIRNIYKMLYRGGKTLEEVLPEIEQIAETDSAISFFVEFFKRSTRGIIR

SEQ ID NO: 3047 - DNA, 1209 bp, Haemophilus influenzae
  Name: NTH1692
ttgcacaccaaagtgcggttattttttaggataaatttgatgaacaaaacaaatccaaccattgctcttgttgcaggagaagtatctggtgatattctcggtgctggtttaattcgccagctcaaagcacattatcctaatgctcgctttattggtattgcaggcacaagaatgttggctgaaggctgtaaaacgctcgtcgatatggaagagctttctgttatgggtttggctgaaatcttgaaacatcttcctcgtttgctgaaaattcgtaaaaatgtcattcaaactatgttgcaagaaaaacctgatgtttacatcggcattgatgcgcctgattttaatttggatgtagaactcaagctcaaagctaacggaattaaaaccattcattacgtgagcccctctgtatgggcatggcgtcaaaatcgtatccataaaattgccaaagcgacccatcaagttcttgcctttttgccttttgagaaagccttttacgataaatttaatgtcccttgccgttttattggacacacaatggcagatgctattccgctcaaaccaaaccgtgccgaagcatgccaaatgctacagattgatcccgcacaacgctatttagctatcctagttggaagccgtggttcagaggtggaatttctggctgagcctttcttaaaaacagctttattgttaaaagaacaatttcctgatttacaattccttgttcctttggtgaacgaaaaacgacgaattcaatttgaagccattaaagctaaaattgcgccaaatctagacctgcatttaattgacggcaatgcacgacaagcaatgattgcagctgatgcaacacttcttgcttcaggaacagcagcacttgaagcaatgctttgtaaatccccaatggtggtaggctatcgaatgaaaccactgacctatttcttagcaaaacgtttagtgaaaaccgattatatttctttaccaaatttgcttgcgaatgaaatgctcgtgcctgaaatgattcaagaagaatgcacgccagaattgctcgctgaaaaattatctgcttatctttctgatgatgaaagtgcggtaaaaaatcgccatattttaattcagcacttcacggatttacaccaaaagattcaatgcaatgccgataagcaagcggctcaagcagtcattgatttattagaaggaacagaaaatgtt

SEQ ID NO: 3048 - protein, 403 aa, Haemophilus influenzae
  Name: NTH1692
LHTKVRLFFRINLMNKTNPTIALVAGEVSGDILGAGLIRQLKAHYPNARFIGIAGTRMLAEGCKTLVDMEELSVMGLAEILKHLPRLLKIRKNVIQTMLQEKPDVYIGIDAPDFNLDVELKLKANGIKTIHYVSPSVWAWRQNRIHKIAKATHQVLAFLPFEKAFYDKFNVPCRFIGHTMADAIPLKPNRAEACQMLQIDPAQRYLAILVGSRGSEVEFLAEPFLKTALLLKEQFPDLQFLVPLVNEKRRIQFEAIKAKIAPNLDLHLIDGNARQAMIAADATLLASGTAALEAMLCKSPMVVGYRMKPLTYFLAKRLVKTDYISLPNLLANEMLVPEMIQEECTPELLAEKLSAYLSDDESAVKNRHILIQHFTDLHQKIQCNADKQAAQAVIDLLEGTENV

SEQ ID NO: 3049 - DNA, 591 bp, Haemophilus influenzae
  Name: NTH1693
atgtttgaatatccacaaggctatgaattgatcgctggtgttgatgaagttgggcgaggccctttagttggggctgttgtcacggctgccgttattttggatccgaataatccaattgaaggactcgctgattctaaaaaactttctgagaaaaaacgtttagcccttgctgaagaaatcaaagaaaaagcccttgcttgggcattaggtcgagctgaagctaacgaaattgacgagataaatatcctgcaagcctccttgctggcaatgactcgagcagtaaaatctttaaaaattcaaccgcactttgtgttggttgatggcaataagatcccaaaagatttagctattccagcgcaagccgtcgtcaaaggcgataaccttgtggcagaaatcagtgcagcctctattttggcgaaagtggcacgagaccaagaaatggaagaattagacaagcaatatccagaatacgcttttgcccagcataaaggctatccgaccaaattacatttggaaaaattagctgaacttggtgcgttaccgcaacatcgtcgtagctttgccccagtgaaaaaagcactagaacagttt

SEQ ID NO: 3050 - protein, 197 aa, Haemophilus influenzae
  Name: NTH1693
MFEYPQGYELIAGVDEVGRGPLVGAVVTAAVILDPNNPIEGLADSKKLSEKKRLALAEEIKEKALAWALGRAEANEIDEINILQASLLAMTRAVKSLKIQPHFVLVDGNKIPKDLAIPAQAVVKGDNLVAEISAASILAKVARDQEMEELDKQYPEYAFAQHKGYPTKLHLEKLAELGALPQHRRSFAPVKKALEQF

SEQ ID NO: 3051 - DNA, 438 bp, Haemophilus influenzae
  Name: NTH1694
atgaagacagacattcaaaccgaattaacccaagccctactatcacacgaaaaagtatgggcgaacgaagaaaaaaccattttagccaaaaacattctgttggatttggtagaaaaaaccgacccgactattatcgggttgttattggggaatgatgagttaaaacgccatttttttgtggaagtgaatggtgttttggtgtttaaattgcaggattttcgttttttcttggacaaacacagaatcaataattcctacacaaaatacgccaatcgcattggcttgacggacggcaaccgctttttgaaagacagttcggatattgtgttggattttccgtttaaagattgtgtgctaaatggcggacaaagcaccgaagaaggcgaagaaatttattttaaacgcaataacagccagccagccaattatacactaaat

SEQ ID NO: 3052 - protein, 146 aa, Haemophilus influenzae
  Name: NTH1694
MKTDIQTELTQALLSHEKVWANEEKTILAKNILLDLVEKTDPTIIGLLLGNDELKRHFFVEVNGVLVFKLQDFRFFLDKHRINNSYTKYANRIGLTDGNRFLKDSSDIVLDFPFKDCVLNGGQSTEEGEEIYFKRNNSQPANYTLN

SEQ ID NO: 3053 - DNA, 1356 bp, Haemophilus influenzae
  n 1314, 1343, 1344, 1345, 1346, 1347: n is any nucleotide
  Name: NTH1695
atgaaaaatcggctggaaattgcgaaaacattgttggctgatgatggcgtgatttttgttcaatgtgatgacaatgaacaagcctatttgaaaattttaatggacgaagtttttggtcgtgaaaattttgttacaaccattcattgccaaatgtccacaacgcaaggaatgaaagttaaagcggcacaagatggaaatattgttaaaaatgctgaatatattatagttttttcaaaaaatggacataaaaatattgcaataaatcccttgtatgatttgcgttcagaatatgatgaacactattcgctatatttaaaaaacgatggggctattgggcaacttaaagaattatatgattatagatttccaaaagatttaaaaaatacaaccgcactttctttaaaagaagcatttaagaaaagtaatgaatttgccgagattgtgaaaacacatctttccaagattgtaagaagcgataaagttactggatttgatttatccgttgaattagaaaatagcaaatggaaagaagttgagagaaatggaagaaaatatattcttacattagataaaaatggcaaagtttgccaattattaagactacaagattcttggggaaaaactgataattacaataatgatgagggacttcgtaaaattcgtggtaattggtgggaaggtttttaccttgatatgggaaatgttggaaaagaagggagcgtagattttaaaaatggcaaaaaaggagagcgtttaatttcacaaattattaaaacagcaaccaacgaaaacgacatcgtcctagactaccatttaggcagtggcacaaccgccgccgtcgctcataaaatgaaccgccaatacatcggtattgaacaaatggattatattgaaacgcttgccgttgaacgcttgaaaaaagtgattgaaggcgagcaaggcggtatttccaaagccgtgaattggcaaggcggtggcgagtttgtttatgccgaacttgctccatttaacgaaacagcaaaacaacaaattttggcgtgcgaaaattcaaacgacatcaaaacgctgtttaatgaattatgcgaacgctatttcttgaaatacaatgtaagcgtgaatgaatttagtcaaatcattgaagaacctgaatttcaaaccttaccacttgacgaacaaaaacaaatgatgcttgaaatgttggatttaaatcaaatgtatgtttcattatccgaaatggacgatgaacaatttgcaggttgcttaaacgatgacgataaagcgttaagccgtgcgttctatcaatcagtaaaaaancagggtaccgagtcgatattcgaaaacannnnnttaattaat

SEQ ID NO: 3054 - protein, 452 aa, Haemophilus influenzae
  Xaa 438, 448, 449: Xaa is any amino acid
  Name: NTH1695
MKNRLEIAKTLLADDGVIFVQCDDNEQAYLKILMDEVFGRENFVTTIHCQMSTTQGMKVKAAQDGNIVKNAEYIIVFSKNGHKNIAINPLYDLRSEYDEHYSLYLKNDGAIGQLKELYDYRFPKDLKNTTALSLKEAFKKSNEFAEIVKTHLSKIVRSDKVTGFDLSVELENSKWKEVERNGRKYILTLDKNGKVCQLLRLQDSWGKTDNYNNDEGLRKIRGNWWEGFYLDMGNVGKEGSVDFKNGKKGERLISQIIKTATNENDIVLDYHLGSGTTAAVAHKMNRQYIGIEQMDYIETLAVERLKKVIEGEQGGISKAVNWQGGGEFVYAELAPFNETAKQQILACENSNDIKTLFNELCERYFLKYNVSVNEFSQIIEEPEFQTLPLDEQKQMMLEMLDLNQMYVSLSEMDDEQFAGCLNDDDKALSRAFYQSVKXQGTESIFENXXLIN

SEQ ID NO: 3055 - DNA, 555 bp, Haemophilus influenzae
  Name: NTH1696
atgcttaaccaaattaaaaaagatgctcaagatcgtatggaaaaaagccttgaagcattaaaaggtcatatttcaaaaattcgtactggtcgtgctcaaccgagtttacttgatgcaattcaagttgaatattacggtgcggcgaccccacttcgccaattagcaaacgtagtggcagaagatgcgcgtactttagccgtaactgtttttgatcgttctttaatctctgcggtagaaaaagcaattttaacctcagatttaggtttaaacccatcttcagcgggtaccacaatccgtgttccgcttccgccattaacagaagaacgtcgtcgcgatttaatcaagatcgtaaaaggcgaaggtgaacaaggtaaagttgcgattcgtaatgtgcgtcgtgatgcgaatgataaaatcaaagcattattaaaagacaaagaaatcagcgaaaacgaacaacataaagcagaagaagaaatccaaaaaatcacagatatttacattaaaaaagtagatgaagtattagcggataaagaaaaagaattaatggatttc

SEQ ID NO: 3056 - protein, 185 aa, Haemophilus influenzae
  Name: NTH1696
MLNQIKKDAQDRMEKSLEALKGHISKIRTGRAQPSLLDAIQVEYYGAATPLRQLANVVAEDARTLAVTVFDRSLISAVEKAILTSDLGLNPSSAGTTIRVPLPPLTEERRRDLIKIVKGEGEQGKVAIRNVRRDANDKIKALLKDKEISENEQHKAEEEIQKITDIYIKKVDEVLADKEKELMDF

SEQ ID NO: 3057 - DNA, 90 bp, Haemophilus influenzae
  Name: NTH1697
atgacaatgttttgtttttgcatagaatctttaccgcactttgttgattatattttcattggtacgtctaaattcgcatacctaataaaa

SEQ ID NO: 3058 - protein, 30 aa, Haemophilus influenzae
  Name: NTH1697
MTMFCFCIESLPHFVDYIFIGTSKFAYLIK

SEQ ID NO: 3059 - DNA, 678 bp, Haemophilus influenzae
  Name: NTH1698
atgcaaaaacaaaacattgtcattcttggttcaacgggatcaatcggtaagagtaccctttctgttatcgaaaataaccctcagaaatatcatgcatttgcactcgtcggcggaaaaaatgtagaagcaatgtttgaacaatgtatcaaattccgaccgcactttgcggctcttgatgatgtaaatgcggctaaaattttacgtgaaaaattaattgcgcatcatattccaacgaaagtattagcaggacgacgagctatttgcgaactcgcagcacacccagatgccgatcagataatggcgtcgattgttggtgcagcaggattgttaccgactctttcagcggttaaagcaggtaaacgggtattactggcaaataaagaatcactggtaacctgcggacagctttttattgatgccgtaaaaaactatggctcgaagcttttaccagtagatagtgaacataatgctatctttcaatcattaccgccagaagcacaagaaaaaatcggtttttgcccactttctgaattaggtgtaagtaaaattatactcactggttctggcggaccattccgttacacgccacttgaacaattcaccaacataacaccagaacaagcagttgcgcaccctaattggtctatgggtaaaaaaattctgtcgattcagctacaa

SEQ ID NO: 3060 - protein, 226 aa, Haemophilus influenzae
  Name: NTH1698
MQKQNIVILGSTGSIGKSTLSVIENNPQKYHAFALVGGKNVEAMFEQCIKFRPHFAALDDVNAAKILREKLIAHHIPTKVLAGRRAICELAAHPDADQIMASIVGAAGLLPTLSAVKAGKRVLLANKESLVTCGQLFIDAVKNYGSKLLPVDSEHNAIFQSLPPEAQEKIGFCPLSELGVSKIILTGSGGPFRYTPLEQFTNITPEQAVAHPNWSMGKKILSIQLQ

SEQ ID NO: 3061 - DNA, 513 bp, Haemophilus influenzae
  Name: NTH1700
atgatgaataaaggcttagaatacattgaggctcgctggcttttcaatgcaagtgcggaagaaatggaagtcattattcatccacaatcaattattcattctatggtgcgttatgttgatggctcagtcatagctcaaatgggaaatccagatatgcgtacaccaattgcagaaactatggcatatcctcaccgcacttttgctggagtagaaccactcgatttctttaaaatcaaagaactgacttttattgaacctgattttaatcgctatccgaatttaaaactggctattgatgcctttgctgcgggtcaatatgcgacaacagcaatgaatgcagctaatgaaattgccgtacaagcatttttagatcgtcaaattagttttatggatattgcaaaaattaattcgaaaacaattgagagaatttcgccttataccattcaaaatattgatgatgtactcgaaattgatgcacaagcaagagagattgcgaaaacactaattagagaa

SEQ ID NO: 3062 - protein, 171 aa, Haemophilus influenzae
  Name: NTH1700
MMNKGLEYIEARWLFNASAEEMEVIIHPQSIIHSMVRYVDGSVIAQMGNPDMRTPIAETMAYPHRTFAGVEPLDFFKIKELTFIEPDFNRYPNLKLAIDAFAAGQYATTAMNAANEIAVQAFLDRQISFMDIAKINSKTIERISPYTIQNIDDVLEIDAQAREIAKTLIRE

SEQ ID NO: 3063 - DNA, 807 bp, Haemophilus influenzae
  Name: NTH1701
atggcgtttagtacaatttttatcttactgatttgcggtatttgtaccaatatggtttctgctatttttggtattggcggtggggtattgatggtgccaattttacgtacattgtttcctgcgttaccgattcaagttatttcagctacgtcactcaccattgtgatgtgtaccgcattgattaatttattatttttccataagcaaaaaattaaaattgattatatcaatatgattttatggtctattgctatggtgattggggtgcaaattggttttgaattaagtttttatttttctacagcgataattagtttaatttttacggttagtttaagtgcactagcgattaaaacatttttgaacagatcgagaatacaaatagaagtgtttaatatgtctcctatagaacgagctaaaggtagtattagtttttgtggaggaggcttaattgcgggtattacaggtattggaggcggttctattcttgcgccccttgtcgggcaattaaagggggtaaaaacgcaacaaattgccgtttatacgaactatatgatgattattggtggtattggtaatctatacggctatctcactagagcttttccctatgatatcagcctaagtggccaactaggatatgtaaactttcttgtagttggtgtcgttaccttgggttcatttggaatgagtttcttctcaatgaaattgcgtggattaatgaatccagttttaacaagaaaattattggcgattattttattttgtattgcagcctatatgtgcattttggaatttgtattccat

SEQ ID NO: 3064 - protein, 269 aa, Haemophilus influenzae
  Name: NTH1701
MAFSTIFILLICGICTNMVSAIFGIGGGVLMVPILRTLFPALPIQVISATSLTIVMCTALINLLFFHKQKIKIDYINMILWSIAMVIGVQIGFELSFYFSTAIISLIFTVSLSALAIKTFLNRSRIQIEVFNMSPIERAKGSISFCGGGLIAGITGIGGGSILAPLVGQLKGVKTQQIAVYTNYMMIIGGIGNLYGYLTRAFPYDISLSGQLGYVNFLVVGVVTLGSFGMSFFSMKLRGLMNPVLTRKLLAIILFCIAAYMCILEFVFH

SEQ ID NO: 3065 - DNA, 237 bp, Haemophilus influenzae
  Name: NTH1702
atgaattcatttcaattaatggcaaaacctactggttcaatttgtaatttagattgtaaatattgcttttacttggaaaaacctcacttaaatcaacgggctatgactaatgaagtattagaagcctatatcaaatcctatattgaagcaacgcctcaacaacaagttactttcctatggcaaggcggcgagccaaccctagcaggtcttgatttctacaaaagagcggtcaatttt

SEQ ID NO: 3066 - protein, 79 aa, Haemophilus influenzae
  Name: NTH1702
MNSFQLMAKPTGSICNLDCKYCFYLEKPHLNQRAMTNEVLEAYIKSYIEATPQQQVTFLWQGGEPTLAGLDFYKRAVNF

SEQ ID NO: 3067 - DNA, 387 bp, Haemophilus influenzae
  Name: NTH1703
atggcttaccttggtttacaaccaagtttatgtatttttcgtgaaacctgcggcgatcaattggttattgaacaaaatggcgatatttatagttgcgatcattatgtttatcctgaatataaactcggaaatcttattgaaacccctctaatacagctccttgataataatactaaacaaaagaattttggtgcagcgaaatcttttctttccgaacagtgtaaaatctgtaagtttcgctttgcatgtcacggaggatgtccaaaacatcgtacaattcaaggatttggtaaaacacataatcaactttgtgaggcatattattcagcactttctcatatggatccatatttaaagtcatttgcaaaatcatttggcaaaataaaa

SEQ ID NO: 3068 - protein, 129 aa, Haemophilus influenzae
  Name: NTH1703
MAYLGLQPSLCIFRETCGDQLVIEQNGDIYSCDHYVYPEYKLGNLIETPLIQLLDNNTKQKNFGAAKSFLSEQCKICKFRFACHGGCPKHRTIQGFGKTHNQLCEAYYSALSHMDPYLKSFAKSFGKIK

SEQ ID NO: 3069 - DNA, 1110 bp, Haemophilus influenzae
  Name: NTH1704
atgcaagaacgggcatcaacgggtcgaatttacattcaaaacgtggatcactgtaatacccactctccgtttgatccacaagttgcaccagttcgtcaatctaacttatgcttagaaattgcattaccaactaaaccgcttcagcacattaacgatgaaaatggggaaattgcactttgtacactttccgcttttaacttaggtaaaattgaaaacttagatgaattagaagaacttgcggatcttgcagtgcgttcacttgatgccttattagactatcaagattaccctgttgtggcagcaaaacgtagctcacttgcacgccgttcactcggtattggggtcattaactatgcgtattaccttgcgaaaaatggtgttcgctattctgatggttcagccaacgatttaacacaccgcacttttgaagccattcaatattatttattgaaagcctctatgaacttagcaaaagagcaaggtgcgtgtgaatacttcaatgaaaccacttatgcaaaaggcattttaccgattgatacctataagaaagatttagattccttaacacaagagcctctacattatgattgggaaagtttacgtaaagatattcaagaatttggtttacgtaactcaacattaactgccttaatgccatcagaaacatcatcgcagatttccaatgcgactaatggtattgagccaccgcgtggacacgtaagtattaaagcatcaaaagatggtatcttaaaacaagttgtacctgaatatgaaaatttaatggataactatgaattactttgggatattccaagtaatgacggctacttacacttagtcggtattatgcaaaaattcgtggatcaagcgatctctgcaaacacaaactatgatccaaaacgttttgaagacggcaaagtaccaatgaaagtgttgttaaaagatttattaaccgcttacaaatacggtttaaaaaccctttactatcaaaatacccgcgacggtgccgaagatgttcaagaagatcttgatgacggctgtgctggtggtgcttgcaaaatttatacgcccctattgtcttccccaacttatggggaagatagcacgaca

SEQ ID NO: 3070 - protein, 370 aa, Haemophilus influenzae
  Name: NTH1704
MQERASTGRIYIQNVDHCNTHSPFDPQVAPVRQSNLCLEIALPTKPLQHINDENGEIALCTLSAFNLGKIENLDELEELADLAVRSLDALLDYQDYPVVAAKRSSLARRSLGIGVINYAYYLAKNGVRYSDGSANDLTHRTFEAIQYYLLKASMNLAKEQGACEYFNETTYAKGILPIDTYKKDLDSLTQEPLHYDWESLRKDIQEFGLRNSTLTALMPSETSSQISNATNGIEPPRGHVSIKASKDGILKQVVPEYENLMDNYELLWDIPSNDGYLHLVGIMQKFVDQAISANTNYDPKRFEDGKVPMKVLLKDLLTAYKYGLKTLYYQNTRDGAEDVQEDLDDGCAGGACKIYTPLLSSPTYGEDSTT

SEQ ID NO: 3071 - DNA, 117 bp, Haemophilus influenzae
  Name: NTH1705
atggcatacactactttttcccaaaataaaaacgatcaattaaaagaaccgatgttctttggtcaaaacggttatgttgcgcgttacgatcaacaaaatacgagacttttgagaagc

SEQ ID NO: 3072 - protein, 39 aa, Haemophilus influenzae
  Name: NTH1705
MAYTTFSQNKNDQLKEPMFFGQNGYVARYDQQNTRLLRS

SEQ ID NO: 3073 - DNA, 933 bp, Haemophilus influenzae
  Name: NTH1706
ttgcctgaacacgaaaaacacatcttcatcagcaacttaaaatatcaaaccttattggattctattcaaggtcgtagcccgaacgtggcattattgcctttagtgtcgattcctgaattagaaacttggattgaaacttggacattctctgaaaccatccactctcgctcttacacacatattattcgtaatattgtgaacgatccttctatcgtatttgatgacatcgtaactaacgaagaaatcatcaaacgtgcacaagatatttcatcttactacgatgatttaatccgtgatagccaactttatggcttatacggcgaaggcacttataccgtagatggcaaagaatgcgtcgtaactttacgtagtttgaaaaaacaactttacctttgcctaatgagcgtgaatgcacttgaagcaattcgtttctacgtttctttcgcttgttcatttgcttttgctgaacgtcgtttaatggaagggaatgcaaaaattattaaatttatcgcacgtgatgaagccttgcatttaacaggtacacagcatattttaaatattatggctgcaggtcaagacgatcctgaaatggcagaaattgcggaagaatgtaaacaagaagcctatgatttatttgttgcagcggcagaacaagaaaaagcttgggctgattatctatttaaagacggttctatgatcggcctcaacagagatattttagttcaatacgtagaatatattactaatatccgtatgcaagctgttggattgccactaccattccaaacacgttcaaatccaattccttggattaacgcttggttagtgtcagataacgtacaggttgcaccacaagaagtagaagtaagctcttatcttgtaggtcaaattgactcaaaagttgatacgaatgattttgacgatttttctctc

SEQ ID NO: 3074 - protein, 311 aa, Haemophilus influenzae
  Name: NTH1706
LPEHEKHIFISNLKYQTLLDSIQGRSPNVALLPLVSIPELETWIETWTFSETIHSRSYTHIIRNIVNDPSIVFDDIVTNEEIIKRAQDISSYYDDLIRDSQLYGLYGEGTYTVDGKECVVTLRSLKKQLYLCLMSVNALEAIRFYVSFACSFAFAERRLMEGNAKIIKFIARDEALHLTGTQHILNIMAAGQDDPEMAEIAEECKQEAYDLFVAAAEQEKAWADYLFKDGSMIGLNRDILVQYVEYITNIRMQAVGLPLPFQTRSNPIPWINAWLVSDNVQVAPQEVEVSSYLVGQIDSKVDTNDFDDFSL

SEQ ID NO: 3075 - DNA, 1227 bp, Haemophilus influenzae
  Name: NTH1707
atgacaatcgaaattcttgttccagacctacctgaatcagttgcagatgcaactgttgccacttggcataaaaaactgggcgatactgtgaaacgtgatgaggttattgtggaaattgaaacggataaagtcgtgctagaagttcccgcactttctgatggtgtactggctgaagttgttcaagctgagggcgaaacagtggtgagtaaacagttgctaggcaaaatttctacggctcaagaaggagatgtcagttcagcgacgttaaaagcaacgaatgaacccacaccatctgatcgtcaaaatgcagcgattgaaaatagtcataatcataatgcggatcagagccctgcaattcgtcgtttattagcagaacatgatttacaagcagatcaaattcaaggttcgggtgtgggtggtcgtttaacacgtgaagatattgaacgtgaaattgcaaaacgacaagcacagcaagtgaaacaagaagctgccactgagcaaaatacaattagtacggtggcttatagcgcacgttctgaaaaacgtgtgccaatgacccgtttgcgtaaacgtattgctgaacgtttacttgaagccaaaaatagtacagcaatgcttactactttcaatgaagtggatatgcagccgataatgactttgcgtaaaacctacggcgaaaaatttgaaaaacagtatggtgtccgtttaggctttatgtctttttatattaaagcggttgtggaagcattaaaacgttatcctgaagtgaatgcttctattgatggggatgatgttgtttaccataactattttgatattagtattgcagtttcaacaccacgtggattagtcacaccagtgcttcgtgattgcgataagctcagtatggcagagatcgaaaaacaaattaaagcattagctgaaaaaggtcgtgatggcaaattaacagtagaagatcttactggcggcaattttactattacaaatggtggcgtgttcggttctcttatgtccactccaattatcaatccaccacaaagtgcgattttaggaatgcacgctattaaagaacgcccgattgcgcttaatggtcaagttgtgattcatcctatgatgtaccttgctttatcttacgatcatcgtttaattgacggccgtgaatctgttggtttcttggtaacgattaaagaattattggaagatccaacaagattgttattagaaatc

SEQ ID NO: 3076 - protein, 409 aa, Haemophilus influenzae
  Name: NTH1707
MTIEILVPDLPESVADATVATWHKKLGDTVKRDEVIVEIETDKVVLEVPALSDGVLAEVVQAEGETVVSKQLLGKISTAQEGDVSSATLKATNEPTPSDRQNAAIENSHNHNADQSPAIRRLLAEHDLQADQIQGSGVGGRLTREDIEREIAKRQAQQVKQEAATEQNTISTVAYSARSEKRVPMTRLRKRIAERLLEAKNSTAMLTTFNEVDMQPIMTLRKTYGEKFEKQYGVRLGFMSFYIKAVVEALKRYPEVNASIDGDDVVYHNYFDISIAVSTPRGLVTPVLRDCDKLSMAEIEKQIKALAEKGRDGKLTVEDLTGGNFTITNGGVFGSLMSTPIINPPQSAILGMHAIKERPIALNGQVVIHPMMYLALSYDHRLIDGRESVGFLVTIKELLEDPTRLLLEI

SEQ ID NO: 3077 - DNA, 666 bp, Haemophilus influenzae
  Name: NTH1708
atgtgtggtttagttatgttattgcctcatggctatgagggacaaggccctgaacattcttccgcacgtcttgaacgttatttgcaactttgcgcagaacaaaatatgcaagtttgcgtgccatcaacacctgcacaggtgtaccatatgttgcgccgccagtctttacgtaaaatgcgccgtccattgattgccatttccccaaaatctttactacgtcatccattggcagtgtccagtttagacgagttgattaatggaactttccaaacggtaatcggagaaattgatgagcttgatcctaaagatgtaaaacgtgtggtaatgtgttcaggtaaagtttattacgatgtacttgaacaacgtcgtgcaaataatcagaaagatgtagcgattattcgtattgagcagctttatccattcccgcatgaggatgtgaagaaagcgcttgagccttatgcgcatgtcacggattatgtatggtgccaagaagaaccacttaaccaaggggcttggtattgcagcaaacataattttgaatcagcaattccagaatccgttaaactcaaatatgcagggcgtccagcttctgcttcgcctgctgtgggttatatgtcgcttcacactaaacagcaaaaacagttagtggaagatgcgttgagtttt

SEQ ID NO: 3078 - protein, 222 aa, Haemophilus influenzae
  Name: NTH1708
MCGLVMLLPHGYEGQGPEHSSARLERYLQLCAEQNMQVCVPSTPAQVYHMLRRQSLRKMRRPLIAISPKSLLRHPLAVSSLDELINGTFQTVIGEIDELDPKDVKRVVMCSGKVYYDVLEQRRANNQKDVAIIRIEQLYPFPHEDVKKALEPYAHVTDYVWCQEEPLNQGAWYCSKHNFESAIPESVKLKYAGRPASASPAVGYMSLHTKQQKQLVEDALSF

SEQ ID NO: 3079 - DNA, 552 bp, Haemophilus influenzae
  n 539, 540, 541, 542, 543: n is any nucleotide
  Name: NTH1709
atggcaagatatttgggtcctaaactcaagctcagccgtcgtgaaggcactgatttattccttaaatcaggcgtgcgtgcgattgattcaaaatgtaaaattgatacagcaccaggtcagcacggtgctcgtaaaccgcgtttgtctgactatggtagtcagttacgtgaaaaacaaaaagttcgtcgtatctatggtattttagaacgtcaattccgtaactactataaagaagcaaaccgtttgaaaggtaacactggtgaaaatttattagtgttattagaaggtagattggataacgttgtttatcgcatgggatttgctgcaactcgtgcagaggctcgtcaattagtgagtcataaagcaattgttgtgaatggtcgtgttgttaatattccatctttccaagtttctgtaaatgatgtagttgctattcgtgaaaaatcgaaaaaacaagctcgtattaaagcatcattagaattagcagagcaaagagaaaaaccaacaggtaaagtaccgagtctgatatccgaaaccannnnnttaattaat

SEQ ID NO: 3080 - protein, 184 aa, Haemophilus influenzae
  Xaa 180, 181: Xaa is any amino acid
  Name: NTH1709
MARYLGPKLKLSRREGTDLFLKSGVRAIDSKCKIDTAPGQHGARKPRLSDYGSQLREKQKVRRIYGILERQFRNYYKEANRLKGNTGENLLVLLEGRLDNVVYRMGFAATRAEARQLVSHKAIVVNGRVVNIPSFQVSVNDVVAIREKSKKQARIKASLELAEQREKPTGKVPSLISETXXLIN

SEQ ID NO: 3081 - DNA, 234 bp, Haemophilus influenzae
  n 225, 226, 227, 228, 229: n is any nucleotide
  Name: NTH1710
atgccatcttttgatattgtttctgaaattactttacacgaagttcgtaatgcagtggaaaatgcaaaccgtgtgcttagcacgcgttatgattttcgtggtgtcgaagcggtaattgaattaaatgaaaaaaatgaaacgattaaaatcaccacagaatctgatttccaacttgaacaattaattgagattttaattgggatacttggggtacccgagacccgnnnnnttaat

SEQ ID NO: 3082 - protein, 78 aa, Haemophilus influenzae
  Xaa 76, 77: Xaa is any amino acid
  Name: NTH1710
MPSFDIVSEITLHEVRNAVENANRVLSTRYDFRGVEAVIELNEKNETIKITTESDFQLEQLIEILIGILGVPETRXXN

SEQ ID NO: 3083 - DNA, 942 bp, Haemophilus influenzae
  Name: NTH1712
atgcaaattcaatgtttcgaaagtattacacaaaaatatccacaatttcctaccgcacttttggctaatgaggagcctatacagaacggagagccttttatcttatacggcacaaagttggacataactaagctagaaaaatttcaacaaaagtgcggtcaaaattttcagatttttgatgtttggatggtagcgaaaaatattatcgtcttattgaaaggtcaatggttttctgatttcattaaatttgctcacgatgttgaagtggatattgctaaattagatttcagccctaaattgtctcaagcagggttgttggtgatggatatggattctaccgctattcaaattgagtgtattgatgaaattgcgaaactagcgggtgttggcgaacttgtttctgcgattacggaaagtgcaatgaggggggaattagatttcgagcaaagtttgcgttgtcgagtgggtacattaaaaggtgcgccagaaagcattttgcagcaagttagagagaatttaccgctaatgtctggattagttgaaacgatccaaaccttacaaaaatatggctggaaaactgcaattgcttcaggcggatttacttattttgcggattatttgaaagccttattgcaacttgattttgctgcatcaaatcaatttgatattgaagatggaaaactcacaggcttagttaaaggcgatgtggttgatgcccaatataaagctaaaacattgcaacatttgttagaggaatacggtatttattcccaacattctattgctatcggcgacggtgcaaatgacttggcaatgatgaatgtggcgggactaggtgttgcgttccatgctaaacctaaagtgcaacaacaagcgcaaattgtggtaaacttcgccgacttaaccgcacttttatgccttctaagtgccaatgatcgaatt

SEQ ID NO: 3084 - protein, 314 aa, Haemophilus influenzae
  Name: NTH1712
MQIQCFESITQKYPQFPTALLANEEPIQNGEPFILYGTKLDITKLEKFQQKCGQNFQIFDVWMVAKNIIVLLKGQWFSDFIKFAHDVEVDIAKLDFSPKLSQAGLLVMDMDSTAIQIECIDEIAKLAGVGELVSAITESAMRGELDFEQSLRCRVGTLKGAPESILQQVRENLPLMSGLVETIQTLQKYGWKTAIASGGFTYFADYLKALLQLDFAASNQFDIEDGKLTGLVKGDVVDAQYKAKTLQHLLEEYGIYSQHSIAIGDGANDLAMMNVAGLGVAFHAKPKVQQQAQIVVNFADLTALLCLLSANDRI

SEQ ID NO: 3085 - DNA, 105 bp, Haemophilus influenzae
  Name: NTH1713
gtgaaaataattaaagaaaaactactcaatgatacttgcaacgattatttcgctaagcctagcgatatttggcgttatcttatttggtgtaaaacaagtattttt

SEQ ID NO: 3086 - protein, 35 aa, Haemophilus influenzae
  Name: NTH1713
VKIIKEKLLNDTCNDYFAKPSDIWRYLIWCKTSIF

SEQ ID NO: 3087 - DNA, 2040 bp, Haemophilus influenzae
  Name: NTH1714
atgcgcaagattatttttcaaaacgaattatcacaggagaacaaaatggcaactcgtagacaattagccaatgcaattcgtgtcttagcaatggattctgtacaaaaagcgaaatctggtcaccctggtgcaccaatggggatggcggatattgctgaagtattatggcgcgactttttaaaacacaatccaaccaatcctaaatgggctgatcgtgaccgttttgtgctttcaaatggacacggttctatgttgatttatagtcttttacatttaactggctatgatctttctatcgaagatttaaaacaattccgtcaattacattctaaaaccccaggtcacccagaatatggttatgcacctggtgttgaaaccacgactggcccgttaggtcaaggtatcactaatgcggtgggtatggcaattgctgagaaaaccttagctggacaatttaaccgtgaaggccatgaaattgtcgatcaccacacttatgtgttcttaggcgatggctgtttaatggaagggatttctcacgaggcttgctctttagcaggaacattaggtctgggtaaactaatcgcattctacgatgacaacaatatttccattgatggtcatgttgatggctggttcagtgatgacaccgccgagcgttttgaagcttatggctggcaagtaatccgtaatgtaaatggtcacaatgcagagcaaattcgcgctgctgccgttcttgctcaagcagaaaaagaaaaaccaacgttaattatttgtaaaaccatcattggttttggttctccaaataaatcaggttctcatgattgccacggtgcgccattaggcgatgaagaaatcgctttaacccgcaaagcacttggttgggaatatgcgccatttgaaattccagctgaatactatgctgaatggtcggcaaaagagaaaggtgctgcagcagaaaaatcttgggaagaaaaatttgccgcttatgcaaaagcctatcctgaattggcagcagaatttaaacgtcgtgtttctggcgaattaccaacaaactgggcggcagaatctaaagcgttcatcgaaaaatttcaagcaattccagcgagtattgcaagccgtaaagcatcacaaaatgccattgaagcctatgcacacctattgccagaatttttaggtggttctgcagacttagcaagctccaacttaaccttatggagtggttcaaaaccgattcgtgcccacgaaaacgtaagtggtaactacattaactacggtgttcgtgaatttggtatgtctgccattatgaacggcattgccttacacggcggtttcattccttacggcgcaaccttcttaatgttctacgagtatgctcacaacgcagtacgtatggcagcattaatgaaacaacgcacattattcgtttatacccacgattccatcggtttaggcgaagatggacctacacaccaaccagtagaacaaacggcttcactacgcttaattccaaaccttgaaacatggcgtccatgtgaccaagttgaatcagccatcgcatggcaacaagcggttgaacgtcaagatggcccaagtgcgttaattttcactcgtcaaaatcttgctcaaatgaaccgcacttctgcacaattagatgcggttaaacgtggtgcttatgtattaaaagactgtgatggcacacctgagttaattttcattgcgacaggttctgaagtggaattagcagtgcaagcagccgaagcattaagtgctgaaggtaaaaaagtacgcgttgtttctatgccaagtactaaccgtttcgataaacaagacgaagcataccgtgaaagtgtattacctgcagcggtaaccaaacgtgttgcgattgaagcgggtattgctgacttctggtataaatacgttggattcaatggtcgtgttgtcggtatgaatagctttggcgaatccgcaccagcagatcaattatttaaactctttggtttcactgttgaaaacgtggtagcaaaagcgaaagaaattctt

SEQ ID NO: 3088 - protein, 680 aa, Haemophilus influenzae
  Name: NTH1714
MRKIIFQNELSQENKMATRRQLANAIRVLAMDSVQKAKSGHPGAPMGMADIAEVLWRDFLKHNPTNPKWADRDRFVLSNGHGSMLIYSLLHLTGYDLSIEDLKQFRQLHSKTPGHPEYGYAPGVETTTGPLGQGITNAVGMAIAEKTLAGQFNREGHEIVDHHTYVFLGDGCLMEGISHEACSLAGTLGLGKLIAFYDDNNISIDGHVDGWFSDDTAERFEAYGWQVIRNVNGHNAEQIRAAAVLAQAEKEKPTLIICKTIIGFGSPNKSGSHDCHGAPLGDEEIALTRKALGWEYAPFEIPAEYYAEWSAKEKGAAAEKSWEEKFAAYAKAYPELAAEFKRRVSGELPTNWAAESKAFIEKFQAIPASIASRKASQNAIEAYAHLLPEFLGGSADLASSNLTLWSGSKPIRAHENVSGNYINYGVREFGMSAIMNGIALHGGFIPYGATFLMFYEYAHNAVRMAALMKQRTLFVYTHDSIGLGEDGPTHQPVEQTASLRLIPNLETWRPCDQVESAIAWQQAVERQDGPSALIFTRQNLAQMNRTSAQLDAVKRGAYVLKDCDGTPELIFIATGSEVELAVQAAEALSAEGKKVRVVSMPSTNRFDKQDEAYRESVLPAAVTKRVAIEAGIADFWYKYVGFNGRVVGMNSFGESAPADQLFKLFGFTVENVVAKAKEIL

SEQ ID NO: 3089 - DNA, 999 bp, Haemophilus influenzae
  Name: NTH1716
atgttagcggaaaaattacaaattaactctattacacctcatccaagtgtagaatattggtctgtttgcaaagttgaggcgttatttgaaacgccatttttggaattagtttaccgagcaacgcaagttcatcgtaagcattttaatcctcgcgcgattcagttatccacgttaatgtctatcaaaacggggggatgcccagaagattgtagttattgccctcaatcagcccgttatcatactggcgtacaaaatcagcagttattagatgttgatgagatcgtcgctaaagcaaaaattgcgaaagcacgtggtgcgggacgtttctgtatgggggctgcttggcgaggccctaagccaaaagatattgagaaagtcacagaaattattaaagccgtgaaatcacttggtttagaaacttgcggtacctttggtttattgcaagacggtatggcggaagatttaaaagaagctggattagattattacaatcataatcttgataccgcaccagaacattatgcagaagtgattggtactcgccgttttgatgatcgtcttagtaccttaggaaaagtgcgcaaagctggattaaaagtgtgttgtggtggcattgtggggatgaatgaaacccgtaaagaacgggctggattaatcgcgagccttgcaaatcttgatccgcaacctgagtcagtgccgattaatcaactcgttaaggttgaaggtacaccgttagccgatgcggaagaattagattggacggagtttgtgcgaacgattgctgttgcacgtattactatgccaaaaagttatgttcgcctttctgcaggtcgtagtggtatgactgaagaaatgcaagcgatgtgttttatggcgggggcaaattcgattttctatggcgataaattacttgttacagataatccagaagaagatggcgatcagttattgatggcaaaattagatttagagccagaaactgcagaaaataaaaagttg

SEQ ID NO: 3090 - protein, 333 aa, Haemophilus influenzae
  Name: NTH1716
MLAEKLQINSITPHPSVEYWSVCKVEALFETPFLELVYRATQVHRKHFNPRAIQLSTLMSIKTGGCPEDCSYCPQSARYHTGVQNQQLLDVDEIVAKAKIAKARGAGRFCMGAAWRGPKPKDIEKVTEIIKAVKSLGLETCGTFGLLQDGMAEDLKEAGLDYYNHNLDTAPEHYAEVIGTRRFDDRLSTLGKVRKAGLKVCCGGIVGMNETRKERAGLIASLANLDPQPESVPINQLVKVEGTPLADAEELDWTEFVRTIAVARITMPKSYVRLSAGRSGMTEEMQAMCFMAGANSIFYGDKLLVTDNPEEDGDQLLMAKLDLEPETAENKKL

SEQ ID NO: 3091 - DNA, 651 bp, Haemophilus influenzae
  Name: NTH1717
atgctgatgatttatctaaataatgtgattttgaatgataaaaccttaccaatgtgctttaatttgaacgttaaggctggcgaacgtgtcgcaattattggcgaaagtggggcggggaaaagtaccttattgaatttaattgctgggtttgaatttcctgctcaaggagaaatttggttaaacgataaaaatcatacgcgtagtgcgccttacgagcgtcctgtttccatgctatttcaagaaaataacttatttccccatttgactgtacaacaaaatcttgccttaggaataaaaccctctttaaaattaaccgcacttgagcaggaaaaaattgaacaggccgcttgctccgtaggattgggcgattatttagagcgtttaccgaattctctttcgggggggcaaaaacaacgagtggcattggcgcgttgtttgttgcgagataagccaattttgttattagatgagcctttttctgcattagatcagaaacttcgggtagaaatgctggctttaatcgctaaactttgtgacgagaaagatttaacattgctacttgttacccaccaaccatcggaattaatcggttcgatagatcaagtgttagtggtggaaaatggtcagataagtcaattgcaaaaaggggtg

SEQ ID NO: 3092 - protein, 217 aa, Haemophilus influenzae
  Name: NTH1717
MLMIYLNNVILNDKTLPMCFNLNVKAGERVAIIGESGAGKSTLLNLIAGFEFPAQGEIWLNDKNHTRSAPYERPVSMLFQENNLFPHLTVQQNLALGIKPSLKLTALEQEKIEQAACSVGLGDYLERLPNSLSGGQKQRVALARCLLRDKPILLLDEPFSALDQKLRVEMLALIAKLCDEKDLTLLLVTHQPSELIGSIDQVLVVENGQISQLQKGV

SEQ ID NO: 3093 - DNA, 252 bp, Haemophilus influenzae
  n 9: n is any nucleotide
  Name: NTH1718
ttgagtggnaaaaccttgcgcgcaccgttgcgttatgcttttgctttaggtttggcgttatctctcggcgattttacggctattgcgttatttggcaatcaagagtttacttctttaccgcatttgttatatcagcagttaggtaattatcgtaatcaagatgccgctgtaaccgcagggattttattattgctttgtggcatattgtttgcctttattcacacatatagggatgctgatgatttatctaaa

SEQ ID NO: 3094 - protein, 84 aa, Haemophilus influenzae
  Name: NTH1718
LSGKTLRAPLRYAFALGLALSLGDFTAIALFGNQEFTSLPHLLYQQLGNYRNQDAAVTAGILLLLCGILFAFIHTYRDADDLSK

SEQ ID NO: 3095 - DNA, 231 bp, Haemophilus influenzae
  Name: NTH1719
gtgggtgtaattcgtaaggaaagcttgattttaaatcttcctggtcagcctaaagcgattaaagaaaccttggaaggcgtgaaagataaagagggaaatgtgcttgtaaaaggcatttttagcgcagtgccttattgtttgcaactgattaacggcttatatattgataccaagcctgaaatcatcgaaagtttccgtcctaaatccgcaagacgcgaaaatctggagaaa

SEQ ID NO: 3096 - protein, 77 aa, Haemophilus influenzae
  Name: NTH1719
VGVIRKESLILNLPGQPKAIKETLEGVKDKEGNVLVKGIFSAVPYCLQLINGLYIDTKPEIIESFRPKSARRENLEK

SEQ ID NO: 3097 - DNA, 336 bp, Haemophilus influenzae
  Name: NTH1720
atgaaaaaaatcgaagcaatgattaaaccctttaaattagacgatgtgcgagaaagtctttcagatattggtatttcaggtatgacaatcacggaagtacgcggatttggtcgccaaaaaggtcatacagaactttatcgtggtgcggaatatatggtggattttctgccgaaagtgaaattggaagtagtggttcctgatgaacttgtggatcaatgtattgaagcgattgttgaaacggcacaaacaggcaaaatcggtgacggcaaaatttttgtttatcacgttgagcgagcgatccgcattcgcacgggcgaagaaaacgaggatgcgatt

SEQ ID NO: 3098 - protein, 112 aa, Haemophilus influenzae
  Name: NTH1720
MKKIEAMIKPFKLDDVRESLSDIGISGMTITEVRGFGRQKGHTELYRGAEYMVDFLPKVKLEVVVPDELVDQCIEAIVETAQTGKIGDGKIFVYHVERAIRIRTGEENEDAI

SEQ ID NO: 3099 - DNA, 1044 bp, Haemophilus influenzae
  Name: NTH1722
gtgcaaaataatttaaatttacaccgcactttgcttggcattgctgcggtgattattatcttagctggcgtaaaattggcggcagaaatcgtggtgccattcttgctatcactctttatcgcgataatttgttcgccgataattaaggcgatgacccaacgccgcgtcccgcattggttagccattactttgctttttgtcttgatttctttggtatttttcttcttagtcgggttgattaacagcacggcaagagaatttacccaatctattccacaatataaagttttgctttcacaacgtgtgagtgatttaactggattgttgcaacgtttcaatctgcctttcacgctttcgcgtgaaaccatccaagaaaattttgacccaagcatcattatgaattttgtaagccgagtattgctgaatttctctggtgtagtgagtaatgtgtttgttttagtgttggttgtgatttttatgcttgccgaagcaccaacgatgaaacataaatttgcaatggtaattagttcaacccctcatgatgcagccaaagaagaacgccatattgatcgcgttttgcaaggcgtaattggttatcttggcatcaaaagcatcacgagtttactgactggcgtcggagtgtttattttgttggaagcctgtggggttcaatatgccattttgtgggcaaccttgagtttcttgctgaattatattcccaatataggttctatcatcgcggctattccgattattgtgcaagccttattactgaatggttttggcattggctttggcgtagcaatcggtgttattgcgattaatatggttgtcggtaacattattgaacctaaaatgatggggcaacgattagggctttcaaccttagtggtgttcctttcattattgttttggggatggctgcttggaacagtgggaatgctactgtctgttcctttgacgatggcattaaaaattgccttggagtccagtcccaatacagcgaaatatgcctgtctattaggagatgtcgaagatttcaaa

SEQ ID NO: 3100 - protein, 348 aa, Haemophilus influenzae
  Name: NTH1722
VQNNLNLHRTLLGIAAVIIILAGVKLAAEIVVPFLLSLFIAIICSPIIKAMTQRRVPHWLAITLLFVLISLVFFFLVGLINSTAREFTQSIPQYKVLLSQRVSDLTGLLQRFNLPFTLSRETIQENFDPSIIMNFVSRVLLNFSGVVSNVFVLVLVVIFMLAEAPTMKHKFAMVISSTPHDAAKEERHIDRVLQGVIGYLGIKSITSLLTGVGVFILLEACGVQYAILWATLSFLLNYIPNIGSIIAAIPIIVQALLLNGFGIGFGVAIGVIAINMVVGNIIEPKMMGQRLGLSTLVVFLSLLFWGWLLGTVGMLLSVPLTMALKIALESSPNTAKYACLLGDVEDFK

SEQ ID NO: 3101 - DNA, 792 bp, Haemophilus influenzae
  Name: NTH1724
gtggcgcacaaagaactattcctcgccaatgtggcgatttgcggctctacccatttagttactactggtctaggcacagaacatttagaagaaaccttgagaccgctatttcctcattattctgtagcgcgaatcgaccgcgatagcacggcacgtaaaggaaaattggaaggttatttagaagatattcaacaaggcaaaagccaaattttgattggcacacaaatgctcgcgaaaggacatcattttccgaatgttactctcgttgccttagtgaatgtagatagtgcattattttcactggattttcgtgcagaagaacgtttagctcaactttatattcaagttgctggacgtgcaggacgtgccgataaacaaggtgaagttgtgctacaaacacattatcctgatcatcctttgcttaccactttattggcaaatggctaccaagcttttgcaaaagaaaccttacaattacgccattcaatgggattgccgccttttacttttcaggcgttattcaaagcacaggctcgacattctgatcttgcagaaaattgcttaagccaaattgcagatttttttcaatcgaagcaaattacgggattacaaatgcttggcccaatgcctgcaccgttcagcaaaaaagcggggcaatatcgctggcagttattattgcaacatccgtcaagaatgacgttgcaaaaagcattaagagaatatcaacaagccgaacttgaaaaaaacagcctagtgcggttaattttggacgtcgatccgcaagacttatca

SEQ ID NO: 3102 - protein, 264 aa, Haemophilus influenzae
  Name: NTH1724
VAHKELFLANVAICGSTHLVTTGLGTEHLEETLRPLFPHYSVARIDRDSTARKGKLEGYLEDIQQGKSQILIGTQMLAKGHHFPNVTLVALVNVDSALFSLDFRAEERLAQLYIQVAGRAGRADKQGEVVLQTHYPDHPLLTTLLANGYQAFAKETLQLRHSMGLPPFTFQALFKAQARHSDLAENCLSQIADFFQSKQITGLQMLGPMPAPFSKKAGQYRWQLLLQHPSRMTLQKALREYQQAELEKNSLVRLILDVDPQDLS

SEQ ID NO: 3103 - DNA, 1461 bp, Haemophilus influenzae
  n 1383: n is any nucleotide
  Name: NTH1725
ttgattatgaaaattgtccgagtggcactggctgtgccgcttcctcgcttatttgattatttcgtccccgatgatgtttcattacaaatcggtatgcgtgttcttgtgccttttggcactcaaaaacgtgtcgccattgtggctgattttccgacaaaatcggacgtgccagaggataaactcaaggctattcttcaaccattggatttagccccactttttacgcccatttattgggattggcttcactgggcagcaaattattatcaagcgggattaggcgatgtgttatttcaagccttgcctgtgaaattgcgtaacggcgaaagtgcggtaaaaaatgaccgcactttttggcgaattacggatgcggggaaaaatgcccttgaacaaggcgaattaaaacgctcgaaaaagcaagctgaagccctacaatgcttatctgaaactgatcttgaaaaaggcaataataatttttcctctgccatttggtctgccttaaaagccaaagggtttattgaagaaattactatccaaacaaatcccctaagctggcaacaaagattaggcaataacccaatagtcaatgctgaaaatcgtttaaccttaaataagcagcaagccttagccttcagccaactgctcttccattctggtttcaatgtatggctgctcgatggcgtgactggttcaggtaaaacagaaatttatctgcagtatattgaagaaattttaaaatcgggtaagcaagtattagtgcttgtacccgaaatcgggctaacacctcaaacggtgcaacgttttaaagcacgttttaatgtagaaattgatgtactgcattctaatttaaccgatacgcaacggctttatgtatgggatcgcgcccgctctggacaaagtgccattgtgattggcacgagatcggcattgttcacgcaattttctaatcttggtgcaattattttggacgaggaacacgattcgtcttacaaacaacaagacagttggcgttaccatgcgcgagacttggcgattgtgctggctcaaaaactaaatattgcggtattaatgggctccgccacgccaagtttagaaagtattaataatgtacaaaacggcaaataccaacatttagttttatcaaaaagagcgggaaattctaccgcacttcgtcatttcgttattgatttgaaaaatcaaaatatacaaaacgggttatcaaaacccttgttggaacgaatgaaagcccatctcgaaaaaggcaatcaagtgttgcttttcttaaatcgacgaggctttgcacccgtattgctttgccatgaatgtggttggatcgcacaatgccctcattgtgaaaaaccttatacctatcatcagcatcanaatgtattggcgttgtcattattgtggcgcacaaagaactattcctcgccaatgtggcgatttgcggctctacccatt

SEQ ID NO: 3104 - protein, 487 aa, Haemophilus influenzae
  Xaa 461: Xaa is any amino acid
  Name: NTH1725
LIMKIVRVALAVPLPRLFDYFVPDDVSLQIGMRVLVPFGTQKRVAIVADFPTKSDVPEDKLKAILQPLDLAPLFTPIYWDWLHWAANYYQAGLGDVLFQALPVKLRNGESAVKNDRTFWRITDAGKNALEQGELKRSKKQAEALQCLSETDLEKGNNNFSSAIWSALKAKGFIEEITIQTNPLSWQQRLGNNPIVNAENRLTLNKQQALAFSQLLFHSGFNVWLLDGVTGSGKTEIYLQYIEEILKSGKQVLVLVPEIGLTPQTVQRFKARFNVEIDVLHSNLTDTQRLYVWDRARSGQSAIVIGTRSALFTQFSNLGAIILDEEHDSSYKQQDSWRYHARDLAIVLAQKLNIAVLMGSATPSLESINNVQNGKYQHLVLSKRAGNSTALRHFVIDLKNQNIQNGLSKPLLERMKAHLEKGNQVLLFLNRRGFAPVLLCHECGWIAQCPHCEKPYTYHQHXNVLALSLLWRTKNYSSPMWRFAALPI

SEQ ID NO: 3105 - DNA, 306 bp, Haemophilus influenzae
  Name: NTH1726
ttggtaaaatttttgaaaccaatcacgctttttccaatggaatcaaaagaaggcgtagaattatttgtacactttggtattgatactgttgagttgaaaggcgaaggctttactcgtattgcacaagaaggtcaatctattaagcgtggtgataccgtgattgaatttgatcttcctttattagaatcaaaagcaaaatctgtcttaacaccaatcgtaatttcaaatatggatgaaatttcttgtatcgtaaaaaaatcaggcgaagtagtggctggagaatcagtagtattagccttaaagaaa

SEQ ID NO: 3106 - protein, 102 aa, Haemophilus influenzae
  Name: NTH1726
LVKFLKPITLFPMESKEGVELFVHFGIDTVELKGEGFTRIAQEGQSIKRGDTVIEFDLPLLESKAKSVLTPIVISNMDEISCIVKKSGEVVAGESVVLALKK

SEQ ID NO: 3107 - DNA, 1743 bp, Haemophilus influenzae
  Name: NTH1729
ttgtttcggaaggtatctatgatttctggcattctcgcatccccaggtattgcctttggtaaggcacttgttcttaaagaagaaaagattgttcttgatacgcaaaaaattacagatgatcaaattgatgaagaagttgctcgattttatgaagggcgtgctgcggcggtagaacaacttaattcaattagagaacgtgcattaatttctttaggcgaggaaaaagccgcaatctttgaaggtcacttgatgattcttgaggatgaagaattagaagaagaaattcttgattatcttcgttcaaataaagtgaatgcaggggttgcagcgagtaaaattttagatcaacaagtgacaatgttatctgaaattgatgatgaatatttgaaagaacgtgcaggcgatattcgggatattgctaaccgtttagttaaaaatattttgggcatgcacattgttgatcttggcgatattcaggaagaatctattcttgttgcttatgatctgactccctcagaaaccgcccaacttaatctcgaaaaagtattaggggttgtcactgatattggtggcagaacttcccatacttcgattatggcacgttctttagaattgccagcgattgtcggcacaaataaagtgactaaattagtcaatacgggcgattacttaattttagatgcgataaataatcaagtttatattaatccaacggcatctcaaattgatgaattaaaagcacttgaagcgaaaatttctgaggaaaaagcagagttagctaaattaaaagatcttccagctattacattggatggacataaggttgatatcgtcgcgaatatcgggacgattcgtgattgtgacggcgcagaacgtaatggagcggaagggattgggctataccgaactgaatttttatttatggatcgtgaacagcttcccacagaagaagaacaatttattgcctataaacaagtggtagaagcaatgaacggacgcttaactgtgcttcgtacgatggatattggcggcgataaagagctttcatatttagatttaccaaaagaaatgaatccattcttgggatggcgtgcaattcgcattgcgttagatcgtcgtgaaattttaaatgcacaattacgtgcggtattgcgtgcttcagcttttggtaaattggcagtgatgttcccgatgattatttcggtagaagaaattcgagaattaaaagcggttattgaaacattaaaggcggaattacgtgaagaagggagagtttttgataataacatacaagtgggtgtcatggttgaaactccctctgcggcggtaaatgcaaaatttttagcaaaagaagtagatttctttagtatcggaactaatgatttaactcaatatactttggctgtagatcgcggtaatgagtttatttcccatctttataatccaatgcacccttctgtgcttggtttaattaaacaagtgattgatgcctctcacacagaaggaaaatggacgggaatgtgtggggaattagcaggggatgaacgcgcgactttattgttacttggtatgggattagatgaatttagcatgagtgcgatttctgtacctcgcattaaaaaattaatccgtaatgtaaatttccaagatgcaaaagcgcttgctgatgccgcattacaaaaaccgaccgctgcagaaattgatcaattaattgaagaatttttgctggaaaattcattaaat

SEQ ID NO: 3108 - protein, 581 aa, Haemophilus influenzae
  Name: NTH1729
LFRKVSMISGILASPGIAFGKALVLKEEKIVLDTQKITDDQIDEEVARFYEGRAAAVEQLNSIRERALISLGEEKAAIFEGHLMILEDEELEEEILDYLRSNKVNAGVAASKILDQQVTMLSEIDDEYLKERAGDIRDIANRLVKNILGMHIVDLGDIQEESILVAYDLTPSETAQLNLEKVLGVVTDIGGRTSHTSIMARSLELPAIVGTNKVTKLVNTGDYLILDAINNQVYINPTASQIDELKALEAKISEEKAELAKLKDLPAITLDGHKVDIVANIGTIRDCDGAERNGAEGIGLYRTEFLFMDREQLPTEEEQFIAYKQVVEAMNGRLTVLRTMDIGGDKELSYLDLPKEMNPFLGWRAIRIALDRREILNAQLRAVLRASAFGKLAVMFPMIISVEEIRELKAVIETLKAELREEGRVFDNNIQVGVMVETPSAAVNAKFLAKEVDFFSIGTNDLTQYTLAVDRGNEFISHLYNPMHPSVLGLIKQVIDASHTEGKWTGMCGELAGDERATLLLLGMGLDEFSMSAISVPRIKKLIRNVNFQDAKALADAALQKPTAAEIDQLIEEFLLENSLN

SEQ ID NO: 3109 - DNA, 276 bp, Haemophilus influenzae
  Name: NTH1730
ttgattagtcgaggtagcattatgtattcaaaagatgtggaaattattgcaccaaacggtttacacacgcgccctgctgcacaatttgtgaaagaagcgaaagcattttcttctgaaattacagtaacctcaggggggaaaagtgcaagtgcaaagagcttatttaagttgcaaacattagttttaacgcagggaacaatacttaccatttctgctgatggagaagacgagcaacaggcagttgaacatttagttgcgttaattcctactttagaa

SEQ ID NO: 3110 - protein, 92 aa, Haemophilus influenzae
  Name: NTH1730
LISRGSIMYSKDVEIIAPNGLHTRPAAQFVKEAKAFSSEITVTSGGKSASAKSLFKLQTLVLTQGTILTISADGEDEQQAVEHLVALIPTLE

SEQ ID NO: 3111 - DNA, 1038 bp, Haemophilus influenzae
  Name: NTH1732
atggctaaacgtaaattaactcaaaaccaaactagaagaattcaatcgaataatgcgaaaacattacatcgccataagaaaaaagacattgaatggtcagatgaaatgcttggcgaatcacaagaaggcgttgtggtcacacgttattctattcacgcagatgtcgaaaatgaacaaggcgaaatttatcgttgtaatttgcgtcgtaccttgtcgagtttggtggtgggagataaagttgtttggcgtaaaggcaatgaacaattacaaggtgtgagtggcgtgattgaggcgatccatccccgagaaaatgaaatttcccgccctgattattatgatggtttgaaacctattgcggcgaatattgatcgtattattattgtatcagcggtgttgccaacgctttccttaaatattatcgatcgttatcttgttgtgtgtgaaattgcgggaatcacgcctctcattgttttgaataaagtggatttattggcacaagaacagcgtcaagaaattgaagaccaacttaaaatttaccaagatattggctatgaaattttaatgatttcagcaaagagcggtgaaaatatggaaaaattgaccgcacttttggcacaaggcacggcgatttttgttgggcaatctggtgttggtaaatcgagtttaattaatcatattttgcctagcgtaaacgctcaagtaggggatgtgagcgaaacatcaggcttagggcagcataccacgacatcgtcacgtctttaccatttgccacaaggcggtaatttaattgattcgcccggaattagagaatttggcctttggcatttagatgcagagcaaatcacaaaaggctatcgagaatttcaatatgttttgggcacctgtaaattccgtgattgtaaacatttgagcgaccccggatgtgcgttgcgtgaagccgttgagcaaggcaaaatttcgcctgttcgttatgatagctatcatcgattaattgaaagtttaagtgaaacaaaatcacaacgtcatttttcattagtt

SEQ ID NO: 3112 - protein, 346 aa, Haemophilus influenzae
  Name: NTH1732
MAKRKLTQNQTRRIQSNNAKTLHRHKKKDIEWSDEMLGESQEGVVVTRYSIHADVENEQGEIYRCNLRRTLSSLVVGDKVVWRKGNEQLQGVSGVIEAIHPRENEISRPDYYDGLKPIAANIDRIIIVSAVLPTLSLNIIDRYLVVCEIAGITPLIVLNKVDLLAQEQRQEIEDQLKIYQDIGYEILMISAKSGENMEKLTALLAQGTAIFVGQSGVGKSSLINHILPSVNAQVGDVSETSGLGQHTTTSSRLYHLPQGGNLIDSPGIREFGLWHLDAEQITKGYREFQYVLGTCKFRDCKHLSDPGCALREAVEQGKISPVRYDSYHRLIESLSETKSQRHFSLV

SEQ ID NO: 3113 - DNA, 567 bp, Haemophilus influenzae
  Name: NTH1733
ttgcataggatacctgatattatgccattcgataaacaaaatcttatttggattgatttagaaatgaccggtttagatccggaaaaagaacgtattattgaaattgcgactattgtgacagataaaaatttaaatattttggcagagggcccagtattagcggttcatcagtctgatgaattactcaataaaatgaatgattggtgccaaaaaacgcatagtgaaaacggcttaattgaacgcgtaaaagccagcaaacttaccgaacgagcagcagaattacaaaccttagactttttaaaaaagtgggttcccaaaggtgcatcgccaatttgcggtaacagcattgcccaagataaacgcttcttagtgaaatatatgccagatttagccgattattttcattatcgccatttagacgtgagcacattaaaagaacttgctgcacgttggaaacctgaaattttagaaggctttaaaaaagagaatacgcatttagcgctagatgacattcgagaatccattaaagagctggcttattatcgcgaacacttcatgaaattagat

SEQ ID NO: 3114 - protein, 189 aa, Haemophilus influenzae
  Name: NTH1733
LHRIPDIMPFDKQNLIWIDLEMTGLDPEKERIIEIATIVTDKNLNILAEGPVLAVHQSDELLNKMNDWCQKTHSENGLIERVKASKLTERAAELQTLDFLKKWVPKGASPICGNSIAQDKRFLVKYMPDLADYFHYRHLDVSTLKELAARWKPEILEGFKKENTHLALDDIRESIKELAYYREHFMKLD

SEQ ID NO: 3115 - DNA, 147 bp, Haemophilus influenzae
  n 17, 46, 143, 144: n is any nucleotide
  Name: NTH1734
atgttaaaaagtgcggntgaattttctcaaaaaataaaggcttgtngatttaataacacaagcccttatttttatgctttcttcaaccgtttggcacgacgtttcattcttcttaccccaacgggtattcgccatgcatgcgnntat

SEQ ID NO: 3116 - protein, 49 aa, Haemophilus influenzae
  Xaa 6, 16, 48: Xaa is any amino acid
  Name: NTH1734
MLKSAXEFSQKIKACXFNNTSPYFYAFFNRLARRFILLTPTGIRHACXY

SEQ ID NO: 3117 - DNA, 882 bp, Haemophilus influenzae
  Name: NTH1735
ttgtggatgcagattatcaaagaagctattacttatagctttgtggatccaaaaattcaaagtttattacatccacataaagaagcacttgtattgccaaacccaatttctgtggaaatgtccgcaatgcgcgtgtctttaatcagcggtttattaggtgcagtgctttataaccaaaatcgccaacaatcccgtgttcgtttatttgaaacaggattacgttttgtgccagatgccaatgctgaatttggcgtgcgtcaagaatttgttttaagtgcggtgattactggaacggcaaaatctgaacattgggcaggtaaagcagagtctgtagatttctttgatcttaaaggcgatttagaatcagtactttctttaacagaaggtggtaatagagttcgttttgttgcaaaacaatttgatgcattacaccctggccaatctgctgctattgaattagatggtcaagaaattggttttattggtgcaattcatccatctattagtcaaaaacttggcttaaatggcaaaacgtttgtatttgaaattctttggaatgcaattgcggcacgtaatgtggtgcaagcaaaagaaatttctaaattcccagcaaaccgtcgtgatttagctttagtcgtcgcggatagcgtaccagcaggggaattaatcgcagcatgtaaacaagcaggtggcgaaaaattggtgcaagtgaacttgttcgatgtatatcaaggtgtgggcgtcgctgaaggctataagagtttagcgattagcttgactgtccaagataatgaaaaaacacttgaagatgaagaaattaatgcagtgatttcagcagtattagcggaggtaaaacaacgctttaatgctgaattaagggat

SEQ ID NO: 3118 - protein, 294 aa, Haemophilus influenzae
  Name: NTH1735
LWMQIIKEAITYSFVDPKIQSLLHPHKEALVLPNPISVEMSAMRVSLISGLLGAVLYNQNRQQSRVRLFETGLRFVPDANAEFGVRQEFVLSAVITGTAKSEHWAGKAESVDFFDLKGDLESVLSLTEGGNRVRFVAKQFDALHPGQSAAIELDGQEIGFIGAIHPSISQKLGLNGKTFVFEILWNAIAARNVVQAKEISKFPANRRDLALVVADSVPAGELIAACKQAGGEKLVQVNLFDVYQGVGVAEGYKSLAISLTVQDNEKTLEDEEINAVISAVLAEVKQRFNAELRD

SEQ ID NO: 3119 - DNA, 159 bp, Haemophilus influenzae
  Name: NTH1736
atggctacgataactaaacttgatattattgaatatttaagcgataaatatcacttatctaaacaagatacgaaaaatgtggtggagaactttttggaagagatccgcttatcgctagaatctggtcaagatgtgaaattatcaggatttggtaatttt

SEQ ID NO: 3120 - protein, 53 aa, Haemophilus influenzae
  Name: NTH1736
MATITKLDIIEYLSDKYHLSKQDTKNVVENFLEEIRLSLESGQDVKLSGFGNF

SEQ ID NO: 3121 - DNA, 141 bp, Haemophilus influenzae
  Name: NTH1738
ttggtaatttttgaattacgcgataagtcatctcgcccagggcgtaacccaaaaacaggtgatgttgtgccagtttctgctcgccgagtagtgacatttaaacctgggcaaaagttacgtgcccgtgtagaaaaaactaaa

SEQ ID NO: 3122 - protein, 47 aa, Haemophilus influenzae
  Name: NTH1738
LVIFELRDKSSRPGRNPKTGDVVPVSARRVVTFKPGQKLRARVEKTK

SEQ ID NO: 3123 - DNA, 483 bp, Haemophilus influenzae
  Name: NTH1739
atgaaagtatataaatcatttttaatcgctactgcctcgctgtttttattcgcttgttccagttttcaaaacgatgattatgcgatgaactataaaggtcaaatcggcgatcctattatggccatagccatgttgagcgaacaacaacatgaatgggctggtacaccttatgtgctcggcggcgtttctcgtcgtggggtagattgttctggttttgtgcagaaaactttcttcgatcgttttaatcttcgtttgcctagaagcactgttgaacaagctaattatggtaaacatgtacgcaaagaacatattcaaactggcgatttaattttctttaaaactggccgaggtcctaatggttatcatgtggggatttatgtaaaagaagataaattccttcatgcttccaccagagggggagtcgtctattcttcaatgaataacccttattggtcgaaagccttctggcaagtcagacggatt

SEQ ID NO: 3124 - protein, 161 aa, Haemophilus influenzae
  Name: NTH1739
MKVYKSFLIATASLFLFACSSFQNDDYAMNYKGQIGDPIMAIAMLSEQQHEWAGTPYVLGGVSRRGVDCSGFVQKTFFDRFNLRLPRSTVEQANYGKHVRKEHIQTGDLIFFKTGRGPNGYHVGIYVKEDKFLHASTRGGVVYSSMNNPYWSKAFWQVRRI

SEQ ID NO: 3125 - DNA, 1053 bp, Haemophilus influenzae
  Name: NTH1740
ttggtcgaaagccttctggcaagtcagacggatttaaaaagtataatgctggaattttccagcattttttataatgatttttttcaaattagggagataaaaatgccctcaaacttaaccgcacttcaaattcaacttgaaattttacgccttattccaaaaactcgttttattaccgcagaagaaatcttacaaaaacttgctgatattggtgttcaacgtgatattcgttcaatccaacgcctgctagaaagtttgtctcaacagtttgaaattgagcgagatatgcgtgataaaccttatggatatcgatggaaatcaaatgctaaaggcttggatttaccgattttaaatgaacagcaatcacttgtgcttatgcttgctaaacaatatctcaatggcattttgccttctagcattatgaactcaatggaggcgttctttcaacaggccgaatataatttggtttatgacagccataaaaaatcaggggcagaatggcttaataaagttgctattgcaccaactagtcagccgttattacctgccaaaatcaatccagaaattttttctcaaattagtaccgcactttatcaaaatcgatttttacaggtgcattatcggagtattcacggtaaagaacataaggcacaggtcaagccattggctttggttcaacaaggaccaagtagctatttagtcgcacaatatgagaatggcgatattttacaccttgctttgcatcgcttgcttaaggtaacagtgagtacaatgatatttgaacgccctgattttaatttgaaatcttatgtagaaagccaaaagtttggttttacctatggtcgaaaaattcgattaactttccgcattaataaagatattggtggatttttaacagaaacaccattatcaatggatcaaacagtaaaagattgtggcactgaatatgaaatttccgctaccgtgattaagagcgctatgctggaatggtggatagcccattttggtgaagattaccaagaaattgaccgcacttatttagacgaaaatgcc

SEQ ID NO: 3126 - protein, 351 aa, Haemophilus influenzae
  Name: NTH1740
LVESLLASQTDLKSIMLEFSSIFYNDFFQIREIKMPSNLTALQIQLEILRLIPKTRFITAEEILQKLADIGVQRDIRSIQRLLESLSQQFEIERDMRDKPYGYRWKSNAKGLDLPILNEQQSLVLMLAKQYLNGILPSSIMNSMEAFFQQAEYNLVYDSHKKSGAEWLNKVAIAPTSQPLLPAKINPEIFSQISTALYQNRFLQVHYRSIHGKEHKAQVKPLALVQQGPSSYLVAQYENGDILHLALHRLLKVTVSTMIFERPDFNLKSYVESQKFGFTYGRKIRLTFRINKDIGGFLTETPLSMDQTVKDCGTEYEISATVIKSAMLEWWIAHFGEDYQEIDRTYLDENA

SEQ ID NO: 3127 - DNA, 429 bp, Haemophilus influenzae
  Name: NTH1742
atggataatgtgatggtagattttccatcaggtattgcaaaactagatgataaaaccaagcgagaatatgaaggtcgatatgatgaagtcgagggcatttttagcttaatggaacctatgccgaatgcgatttctgcggtgcataaattgatgaaaaaatatcatatttatgtgctttctactgcgccttggcataatccttctgcttggagtgataaagtaaaatggattcaacattatttcggtgaagaaaaaggttcagccttatataaacgattgattttatcccatcataaaaatctcaaccaaggtgattatttaattgatgatcgcactaaaaatggtgctggcaaatttcaaggcgagcatgttcattttggtacagaacagtttgctaataaaaggagcctgaaaaatgacagagaaaaa

SEQ ID NO: 3128 - protein, 143 aa, Haemophilus influenzae
  Name: NTH1742
MDNVMVDFPSGIAKLDDKTKREYEGRYDEVEGIFSLMEPMPNAISAVHKLMKKYHIYVLSTAPWHNPSAWSDKVKWIQHYFGEEKGSALYKRLILSHHKNLNQGDYLIDDRTKNGAGKFQGEHVHFGTEQFANKRSLKNDREK

SEQ ID NO: 3129 - DNA, 708 bp, Haemophilus influenzae
  Name: NTH1744
atgacagagaaaaataaaccaatttgcgtggtattaacgggagctggcattagtgccgaaagtggaattccaacttttagatcggaagatggtttgtgggcagggcataaagtagaagaagtttgtacgcccgaagccttgcaaaagaaccgtgcgaaagtgcttgatttctataaccaacgccgtaaaaatgcggcagcagctaagccaaacgctgcgcatctcgccttagttgaactagaaaaagcctatgatgtgagaatcatcacgcaaaatgtggatgatttacatgaacgtgccggcagctcgaaggtgttgcatttacacggtgaattaaataaagctcgcagtagctttgatgaaagttatattgtggattgttttggtgatcagaaattagaagataaagatccaaatggacacccaatgcgcccttacatcgtcttttttggtgaaatggtgccgatgctagaacgagcggttgatattgtggaacaagcagatgttgtgttagtgattggcacttctttacaagtgtatccagccaatggcttagtcaatgaagccccaagaaaagcgccaatttatctgattgatcctaacccaaatacaggatttgttcgtaagcaagttattgcaatcaaagaaaaagcaggcgagggtgtgccaaaagtggtggcagagttattagagaacaccaaaaactca

SEQ ID NO: 3130 - protein, 236 aa, Haemophilus influenzae
  Name: NTH1744
MTEKNKPICVVLTGAGISAESGIPTFRSEDGLWAGHKVEEVCTPEALQKNRAKVLDFYNQRRKNAAAAKPNAAHLALVELEKAYDVRIITQNVDDLHERAGSSKVLHLHGELNKARSSFDESYIVDCFGDQKLEDKDPNGHPMRPYIVFFGEMVPMLERAVDIVEQADVVLVIGTSLQVYPANGLVNEAPRKAPIYLIDPNPNTGFVRKQVIAIKEKAGEGVPKVVAELLENTKNS

SEQ ID NO: 3131 - DNA, 138 bp, Haemophilus influenzae
  Name: NTH1745
ttgtttgatcataatggatacccagttatcaatgatactgggcttgccgcgctcactttattagttgctgaatctgatccgaaacaaaaagaaacgcttattaggcttattatgcatatgcttaagcaagagaaaaaa

SEQ ID NO: 3132 - protein, 46 aa, Haemophilus influenzae
  Name: NTH1745
LFDHNGYPVINDTGLAALTLLVAESDPKQKETLIRLIMHMLKQEKK

SEQ ID NO: 3133 - DNA, 261 bp, Haemophilus influenzae
  Name: NTH1747
atgtctagaagactaagaagaacgaagattgtatgtactatgggcccatcaactgaccgtgataacaatcttgaaaaaattatcgcagcgggcgcaaacgtagttcgtatgaacttctctcacggtacacctgatgaccatatcggacgtgctgaacgtgtacgttctattgcgaaaaaattaggtaaaaccgtggcaatcttaggtgatttacaaggtcctaaaattcgtgtttctacttttaaagacggtaaattttct

SEQ ID NO: 3134 - protein, 87 aa, Haemophilus influenzae
  Name: NTH1747
MSRRLRRTKIVCTMGPSTDRDNNLEKIIAAGANVVRMNFSHGTPDDHIGRAERVRSIAKKLGKTVAILGDLQGPKIRVSTFKDGKFS

SEQ ID NO: 3135 - DNA, 90 bp, Haemophilus influenzae
  Name: NTH1748
atgcttaatggtttcactaatacagccatccttccccccatttggtattacgaaaataattttggtaagcgtgattttttagtattttta

SEQ ID NO: 3136 - protein, 30 aa, Haemophilus influenzae
  Name: NTH1748
MLNGFTNTAILPPIWYYENNFGKRDFLVFL

SEQ ID NO: 3137 - DNA, 1245 bp, Haemophilus influenzae
  Name: NTH1749
atggctgtattagtgaaaccattaagcattacagaaatcaataatgctaaacctaaagagaaagactactcactgtctgatggccaaggtcttttcttgctcgtaaaaatgaatggttcgaaaatttggcgatttcaatattataaaccaatttctaaaaaaagaactttaattagtcttggtgtttatcctgagatttcattgaaagatgctcgagagattagggatttatatcgttctttgttggcgaaaaatatcgatccgcaagattatcgtttacagcaagaacaaaaagccatccaagaacgtcaatttaccttgagcgaaatggggaaggaatggctatacctaaagaaaaatgaagttgatactgggcgattaaaagaagtgacttttattgatattgggaaacggttagaacgtcacttgtttaaagtgttggggcattattctattagtgagatttctgctcctcttgctattgagaaattaaaaccattagaacgagcaggaaaattggatacattgcatcgtattattggttatttaaaccaaataatgatttattcggttaatagaggggtaattaattataatgcaaccgcagatattggaagggtatttattcgaccaatagctgaaaataaccctactattcgcccagagcaattacctaaattgtttgaagatttgcagaatagtacccttgaaattgaaactcgttgtgcattagagctactactacttaccgcaggtcgggctggggctattactcaattagaatgggaaaatgtagatttcgaaaacagcttattgaatataccgaaagaaaaaatgaaggggcgacaaggtaaagtacaagattttatcttgccattatccaaacaagctgtaacgattttgcgcttgttacagaagttgaatcgttgcaatagtaagtttgttttccctagcaaaaaaaatccaagacagcctatatcgaaagagacgccaaataaagcacttggacggatcggttataggaatattttgaccgcacatggtttacgatctgtttttagcacagctatgaatgaggccgaatttaacagtgagattattgaggtgtgcttggcacattttgaatattcttccgttcgtggcacatacaataaagcaaagtatatgccacaacggatcgaatatatgcagtggtgggggaattttgtagaagaggcatctgatgggaaagcattaatgggctgt

SEQ ID NO: 3138 - protein, 415 aa, Haemophilus influenzae
  Name: NTH1749
MAVLVKPLSITEINNAKPKEKDYSLSDGQGLFLLVKMNGSKIWRFQYYKPISKKRTLISLGVYPEISLKDAREIRDLYRSLLAKNIDPQDYRLQQEQKAIQERQFTLSEMGKEWLYLKKNEVDTGRLKEVTFIDIGKRLERHLFKVLGHYSISEISAPLAIEKLKPLERAGKLDTLHRIIGYLNQIMIYSVNRGVINYNATADIGRVFIRPIAENNPTIRPEQLPKLFEDLQNSTLEIETRCALELLLLTAGRAGAITQLEWENVDFENSLLNIPKEKMKGRQGKVQDFILPLSKQAVTILRLLQKLNRCNSKFVFPSKKNPRQPISKETPNKALGRIGYRNILTAHGLRSVFSTAMNEAEFNSEIIEVCLAHFEYSSVRGTYNKAKYMPQRIEYMQWWGNFVEEASDGKALMGC

SEQ ID NO: 3139 - DNA, 285 bp, Haemophilus influenzae
  Name: NTH1751
atggctaaatatttatatcgttacgcattggaaagtaacaatcctacaaacaatgatgatggaaatacatgggaagatgaaagtaggtgttttgataatgtcgctttacatatcgcgaaagaaaacgcttattcctgggatatgtttgaagaaccggaacgcgaagttatgtatgtatggagagatggtgattttgagaacagactgcgttttttagctaaatttgaagttattcaacggcttgatgtgatagagctagaggaagacgacgacccgaacgatttt

SEQ ID NO: 3140 - protein, 95 aa, Haemophilus influenzae
  Name: NTH1751
MAKYLYRYALESNNPTNNDDGNTWEDESRCFDNVALHIAKENAYSWDMFEEPEREVMYVWRDGDFENRLRFLAKFEVIQRLDVIELEEDDDPNDF

SEQ ID NO: 3141 - DNA, 267 bp, Haemophilus influenzae
  Name: NTH1752
atgagtgaaaataatggctggattaattgtgcaaacgaactaccagaaccattttctaccgacttagagtatcgtaatgcaactaacaaacacctaatttattttactgaggatggtgatcattgggctgttggtcttggctggtatttatatgacgataagtcggattgtgaaggttgtttaattccgtattgggaatcggatgaaaaccctggcgaggaagtggaggttatttattggcaaccgctaccacaaccaccggaggaa

SEQ ID NO: 3142 - protein, 89 aa, Haemophilus influenzae
  Name: NTH1752
MSENNGWINCANELPEPFSTDLEYRNATNKHLIYFTEDGDHWAVGLGWYLYDDKSDCEGCLIPYWESDENPGEEVEVIYWQPLPQPPEE

SEQ ID NO: 3143 - DNA, 138 bp, Haemophilus influenzae
  Name: NTH1753
ttgacgaagttgatgggtattgcatttgacaatatgaaagatgagacctttataggtgaattgcaactggcgattaaacgggtagttacgccaattattaaagcaaaacgcaaagcaattttggaggggaaaaatgag

SEQ ID NO: 3144 - protein, 46 aa, Haemophilus influenzae
  Name: NTH1753
LTKLMGIAFDNMKDETFIGELQLAIKRVVTPIIKAKRKAILEGKNE

SEQ ID NO: 3145 - DNA, 168 bp, Haemophilus influenzae
  Name: NTH1754
atgagcaatgaaataacccaaaaagtccgcataacaatcgaagttgaaatggacgactaccaacgtgatcaacttaaaatatcaaaaaatacgcaagtgttaggcggaaatatcgtgctattagactgggaaggtggtgtgtttgacgaagttgatgggtattgcatt

SEQ ID NO: 3146 - protein, 56 aa, Haemophilus influenzae
  Name: NTH1754
MSNEITQKVRITIEVEMDDYQRDQLKISKNTQVLGGNIVLLDWEGGVFDEVDGYCI

SEQ ID NO: 3147 - DNA, 531 bp, Haemophilus influenzae
  Name: NTH1755
atgttcggagcggttgtcagggatgagaatgagattggggaagatatgaaagtgctagacgaacatatccttgagtatatctgggatgaaacattagaccgcatcgcacaacacaccttggtaacgtatatcggtggcagtgttggcacgtatagcgatgatcatgcagagaaaagagcagaagactttgcaatattgagtgtaagacaccttattgaaggctctggattaagcgaaagtcaatttagacggcgggttaaaaagcttatggcacaaggtgttttgttgcaacgcattgggccgaatagctttgtgattaactcggatgtggttaaagacgcagcggtacatgccgcacgatgttggcgcgcaatcggtgtgccgtatggtatggacgacaccgggagagcctgtaaaacattgcctattaacgctctgccgagaagcatttttgagttaaaaacaaattgttatcggattttgagatctgaatatccaagttacaaaggaaaaggagtaggaaatgagcaa

SEQ ID NO: 3148 - protein, 177 aa, Haemophilus influenzae
  Name: NTH1755
MFGAVVRDENEIGEDMKVLDEHILEYIWDETLDRIAQHTLVTYIGGSVGTYSDDHAEKRAEDFAILSVRHLIEGSGLSESQFRRRVKKLMAQGVLLQRIGPNSFVINSDVVKDAAVHAARCWRAIGVPYGMDDTGRACKTLPINALPRSIFELKTNCYRILRSEYPSYKGKGVGNEQ

SEQ ID NO: 3149 - DNA, 417 bp, Haemophilus influenzae
  Name: NTH1756
gtgatggatattattaatttaatcaaacaacaaacgcctgaagaaagacaaacattattcaatgaatttattaaactcttaaaccaaaaaagagaatatgtagatattcctgaaagaattgtatgctctgcttgccaagtgtttgtagatgaaagagatggtacaaatgaagatggcggtgagattatccatgaagtatatggtttaagacactatgacccattcatgcgtaagcagattaaagaattagaaaaacaatacaagtatgctcttttagattgggaacaagggtttctaactaataaaggtcgttttgtaggtcgtaaagaagcaatggaaattgctaaagctcagaaccaagtaattcgtttatctggttcaccaaactcagatattctgttctcagaagatttatat

SEQ ID NO: 3150 - protein, 139 aa, Haemophilus influenzae
  Name: NTH1756
VMDIINLIKQQTPEERQTLFNEFIKLLNQKREYVDIPERIVCSACQVFVDERDGTNEDGGEIIHEVYGLRHYDPFMRKQIKELEKQYKYALLDWEQGFLTNKGRFVGRKEAMEIAKAQNQVIRLSGSPNSDILFSEDLY

SEQ ID NO: 3151 - DNA, 675 bp, Haemophilus influenzae
  Name: NTH1757
gtgagcgccttttgttttaggagaaagaaaatgaaagaatttaacttaaaagcagccttgaatggcgagcctgtgatgttgagaaatggaggaaaagccgttgttaaatacaatttgcttaacgaggttgaaaagctagaggtaagagataccgtatatccgttaatcgggtatagatttgatggtatttacattaatacgacatcatggaacttaacaggtaaatcagtacattgggcaaccatggaatatgacatcattggaatgtgggaagatcctaaactaacgtcagaacaagtgctggaaaaggcttgtaatgaggatttgctagtgctatgcgatggtaatcctgatttacctctaaaagttatcgccaaaactaaaaacggcgagtttgtgatgcagccggaagatggcatcatccaaccatggctcgctaatctgaccatggaatggttctttgtaaaaaaacttgatccaaaattcgacacaagcactttacctaagccgtttaaaccacatattggcgatgagtttttctatttaagcgatggagtgattagatatttttcgttttatgcagattgtgcagctaacttgatgataaatggtcaatgtttccgcacaaaagaagatgctcaaaaatggcttgattttatgaagagtatgatggag

SEQ ID NO: 3152 - protein, 225 aa, Haemophilus influenzae
  Name: NTH1757
VSAFCFRRKKMKEFNLKAALNGEPVMLRNGGKAVVKYNLLNEVEKLEVRDTVYPLIGYRFDGIYINTTSWNLTGKSVHWATMEYDIIGMWEDPKLTSEQVLEKACNEDLLVLCDGNPDLPLKVIAKTKNGEFVMQPEDGIIQPWLANLTMEWFFVKKLDPKFDTSTLPKPFKPHIGDEFFYLSDGVIRYFSFYADCAANLMINGQCFRTKEDAQKWLDFMKSMME

SEQ ID NO: 3153 - DNA, 1161 bp, Haemophilus influenzae
  Name: NTH1758
atgtttacctacggttcaatctgttcagggattgaagcggtaagcgtggcatggaaaggcttaagtaaaccgctgtggtttagcgaaattgagccttttccttgcgccgtgcttgcttatcattatcccaacatcccaaatcttggtgatatgaccaccttacccgaaaaaatcttaaaccgtgaaattcctgcgcctgatgtgcttgttggtggtactccttgtcaagcattttctgtcgctggtttgcgaaactcgttagatgacgagcgcggaaatctcacgttaactttaatacacatattagaggctattgattatgttagataccaagacggtaagcagccgtgcgttttgttgtgggaaaacgttccgggtgtactatccacaaaagacaacgcattcggacaccttttggctggattggttcaagagcgtgagccactgcaaccaacaggggctaaatggtcaaacgctggttatgtgcattcgtcccgaactatcgcgtggcgaatcctcgatgctcaatacttcggactcgcccaacgacgcaagcgcgtgttccttgtggcaagtgctagagaaagaagcgtcgcccaaatactttttgagcgcaaaagcttgcaagggtattctcaatcgtgcggaaaaacgcaacaaggttttacctgctacgctgagggaagctttggaacgtatcgccaatccgtattgggggggctagtaaaagctagtggtggggcgcttggtggtggctctgaaactattgtagtacatggtacgcaagacccgattatttccacatcaactgcccactgcctggggcgcaataatgggcaggaaaatgttttgttcgatatttcagatcgacgcgatgttgtgcgcatacaaaaggacggcactacgccaacacttaccgcaagaatggggacaggtgggaataacattccatgcatgagcatcaaccaaaacattcgcaaacttaccccttcagaatgcgaaaaattacaaggttttcctccaggttatacgcaaatatcgtatcgaaataaaccagccgaagattgcccggatagcccacgctataaagctatcggcaatagtatggctgtaccggttattaagtggatcggggaaagaatgattaattatttaaacaaa

SEQ ID NO: 3154 - protein, 387 aa, Haemophilus influenzae
  Name: NTH1758
MFTYGSICSGIEAVSVAWKGLSKPLWFSEIEPFPCAVLAYHYPNIPNLGDMTTLPEKILNREIPAPDVLVGGTPCQAFSVAGLRNSLDDERGNLTLTLIHILEAIDYVRYQDGKQPCVLLWENVPGVLSTKDNAFGHLLAGLVQEREPLQPTGAKWSNAGYVHSSRTIAWRILDAQYFGLAQRRKRVFLVASARERSVAQILFERKSLQGYSQSCGKTQQGFTCYAEGSFGTYRQSVLGGLVKASGGALGGGSETIVVHGTQDPIISTSTAHCLGRNNGQENVLFDISDRRDVVRIQKDGTTPTLTARMGTGGNNIPCMSINQNIRKLTPSECEKLQGFPPGYTQISYRNKPAEDCPDSPRYKAIGNSMAVPVIKWIGERMINYLNK

SEQ ID NO: 3155 - DNA, 315 bp, Haemophilus influenzae
  Name: NTH1759
atggtagggttggtcaaggcggatacaacagagccaccacaacaatacaacaaaacaaaaacaattcacaatgttaaaaccaaatggagcgtgataagcagtaatactcgagaggtaattactcgcgatattaatgagcatctgaaacgctgggcaagcgaccgaaataacgcattccacaaacttgactacgattcgtgggaggaactatttgactggataaatgaaaaccgcagtagcccatcaacaacagctacaacagcaaaaccgattgtgcctgtgttgcctgtgattaatccaaaacagaggaaaaaa

SEQ ID NO: 3156 - protein, 105 aa, Haemophilus influenzae
  Name: NTH1759
MVGLVKADTTEPPQQYNKTKTIHNVKTKWSVISSNTREVITRDINEHLKRWASDRNNAFHKLDYDSWEELFDWINENRSSPSTTATTAKPIVPVLPVINPKQRKK

SEQ ID NO: 3157 - DNA, 504 bp, Haemophilus influenzae
  Name: NTH1760
gtggaatgcgttatttcggtcgcttgcccagcgtttcagatgctcattaatatcgcgagtaattacctctcgagtattactgcttatcacgctccatttggttttaacattgtgaattgtttttgttttgttgtattgttgtggtggctctgttgtatccgccttgaccaaccctaccattttcgaccttttgcacggttacttccattatcatttctcttgttttgcgccgcatactgttttcacacccacttacagtgccatattgttccctccgctcttccctcgtctgacagctctcttcggttctcttccatccctcttgactctcgctttctcaggcccatctatttttccatgttttgcacccccatcttctcaatcactttattctcaattgttgatgaaccgctactcgtatcgagcacttatatcgtctttcgcctcatgctttcttctctccctcgaacttcctcccagacggcgactgtttctttcgccttt

SEQ ID NO: 3158 - protein, 168 aa, Haemophilus influenzae
  Name: NTH1760
VECVISVACPAFQMLINIASNYLSSITAYHAPFGFNIVNCFCFVVLLWWLCCIRLDQPYHFRPFARLLPLSFLLFCAAYCFHTHLQCHIVPSALPSSDSSLRFSSIPLDSRFLRPIYFSMFCTPIFSITLFSIVDEPLLVSSTYIVFRLMLSSLPRTSSQTATVSFAF

SEQ ID NO: 3159 - DNA, 174 bp, Haemophilus influenzae
  n 161, 162, 163, 164, 165: n is any nucleotide
  Name: NTH1762
ttgggtgggaaaatgtttgatattaacttaacacacgaacagcaacaaaaagcagttgagcaaattcaagaacttatggcaaaaggaattagtagtggagaagcgattcaaatagtggcgaaagcactacgaggggtaccgagtccgaatttcgataccannnnnttaattaat

SEQ ID NO: 3160 - protein, 58 aa, Haemophilus influenzae
  Xaa 54, 55: Xaa is any amino acid
  Name: NTH1762
LGGKMFDINLTHEQQQKAVEQIQELMAKGISSGEAIQIVAKALRGVPSPNFDTXXLIN

SEQ ID NO: 3161 - DNA, 717 bp, Haemophilus influenzae
  Name: NTH1763
atgctagaaattttatatcaagatgagtttctcgttgcggtgaataagcctgatggtatgttggttcatcgcagttggttagatcctcacgaaactcaatttgtgatgcaaactttacgagatcagattggtcagcacgtatttcctattcatcgtttagatcgaccgacatctggcgtgttgttatttgcattgagcagtgaaattgcgaatttaatgtgtgaacagtttgaacaaaagtgcgttcagaaatcttatttggctgtagtgcgagggtatctacagggaaaagagcggatagattatccactaaaaattcaattggataaaatcgcagataaattttctcaagaagataaagagcctcaagaagcagtgactgattatgaaggattaaaaatagtcgaaatgccttatcctgctgggcgttatcaaacggcacgttattctttagttaaattaatccctcatacaggtagaaaacaccaattacgtcgccatatgaaacatatttttcatccgattttaggggatacgcaatatggtgacttacatcaaaatcgtgcattaatgtcacatttaggttgttctcgattatttttacattctaatagtttgtcttttattcatccaataacgaaagagcaaataacaattacagcaggtttagatgaacaatggcatcaattaataaatcaatttgggtgggaaaatgtt

SEQ ID NO: 3162 - protein, 239 aa, Haemophilus influenzae
  Name: NTH1763
MLEILYQDEFLVAVNKPDGMLVHRSWLDPHETQFVMQTLRDQIGQHVFPIHRLDRPTSGVLLFALSSEIANLMCEQFEQKCVQKSYLAVVRGYLQGKERIDYPLKIQLDKIADKFSQEDKEPQEAVTDYEGLKIVEMPYPAGRYQTARYSLVKLIPHTGRKHQLRRHMKHIFHPILGDTQYGDLHQNRALMSHLGCSRLFLHSNSLSFIHPITKEQITITAGLDEQWHQLINQFGWENV

SEQ ID NO: 3163 - DNA, 318 bp, Haemophilus influenzae
  Name: NTH1764
atgcgtaatcaaactaaacagcatcttgaacagcttcaaattaccatgcagcagcttaatttatggcaaacgatgccccctgctgcagaggcgtttttaagtgaagaacctttttcaattgatacgatgtctgccgaagagtggctacagtgggtatttattccacgcatgcaggcattattagaaagtggttcagccttgccacataaaattgctatttctccttatattgaagaagcaatgaaggaatttgatgagttacaacaactattaactcctttagttgctttagaagaacttctgaacaataaccaatgc

SEQ ID NO: 3164 - protein, 106 aa, Haemophilus influenzae
  Name: NTH1764
MRNQTKQHLEQLQITMQQLNLWQTMPPAAEAFLSEEPFSIDTMSAEEWLQWVFIPRMQALLESGSALPHKIAISPYIEEAMKEFDELQQLLTPLVALEELLNNNQC

SEQ ID NO: 3165 - DNA, 1455 bp, Haemophilus influenzae
  Name: NTH1765
atgaaatttatcgttaaactttttcctgaaatcatgattaaaagcgaaactgtgcgtaaacgtttcgcaaaaattttaacctctaatatccgcaatattttacagaaatatgatgaagaaactgcagttgtacgtcactgggattacattgaagtgcggtcaaaaaatgaagagaatcgtgaagaattaatcgccttgttacaacgtattcctggtattcatcattttttagaagttgaagaaaaaccgtttaccgatttacatcatatttttgaattgacgcttgcggatgtcgcgcaacaacttcaaggcaaaaccttttgcgttcgagtaaaacgtaagggtaaacataaatttagttcgattgaagcagaacgttatatcggcggtggattaaatcaacatattgaaagcgcaaaagtgcggttaaaaaatccagatgtgactgttcgtattgatattgaagatgacaaaatgatgttagttaaaacacgtcacgctggtattggcggttatccgattggtacgcaagaagatgtgctttctttaatttcaggaggatttgattcaggcgtatcgagttatatgttgattcgtcgtggttcccgagttcattattgtttctttaatcttggcggtgcagcccatgaaattggcgttaaacaaatggcttatcatatttggcaacgctatagtgcttcacataaagtacgctttattacgattaactttgagggagttgtcggtgagattttagagaaagtcgataacggacaaatgggcgttgtattaaaacggatgatggtgcgagccgcaagtaaagtcgctcaacgtttcaatattgaagcgattgtgacaggggaggcattaggacaagtttctagccaaactttaaccaatttacgcttgattgatgaagccgctgatgccttagtattacgcccgttaattacgcacgataaagaacaaattatcgcgatggcgaaagaaattggtactgacgatattgcaaaatctatgcctgaattttgtggcgtgatttcaaaaaatcctacgatcaaagcggttcgtgaaaagattctagaagaagaagggcattttaatttcgagattcttgaaagttcggtgcaaaatgcgaaatatttagatattcgccagattgcagaagaaacagaaaaagaagtcgtggaagtcgaggcaatttctgtattaggtgaaaatgaagtgattttggatattcgtagcccagaagaaacggatgaaaagccatttgaatcaggtacacatgacgtcattcaaatgccgttctacaaactttcttctcaatttggtagccttgatcaaagtaaaaattacgtgttgtattgtgaacgtggtgtgatgagtaaattacaagccttatatttgaaagaaaatggtttttcaaatgtgcgtgtatttgcaaaaaacattcat

SEQ ID NO: 3166 - protein, 485 aa, Haemophilus influenzae
  Name: NTH1765
MKFIVKLFPEIMIKSETVRKRFAKILTSNIRNILQKYDEETAVVRHWDYIEVRSKNEENREELIALLQRIPGIHHFLEVEEKPFTDLHHIFELTLADVAQQLQGKTFCVRVKRKGKHKFSSIEAERYIGGGLNQHIESAKVRLKNPDVTVRIDIEDDKMMLVKTRHAGIGGYPIGTQEDVLSLISGGFDSGVSSYMLIRRGSRVHYCFFNLGGAAHEIGVKQMAYHIWQRYSASHKVRFITINFEGVVGEILEKVDNGQMGVVLKRMMVRAASKVAQRFNIEAIVTGEALGQVSSQTLTNLRLIDEAADALVLRPLITHDKEQIIAMAKEIGTDDIAKSMPEFCGVISKNPTIKAVREKILEEEGHFNFEILESSVQNAKYLDIRQIAEETEKEVVEVEAISVLGENEVILDIRSPEETDEKPFESGTHDVIQMPFYKLSSQFGSLDQSKNYVLYCERGVMSKLQALYLKENGFSNVRVFAKNIH

SEQ ID NO: 3167 - DNA, 270 bp, Haemophilus influenzae
  Name: NTH1766
gtgaaaaaggataattccatggcgcgtaaacccgcatcttcacaagattttgaaacaacgttagcgcagttagaaaatattgttacacatttagaaaatggcgatctaccgttagaagaagcgttaaaagaatttgaacaaggtgtgcaactcgctaagttagggcaagaacgtttacaacaagcagaacaacgtattcagatcttattgcaaaaaacagaagacgcgccactgaatgattataaagggaatgattatgaagggaatgct

SEQ ID NO: 3168 - protein, 90 aa, Haemophilus influenzae
  Name: NTH1766
VKKDNSMARKPASSQDFETTLAQLENIVTHLENGDLPLEEALKEFEQGVQLAKLGQERLQQAEQRIQILLQKTEDAPLNDYKGNDYEGNA

SEQ ID NO: 3169 - DNA, 888 bp, Haemophilus influenzae
  Name: NTH1767
atgggtcacttttctgaagaattacaacaggttcaaactcgtatcaatcgctttttagaagctcaatttgagggcattgaaagtcataatgcacttttgcttgaggcgatgaaatacgcattattacttggcggtaagcgagttcgccctttcttagtttacgcaacaggtcaaatgcttggtgcagagaaacaaaccttagattacgctgctgctgccattgaagccattcacgcctattccttaattcacgatgatttacctgcaatggatgatgacaatctacgtcgtggacatcctacttgtcatatccaatttgatgaagctacagctattcttgcgggcgatgcgctgcaaagtttcgcatttgaaatattaaccaaaacaccgaatatttctgctgaacaaaaactggctttaattcaaattttagcgcaaggcgctggcgtacaaggaatgtgcttagggcaaagtttagatcttatttctgagcataaacagattagtttaagcgaattagaattaatccatcgtaacaaaacgggtgcattgctaattgccgcattaaaattaggtttcatttgttctccacattttaccgacaaaaggttagaacaatccttaacacaatatgcggaagccattggtttagcctttcaagttcaagatgatattttagatattgaaggcgatagtgcagaaattggcaaacaggtgggtgccgatcttgatttagataaaagtacatatccaaaattacttggattaagtggcgcaaaacaaaaagcgcaagatctatatcaaagtgctttgtctgaattagaaaaaattccttttgatacaaccgcacttcgtgcattagctgaattcgttattaccagaaaaagt

SEQ ID NO: 3170 - protein, 296 aa, Haemophilus influenzae
  Name: NTH1767
MGHFSEELQQVQTRINRFLEAQFEGIESHNALLLEAMKYALLLGGKRVRPFLVYATGQMLGAEKQTLDYAAAAIEAIHAYSLIHDDLPAMDDDNLRRGHPTCHIQFDEATAILAGDALQSFAFEILTKTPNISAEQKLALIQILAQGAGVQGMCLGQSLDLISEHKQISLSELELIHRNKTGALLIAALKLGFICSPHFTDKRLEQSLTQYAEAIGLAFQVQDDILDIEGDSAEIGKQVGADLDLDKSTYPKLLGLSGAKQKAQDLYQSALSELEKIPFDTTALRALAEFVITRKS

SEQ ID NO: 3171 - DNA, 948 bp, Haemophilus influenzae
  n 844: n is any nucleotide
  Name: NTH1768
atgactaataatatgaacaattatcctcttttatctttaattaattctccagaagatttgcgtcttttaaataaagatcagctaccacaactctgtcaagaattacgtgcttatcttttagaatctgttagtcaaactagcggacatttagcgtcaggtttaggcactgttgagctaaccgttgcgctgcattatgtatataagacgccatttgatcagttaatttgggatgtgggacatcaagcttatccacataaaatcctaacgggtcgccgagagcaaatgtccacaattcgccaaaaagacggtattcatccttttccttggcgtgaagaaagtgaatttgatgtattaagtgttggtcactcctctacgtctattagtgcgggattaggcattgccgttgccgcagaacgagaaaatgcaggtagaaaaacagtatgcgtcatcggtgatggcgcaattactgcgggaatggcatttgaggcattaaatcacgcgggggcattgcatacagatatgttagttattttaaatgataacgaaatgtctatttcagaaaacgttggtgcattaaataatcatcttgcgcgtattttctctggctctctttactctacgcttcgtgatggcagtaaaaaaatccttgataaagttccgccaatcaaaaactttatgaaaaaaaccgaagaacatatgaaaggtgtaatgttttcgccagaaagtacattatttgaagaactcggttttaactatattggcccagtggatgggcataacattgatgaattagtggcaatgcttacgaatatgcgtaatctgaaaggccacaatttttgcatantaaaacgaaaaaaggtaaaggatacgcacccgcagaaaaagatcccgattggtttccacggtgtacctaaatttgatccaatcagtggcgaattgcccaaaaca

SEQ ID NO: 3172 - protein, 316 aa, Haemophilus influenzae
  Xaa 282: Xaa is any amino acid
  Name: NTH1768
MTNNMNNYPLLSLINSPEDLRLLNKDQLPQLCQELRAYLLESVSQTSGHLASGLGTVELTVALHYVYKTPFDQLIWDVGHQAYPHKILTGRREQMSTIRQKDGIHPFPWREESEFDVLSVGHSSTSISAGLGIAVAAERENAGRKTVCVIGDGAITAGMAFEALNHAGALHTDMLVILNDNEMSISENVGALNNHLARIFSGSLYSTLRDGSKKILDKVPPIKNFMKKTEEHMKGVMFSPESTLFEELGFNYIGPVDGHNIDELVAMLTNMRNLKGHNFCIXKRKKVKDTHPQKKIPIGFHGVPKFDPISGELPKT

SEQ ID NO: 3173 - DNA, 99 bp, Haemophilus influenzae
  n 90, 91, 92, 93, 94: n is any nucleotide
  Name: NTH1769
gtggcgaattgcccaaaacatagtaaaccactattcgaaaattttggcgattggctattgaaaggcagaaaagatgcaaattattgtttnnnnnttaat

SEQ ID NO: 3174 - protein, 33 aa, Haemophilus influenzae
  Xaa 30, 31, 32: Xaa is any amino acid
  Name: NTH1769
VANCPKHSKPLFENFGDWLLKGRKDANYCXXXN

SEQ ID NO: 3175 - DNA, 297 bp, Haemophilus influenzae
  Name: NTH1770
gtgtttgggattgggcataaagagaaaataaaatttactccgcatattattcactacattggtagcaacaaaccttggttaaaggaacattcagctaactctcctcgtttttataatgaagaatacttgttttatcatcatctttcttgggataatcttagacagacagacagacagacagacagacagacagacagacagacagacagacagacagaaaaatataacccaattgccttgtatgtcaaagtgcggttaattttgaccgcattttttcttttggaaggaaaattacat

SEQ ID NO: 3176 - protein, 99 aa, Haemophilus influenzae
  Name: NTH1770
VFGIGHKEKIKFTPHIIHYIGSNKPWLKEHSANSPRFYNEEYLFYHHLSWDNLRQTDRQTDRQTDRQTDRQTEKYNPIALYVKVRLILTAFFLLEGKLH

SEQ ID NO: 3177 - DNA, 1392 bp, Haemophilus influenzae
  Name: NTH1771
atggcatttcgtattgaaaaagacacaatgggtgaagttcaagttccagcagataaatactgggctgcacaaactgaacgttcacgcaataactttaaaattggcccagccgcatcaatgccacatgaaattatcgaagcttttggctatttgaaaaaagcagccgcatttgctaatcatgatttaggtgtattacctcttgaaaaacgtgatttaattgctctggcttgtgacgaaattttagcaaataaattagatgatcaattcccacttgttatttggcaaactggttctggtacacaatctaatatgaatgtgaacgaagtagttgccaatcgcgcacatgtgataaacggtggaaaattaggtgaaaaatctattattcacccaaatgacgatgtgaacaaatcacaatcttcaaatgatactttcccaacggcaatgcacattgcggcatataaaaaagtagttgagcacaccattccttgtgttgaacgtttacaaaaaacttttgcggcaaaatctgaagccttcaaaaacgtggtaaaaattggccgcactcacttaatggatgcaacgccactcacattaggtcaagaattttcggcttatgcagctcaattagatttcggcttaaaagcattaaaaaatacgctgccacatttaagccaattagcattgggtggaactgcggttggcacaggtttgaatacgccgaaaggctatgatgttaaagtggcagattacattgcaaaattcaccacacttccgtttgtcactgcagataataaatttgaagcattagccgctcatgatgcgattgttgaaactcacggtgcattacgtcaattagcaatgagtttatttaaaattgcgaacgatattcgtctattagcatcaggccctcgttcgggaattggcgaaattttaattcctgaaaatgaaccaggttcttcaattatgccaggtaaagtaaacccaactcaatgcgaagcgatgacaatggtctgtgcacaagtatttggtaatgacactacaatcgcatttgtgggttcacaaggtcacttccaattaaatgtgttcaaccctgtgatgattgcaaacttcttacaatctgctcaattattgggcgatgcttgcgtatctttcgatgaacactgtgcagtgggtattgagccaaactatccacgcattaaacaacaacttgaaaattcattgatgctggtgaccgcacttaatacgaatatcggttatgaaaatgcagctaaaattgcaaaaaccgcacacaaaaatggcaccacattacgtgaagaagcgattaatttaggtttagtgtctgccgaagattttgataaatgggttcgcccagaagatatggtgggtagcttaaaa

SEQ ID NO: 3178 - protein, 464 aa, Haemophilus influenzae
  Name: NTH1771
MAFRIEKDTMGEVQVPADKYWAAQTERSRNNFKIGPAASMPHEIIEAFGYLKKAAAFANHDLGVLPLEKRDLIALACDEILANKLDDQFPLVIWQTGSGTQSNMNVNEVVANRAHVINGGKLGEKSIIHPNDDVNKSQSSNDTFPTAMHIAAYKKVVEHTIPCVERLQKTFAAKSEAFKNVVKIGRTHLMDATPLTLGQEFSAYAAQLDFGLKALKNTLPHLSQLALGGTAVGTGLNTPKGYDVKVADYIAKFTTLPFVTADNKFEALAAHDAIVETHGALRQLAMSLFKIANDIRLLASGPRSGIGEILIPENEPGSSIMPGKVNPTQCEAMTMVCAQVFGNDTTIAFVGSQGHFQLNVFNPVMIANFLQSAQLLGDACVSFDEHCAVGIEPNYPRIKQQLENSLMLVTALNTNIGYENAAKIAKTAHKNGTTLREEAINLGLVSAEDFDKWVRPEDMVGSLK

SEQ ID NO: 3179 - DNA, 243 bp, Haemophilus influenzae
  Name: NTH1773
atgaaaatgaaatccctttttgtggcaatgataacgtttttttctgccgcaccttttgctcattggcaacccatcggaaatgccgaatacacttgggggccgttccatgtttataccattggtttgttttctgaaactggcacttatcaagaaaatgaacgtccattaatgctctctttcaaatatgaaaaacccattgaaggaaaaaatttgcgattacgctcattaaagaaatcgaaacct

SEQ ID NO: 3180 - protein, 81 aa, Haemophilus influenzae
  Name: NTH1773
MKMKSLFVAMITFFSAAPFAHWQPIGNAEYTWGPFHVYTIGLFSETGTYQENERPLMLSFKYEKPIEGKNLRLRSLKKSKP

SEQ ID NO: 3181 - DNA, 321 bp, Haemophilus influenzae
  Name: NTH1774
atgcaagcgacctttcctgatttctcaccaaacgatattttgaactatattgccttacccgatagaggctacttcgtcttaaatgatacagttttagaacacgattttgatgctaaatttaatcaagcatttatcggcatttggcttgcaccgaatagtacttttgtaaaacttcagccacaattattaggcaaaacgaaaagcaatcatgaagcgacagagttttatctcaaacctgaaattgaatcctttgatgaacaagattctacacctgaattaccgccaaattatttattagatagtcagaaaaaatctcaagga

SEQ ID NO: 3182 - protein, 107 aa, Haemophilus influenzae
  Name: NTH1774
MQATFPDFSPNDILNYIALPDRGYFVLNDTVLEHDFDAKFNQAFIGIWLAPNSTFVKLQPQLLGKTKSNHEATEFYLKPEIESFDEQDSTPELPPNYLLDSQKKSQG

SEQ ID NO: 3183 - DNA, 822 bp, Haemophilus influenzae
  Name: NTH1775
atgacaaaaaaatacgatttacattgtcatagtaccgcatcagatggagtgttgagtccaactgaattagtgcatcgtgcttatgcgcaaggtgtgaacgtgctggcattatgcgatcacgatacgattgtgggtattgatgaagctgagattacagcgaaagaagtaggcattgaattgattactggagtagaaatttcgacaaattgggaagggcgagggatccatattgtaggattaaacttcgataaaactcatccaaaaatgaccgcacttttgcaaagtcaaaaagcattacgggaaaaaagagcggtggaaattggcgataaattagaaaaagcagggattcctcatgcttatgacggggcaaaagccttagccgatggcgaagtgacgcgtgctcattatgcacgttatttggtgcagattggtaaggtatctaatgatggtcaggcctttaaacgctatttagggcaaggaaaatcagcatttgttaaagctgaatgggctgatattcccacggcgattgagacaatccatgccgcaggcggtatagctattattgcacatccattacgttataacatgacggggaaatgggtgcgtaagctgatagtcgattttaaggcttggggcggtgatggaatggaaatggcggattgtggtcaaacaaaagatcagcgtcaaatgcttgctcgttgggcaaaagaatttaatctgctgggatccgttggctccgattttcatttcccttgtggctggattgagttaggaaaaaatttagatttagttgatagcgttatcccagtttgggaaaaattt

SEQ ID NO: 3184 - protein, 274 aa, Haemophilus influenzae
  Name: NTH1775
MTKKYDLHCHSTASDGVLSPTELVHRAYAQGVNVLALCDHDTIVGIDEAEITAKEVGIELITGVEISTNWEGRGIHIVGLNFDKTHPKMTALLQSQKALREKRAVEIGDKLEKAGIPHAYDGAKALADGEVTRAHYARYLVQIGKVSNDGQAFKRYLGQGKSAFVKAEWADIPTAIETIHAAGGIAIIAHPLRYNMTGKWVRKLIVDFKAWGGDGMEMADCGQTKDQRQMLARWAKEFNLLGSVGSDFHFPCGWIELGKNLDLVDSVIPVWEKF

SEQ ID NO: 3185 - DNA, 945 bp, Haemophilus influenzae
  Name: NTH1776
ttgaaattagccagtaatcctttatttcaaccgatcttaaaatctcttattcatgctcccaaaggctttccgaaaacggtaatgggtgtaaattttcctaatcccattggattggcggcaggggcagacaaaaatggcgatgcgattgacggctttggtacattgggtttcggttttctcgaggtaggaacagtcacgcccgttgcacaagatgggaatgcaaagccacgtcagtttcgtttgattgaagctgaaggcattattaaccgtaatggttttaataataatggtattgactatcttatagaaaatgtgaaaaacgcccgttataaaggtgtgataggcatcaatattggtaagaataaatttacatctttggaacaaggcaaagatgattatattttctgtttgaacaaagcctataactacgcaggttatattacggtgaatatttcatctcccaatacaccagatttgcgtcaattacaatatggtgattatttcgatgatttattgcgaagcattaaggatcgtcaggctattttggcaaaccaatacaataaatatgtgccgattgcggtaaaaattgcaccagatttaacggaaagtgaattagtgcaaattgcggatacattggttcgtcataaaatggatggcgttattgcaacgaataccacggtttctcgtgatacggttatggggatgaaaaatgccgaacagcaaggcggattaagtggaaagccgttgcagcataaaagcacggagattattaagcgattacatcaagaactgaaaggtcagattccgattattggtagcggcggcattgatgggttgcaaaatgcacaagagaaaattgaggctggtgcagagttgttgcaagtttattcaggattgatttatcacggtccaaaattagtaaaagaattagtaaaaaatattaaa

SEQ ID NO: 3186 - protein, 315 aa, Haemophilus influenzae
  Name: NTH1776
LKLASNPLFQPILKSLIHAPKGFPKTVMGVNFPNPIGLAAGADKNGDAIDGFGTLGFGFLEVGTVTPVAQDGNAKPRQFRLIEAEGIINRNGFNNNGIDYLIENVKNARYKGVIGINIGKNKFTSLEQGKDDYIFCLNKAYNYAGYITVNISSPNTPDLRQLQYGDYFDDLLRSIKDRQAILANQYNKYVPIAVKIAPDLTESELVQIADTLVRHKMDGVIATNTTVSRDTVMGMKNAEQQGGLSGKPLQHKSTEIIKRLHQELKGQIPIIGSGGIDGLQNAQEKIEAGAELLQVYSGLIYHGPKLVKELVKNIK

SEQ ID NO: 3187 - DNA, 213 bp, Haemophilus influenzae
  n 200, 201, 202, 203, 204: n is any nucleotide
  Name: NTH1777
ttgagtatggagaatctcgttattaaatcgaaaactttagatggcaactattatttccatttattaacactattttacttacctaaaagccctcatttctggtttggtggcattggtttctcttccagaaataccccatcttttgttatgttttctctcaaggaaactgttactgcgttggcgcctggttgggcttatannnnnttaattaat

SEQ ID NO: 3188 - protein, 71 aa, Haemophilus influenzae
  Xaa 67, 68: Xaa is any amino acid
  Name: NTH1777
LSMENLVIKSKTLDGNYYFHLLTLFYLPKSPHFWFGGIGFSSRNTPSFVMFSLKETVTALAPGWAYXXLIN

SEQ ID NO: 3189 - DNA, 108 bp, Haemophilus influenzae
  Name: NTH1778
ttgtgccactttttggagcgttattcaaattatcatcatttaaaaaatttaagcctacttgccatatccattgattccgctgatttagtgttaaaagatactgatcaa

SEQ ID NO: 3190 - protein, 36 aa, Haemophilus influenzae
  Name: NTH1778
LCHFLERYSNYHHLKNLSLLAISIDSADLVLKDTDQ

SEQ ID NO: 3191 - DNA, 993 bp, Haemophilus influenzae
  Name: NTH1779
atgaaaaatggcgtaaaacaaatttctttcttatcattaataggcttatcattaataggcttatcattaacgaatatagcttgggcaaaagttgcacgtcctaaaaatgatacactgacaaatacgattcaaagtgcggaattaaaaacctcctctttttcctctatgcctaagaaagaaataccaaataggcatattatttctctttccaaaagccaattagcacaacatccaagacttgttttgcgtgggttaattcttgctttatatcaaaataacactcaggcagttcaactgttattaccactatataaacaatttcctcagcacgataatttcttactcacttgggcaaaggctattgacgcgcgtgaacaaggtgatttaactcaatctattgcttattatcgtgaattattcgctctagacgcatctttactacctttgcgttatcaattagctcaagccctattttttaactatgaaaatgaatctgccaaaattcaatttgaaaaattacgtacagaggtagatgatgaaaaatttttaggtgttattgatcagtatcttttaacactaaatcagcggaatcaatggatatggcaagtaggcttaaattttttaaatgatgataatttgaataacgctccaaaaagtggcacaaaaattggtagttggaccgcttgggaaaaagaaagtgggaaggggggtagggtattctttatcagtagaaaaaaatggccatgggcagatcatttttttagtaaaactatgtttaatgggaatggaaaatattattgggataataaaaaatacaatgaggctactttgcgtataggtggggggttaagttatcaaactgccttagttgaagtctcgttggttccttttcaagaaaagcgttggtatgcaggcggtagctctggaacgaatacaatgaagcaatatgcggataaattgggtatttcgtttagaaaacgtagactggctaag

SEQ ID NO: 3192 - protein, 331 aa, Haemophilus influenzae
  Name: NTH1779
MKNGVKQISFLSLIGLSLIGLSLTNIAWAKVARPKNDTLTNTIQSAELKTSSFSSMPKKEIPNRHIISLSKSQLAQHPRLVLRGLILALYQNNTQAVQLLLPLYKQFPQHDNFLLTWAKAIDAREQGDLTQSIAYYRELFALDASLLPLRYQLAQALFFNYENESAKIQFEKLRTEVDDEKFLGVIDQYLLTLNQRNQWIWQVGLNFLNDDNLNNAPKSGTKIGSWTAWEKESGKGGRVFFISRKKWPWADHFFSKTMFNGNGKYYWDNKKYNEATLRIGGGLSYQTALVEVSLVPFQEKRWYAGGSSGTNTMKQYADKLGISFRKRRLAK

SEQ ID NO: 3193 - DNA, 2007 bp, Haemophilus influenzae
  Name: NTH1780
ttgttttacgccatttttcatattttatccatattcttaaaaaactctaacttgacattattacaaaaaaagaacaataatgcgaattattatcaattttgtataagtattaattctatgaaatctgtacctcttatcactggtggactttcctttttattaagcgcttgtagcgggggaggtggttcttttgatgtagatgacgtctctaatccctcctcttctaaaccacgttatcaagacgatacttcaagttcaagaacaaaatctaatttggaaaagttgtccattccttctttaggaggagggatgaagttagtggctcagaatctgagtggtaataaagaacctagtttcttaaatgaaaatggctatatatcatatttttcctcaccttctacgattgaagatgatgttaaaaatgttaaaacagaaaataaaatacatacaaatccaattgggcttgaacctaatagagcattacaagaccccaatttacaaaaatacgtttattctggtttgtactatattgagaattggaaagacttttccaaattagcaacagaaaaaaaagcctatagtggccattatggttatgcgttttattatggtaataaaactgcaacagacttgccagtaagcggtgtagcaacgtataaaggaacttgggatttcatcactgcaactaaatatggccaaaattattctttgttcagtaatgctagaggtcaagcttattttcgacgtagtgctactcgaggagatattgatttagaaaataattcaaagaatggtgatataggcttaataagtgaatttagtgcagattttgggactaaaaaactgacaggacaactgtcttacaccaaaagaaaaactgatattcaacaatatgaaaaggaaaaactctatgatatagatgcccatatttatagtaatagattcaggggtaaagttactcctacgaaatccacatcggatgaacatccctttaccagcgagggaacattagaaggtggtttttatggacctaatgctgaagaactagggggtaaattcttagctagggataaacgagtttttggggtatttagtgccaaagaaacgccagaaacagaaaaggaaaaattatccaaagaaaccttaattgatggcaagctaattactttctctactaaaacagccgatgcaacaaccagtacaacagccagtacaacagccgatgtaaaaaccgatgaaaaaaactttacgacaaaagatatatcaagttttggtgaagctgattaccttttaattgataattaccctgttcctcttttccctgaaggggatactgatgacttcgtaacgagtaaacatcacgatattggaaataaaacctataaagtagaagcatgttgcaagaatctaagctatgtaaaatttggtatgtattatgaggataaagagaagaaaaacacaaatcaaacaggacaataccaccaatttttgttaggtctccgtactcccagttctcaaattcctgtaacgggaaacgtgaaatatctcggtagttggtttggttatattggtgatgacaagacatcttactccactacaggaaataaacaacaagataaaaatgctcccgccgagtttgatgtcaattttgacaataaaacattaacaggcaaattaaaacgagccgactcacaaaataccgtgtttaacattgaggcaacctttaaaaatggtagtaatgccttcgaaggtaaagcaaccgcaaatgtagtgattgatcccaaaaatacacaagccacatctaaagtcaatttcacgacaacagtaaacggggcattttatggtccgcacgctacagaattaggcggttatttcacctataacggaaacaatcctacagctacaaattctgaaagttcctcaaccgtaccttcaccacccaattcaccaaatgcaagagctgcagttgtctttggagctaaaagacaagtagaaaaaaccaacaag

SEQ ID NO: 3194 - protein, 669 aa, Haemophilus influenzae
  Name: NTH1780
LFYAIFHILSIFLKNSNLTLLQKKNNNANYYQFCISINSMKSVPLITGGLSFLLSACSGGGGSFDVDDVSNPSSSKPRYQDDTSSSRTKSNLEKLSIPSLGGGMKLVAQNLSGNKEPSFLNENGYISYFSSPSTIEDDVKNVKTENKIHTNPIGLEPNRALQDPNLQKYVYSGLYYIENWKDFSKLATEKKAYSGHYGYAFYYGNKTATDLPVSGVATYKGTWDFITATKYGQNYSLFSNARGQAYFRRSATRGDIDLENNSKNGDIGLISEFSADFGTKKLTGQLSYTKRKTDIQQYEKEKLYDIDAHIYSNRFRGKVTPTKSTSDEHPFTSEGTLEGGFYGPNAEELGGKFLARDKRVFGVFSAKETPETEKEKLSKETLIDGKLITFSTKTADATTSTTASTTADVKTDEKNFTTKDISSFGEADYLLIDNYPVPLFPEGDTDDFVTSKHHDIGNKTYKVEACCKNLSYVKFGMYYEDKEKKNTNQTGQYHQFLLGLRTPSSQIPVTGNVKYLGSWFGYIGDDKTSYSTTGNKQQDKNAPAEFDVNFDNKTLTGKLKRADSQNTVFNIEATFKNGSNAFEGKATANVVIDPKNTQATSKVNFTTTVNGAFYGPHATELGGYFTYNGNNPTATNSESSSTVPSPPNSPNARAAVVFGAKRQVEKTNK

SEQ ID NO: 3195 - DNA, 1680 bp, Haemophilus influenzae
  n 1656, 1664, 1665: n is any nucleotide
  Name: NTH1781
atgactaaaaaaccctattttcgcctaagtattatttcttgtcttttaatttcatgctatgtaaaagcagaaactcaaagtataaaagatacaaaagaagctatatcatctgaagtggacactcaaagtacagaagattcagaattagaaactatctcagtcactgcagaaaaagtaagagatcgtaaagataatgaagtaactggacttggcaaaattatcaaaactagtgaaagtatcagccgagaacaagtattaaatattcgtgatctaacacgctatgatccagggatttcagttgtagaacaaggtcgcggtgcaagttctggatattctattcgtggtatggacagaaatagagttgctttattagtagatggtttacctcaaacgcaatcttatgtagtgcaaagccctttagttgctcgttcaggatattctggcactggtgcaattaatgaaattgaatatgaaaatgtaaaggccgtcgaaataagcaagggggggagttcttctgagtatggtaatggagcactagctggttctgtaacatttcaaagcaaatccgcagccgatatcttagaaggagacaaatcatggggaattcaaactaaaaatgcttattcaagcaaaaataaaggctttacccattctttagctgtagcaggaaaacaaggtggatttgaaggacttgctatttacactcaacgaaattcaattgaaacccaagtccataaagatgcattaaaaggcgtgcaaagttataatcgattaatcgccaaagaagatggatctaatgcatactttgtgatggaagatgagtgtccaaaggattataacagttgtataccttcagccaaaccacctgcgaagttatcctcccaaagagaaaccgtaagcgtttcagattatacgggggctaaccgtatcaaacctaatccaatgaaatatgaaagccagtcttggtttttaagaggaggctatcatttttctgaacaacattatattggtggtatttttgaattcacacaacaaaaatttgatatccgtgatatgacatttcccgcttatttaagatcaacagaaaaaccggatttagaaaatagttctttttatccaaagcaagattatggtgcatatcaacgtattgaggatggccgaggcgttaaatatgcaagtgggctttatttcgatgaacaccatagaaaacagcgtgtaggtattgaatatatttacgaaaataagaacaaagcgggaatcattgacaaagcagtgttaagtgctaatcaacaaaacattatacttgacagttatatgcaacatacacattgcagtctttatcctaatccaagtaagaattgccgcccaacacttgataaaccttattcatactatcattctgatagaaatgtttataaagaaaaacataatatgttgcaattgaatttagagaaaaaaattcaacaaaattggcttactcatcaaattgtcttcaatctttgggttttgatgactttacttcagcgcttcagcataaagattatttacctcgacggtgttaccgctacggcaaagagtatttcagagaaacctggtgaaacaccaagaagaaatggtttcaaattacaaccttacttatacccaaaaccaaatgcnatctttgnnaggacgagatcattg

SEQ ID NO: 3196 - protein, 560 aa, Haemophilus influenzae
  Xaa 555: Xaa is any amino acid
  Name: NTH1781
MTKKPYFRLSIISCLLISCYVKAETQSIKDTKEAISSEVDTQSTEDSELETISVTAEKVRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGLAIYTQRNSIETQVHKDALKGVQSYNRLIAKEDGSNAYFVMEDECPKDYNSCIPSAKPPAKLSSQRETVSVSDYTGANRIKPNPMKYESQSWFLRGGYHFSEQHYIGGIFEFTQQKFDIRDMTFPAYLRSTEKPDLENSSFYPKQDYGAYQRIEDGRGVKYASGLYFDEHHRKQRVGIEYIYENKNKAGIIDKAVLSANQQNIILDSYMQHTHCSLYPNPSKNCRPTLDKPYSYYHSDRNVYKEKHNMLQLNLEKKIQQNWLTHQIVFNLWVLMTLLQRFSIKIIYLDGVTATAKSISEKPGETPRRNGFKLQPYLYPKPNAIFXRTRSL

SEQ ID NO: 3197 - DNA, 456 bp, Haemophilus influenzae
  n 447, 448, 449, 450, 451: n is any nucleotide
  Name: NTH1782
atgaaaaaaattgacgtaaaaattttagattctcgcattggaaatgaatttcctctgccaacttacgcaactgaaggttcagcaggtcttgatttacgtgcgttgatcgatgaaagctttgaaattcaaccaggcgaaaccaaattaattccgacagggctatcaatttatattgcggatcccaatttagctgccgtgattttgcctcgctcgggtcttggccataaacacggcattgtgttaggaaaccttgtgggattaattgactccgattatcaagggccattaatggtatcaatgtggaaccgtggaaatgaaccattcaaaattgaagtcggcgatcgtattgctcaacttgttttcgtgccagtagtacaagctgaatttaatattgtagaagattttcaacaaaccgaacgtggagaaggcggtttcggtcatcaggtnnnnnttaat

SEQ ID NO: 3198 - protein, 152 aa, Haemophilus influenzae
  Xaa 150, 151: Xaa is any amino acid
  Name: NTH1782
MKKIDVKILDSRIGNEFPLPTYATEGSAGLDLRALIDESFEIQPGETKLIPTGLSIYIADPNLAAVILPRSGLGHKHGIVLGNLVGLIDSDYQGPLMVSMWNRGNEPFKIEVGDRIAQLVFVPVVQAEFNIVEDFQQTERGEGGFGHQVXXN

SEQ ID NO: 3199 - DNA, 1200 bp, Haemophilus influenzae
  Name: NTH1783
atgaatttaaacggaaaacgtgttgtcgtcggtattacgggcggcattgcagcctataaaacaatagagttgattcgtttattacgcaaagcagaagctgaagtacgtgtagtattaaccccagctgcagcagaatttgttactcctttgacacttcaagccatttctggcaatgctgtatcgcaatctttacttgatccacaagcagagctggcaatggggcatattgaacttgccaaatgggctgatgccattattattgcgccagctagtgcagactttattgcccgtcttactgtaggcatggcgaatgatttactttcaacaatttgtcttgcaactgatgcgccaatttttcttgtgccagcaatgaatcagcagatgtatcaccaatccattactcaacaaaatttaacgactcttcaaacacgtgggattgagcttatcggccccaatagtggttttcaagcttgcggcgatatggggaaagggcgtatgtcagaaccagaggaaatttttaccgcactttctgactttttctctcaaaaacaagatctacaaggattaaatgtcgccattacagcaggcccaacgcgtgaggcaatcgatcccgttcgttatatttctaaccatagttcagggaaaatgggatttgcgattgctgaagcatttgccaaacgtggggcaaacgtcacactgatttcaggcccagtgaatttaacaacaccaaaaaatgtaaatcgaattaatgtcatctcagcacaagaaatgtggcaagcctctcttgaaagtgcggtaaaaaatcaaatttttattggttgtgcggctgttgctgattacagagtagctgaagttgcagaacaaaaaatcaaaaaatctggcgatgaaatatctatcaagttaattaaaaatcccgatattatctcagatgtaggacatttaaaaacacatcgtccttttactgttggatttgcagccgaaacccaaaatattgatgattatgcaaaagataaacttgaacgcaaaaatcttgatatgatttgtgccaacgatgtatctggcggacaagtttttaacgcggatgaaaatgccttgcagcttttttggaaaaatggtcataaaaaattatcgctaaaatcaaaagtagaacttgccgctgatttagtcaatgaaatcatcgaacgctatcaaaaaacctta

SEQ ID NO: 3200 - protein, 400 aa, Haemophilus influenzae
  Name: NTH1783
MNLNGKRVVVGITGGIAAYKTIELIRLLRKAEAEVRVVLTPAAAEFVTPLTLQAISGNAVSQSLLDPQAELAMGHIELAKWADAIIIAPASADFIARLTVGMANDLLSTICLATDAPIFLVPAMNQQMYHQSITQQNLTTLQTRGIELIGPNSGFQACGDMGKGRMSEPEEIFTALSDFFSQKQDLQGLNVAITAGPTREAIDPVRYISNHSSGKMGFAIAEAFAKRGANVTLISGPVNLTTPKNVNRINVISAQEMWQASLESAVKNQIFIGCAAVADYRVAEVAEQKIKKSGDEISIKLIKNPDIISDVGHLKTHRPFTVGFAAETQNIDDYAKDKLERKNLDMICANDVSGGQVFNADENALQLFWKNGHKKLSLKSKVELAADLVNEIIERYQKTL

SEQ ID NO: 3201 - DNA, 702 bp, Haemophilus influenzae
  Name: NTH1785
gtgcggtcaaaatctttcttatttttcttttataaatatatggaaaacaatgatgaattaatgccacgggaaaaattgctggcattcggagcaaaagcattaagtgattatgaactacttgcgatttttttacgtactggtatcaaagattgtcctgttatgtcactttctaaaaatgtattaacgcattttggctccttgcacgctttactttccgcagataaaaaagctttctgttctgtaaaaggcttaggtattacgcaatttattcaactgcaagcgattacggaaatgaccaagcgttatttaaagcaagagatgttaagtacgccgattattaatgatcttgaaacggtaaaactttttttactcactgaattgcaacacgaggaaagagaagtatttatggttttatttttagataatcaacatcgtttgattaaaaaagagcggttatttttaggtacaattaatgtatcagcggtttatccgcgagaaattattaaagaagcactctattgtaatgcggcagctttaattttggcacataatcatccttcaggtataacggagccgagttattcggatcaacttattactaaaaaaattcaagatgcggctgaactaatggaaattcgcgtgcttgatcatttaattgtagggaaaagcgattgttattctttcgcggagaattgtttatta

SEQ ID NO: 3202 - protein, 234 aa, Haemophilus influenzae
  Name: NTH1785
VRSKSFLFFFYKYMENNDELMPREKLLAFGAKALSDYELLAIFLRTGIKDCPVMSLSKNVLTHFGSLHALLSADKKAFCSVKGLGITQFIQLQAITEMTKRYLKQEMLSTPIINDLETVKLFLLTELQHEEREVFMVLFLDNQHRLIKKERLFLGTINVSAVYPREIIKEALYCNAAALILAHNHPSGITEPSYSDQLITKKIQDAAELMEIRVLDHLIVGKSDCYSFAENCLL

SEQ ID NO: 3203 - DNA, 246 bp, Haemophilus influenzae
  Name: NTH1786
ttggagattattatgtctagagtttgtcaagtaacaggcaagcgtccagctgtgggtaataaccgctcacacgcaatgaatgcgacacgtcgtcgttttcttccaaaccttcacactcaccgtttctgggttgaaagtgaaaaccgtttcgtaaccttacgtttaactgcgaaaggtatgcgtattattgataaaaaaggcattgatgcagtattagctgaaatccgtgctcgtggcgaaaaaatc

SEQ ID NO: 3204 - protein, 82 aa, Haemophilus influenzae
  Name: NTH1786
LEIIMSRVCQVTGKRPAVGNNRSHAMNATRRRFLPNLHTHRFWVESENRFVTLRLTAKGMRIIDKKGIDAVLAEIRARGEKI

SEQ ID NO: 3205 - DNA, 168 bp, Haemophilus influenzae
  Name: NTH1787
atggcagctaaaggtgctcgtgagaaaatccgtttagtttctactgcagagacaggtcacttctacacaactgataaaaacaaacgtaatatgcctgaaaaaatggaaatcaaaaaatttgatccagtagtgcgtaaacacgttatctataaagaagcaaaaatcaaa

SEQ ID NO: 3206 - protein, 56 aa, Haemophilus influenzae
  Name: NTH1787
MAAKGAREKIRLVSTAETGHFYTTDKNKRNMPEKMEIKKFDPVVRKHVIYKEAKIK

SEQ ID NO: 3207 - DNA, 1362 bp, Haemophilus influenzae
  Name: NTH1788
atgacaatgattacccctgtacaagcaattcttgcttcaaaccaacattttttagatcgccaagatgtaatggaatccaacgtacgtagttatcctcgcaaattaccttttgcctatgcaaaagcacaaggctgttgggttactgatgttgaaggtaatgaatacctagactttttagcaggcgcaggaacccttgcattaggacataatcatcctatattaatgcaagccattaaagacgtattagatagcggattgccgttacacactttagatttaaccactccacttaaagatgcgtttagtgaagaattattgtcattcttcccgaaagataaatatatcttacaattcacaggcccttctggtgcagatgcaaatgaagcagccatcaaattagccaaaacttacacagggcgtggcaatatcattgctttctctggcggttttcacggtatgacccaaggggcattagccttaacgggtaatcttggtgcaaaaaatgccgttgaaaatttaatgcctggcgtacaatttatgccatatccacacgaataccgctgcccatttggcattggtggcgaagcaggcgcgaaagcagttgaacattactttgagaacttcatcgaagatgtagaaagtggcgtagtaaaaccagctgcagtaattttagaagcaatccaaggagaaggcggcgttgttccagcaccaataagcttcttacaaaaagtacgtgaagtaacccaaaaacacggcattttaatgatcgtcgatgaagtgcaagcgggtttctgccgttctggaagaatgttcgcctttgaacacgcaggcattgagcctgatattattgtgatgtcaaaagcagttggtggcagcttaccattagctgtattagctattcgtaaagaatttgatgcttggcaacctgcaggacatacaggtacatttcgtggcaatcaattagcgatggcgacaggttacgcttcacttaaaattatgcgtgatgaaaacctcgcacaaaatgcccaagagcgtggtgaatacttaaccaacgcattacgtgaattaagcaaagaatatccgtgcatcggcaacgtacgtggtcgtggcttaatgatggggatcgatattgtagacgaacgccaagcgaaagatgcgataggggcttacccgcgcgattgtgaattagcggcagcaatccaaaaagcttgcttcaaaaacaaactcttgctcgaacgtggcggacgcggtggcaacgtggttcgcgtgctttgtgcggtaaacatcaaccaaagtgaatgtgaagagttcatcaaacgcttcaaacaatctgttgtagacgcattgaaagtggtgcgtagt

SEQ ID NO: 3208 - protein, 454 aa, Haemophilus influenzae
  Name: NTH1788
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEHYFENFIEDVESGVVKPAAVILEAIQGEGGVVPAPISFLQKVREVTQKHGILMIVDEVQAGFCRSGRMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQAKDAIGAYPRDCELAAAIQKACFKNKLLLERGGRGGNVVRVLCAVNINQSECEEFIKRFKQSVVDALKVVRS

SEQ ID NO: 3209 - DNA, 231 bp, Haemophilus influenzae
  Name: NTH1789
atgattgaagcctctgtttttatgactaatcgaagtcaagctgtgcgtttgcccgctgaagttcgcttttctgaagaaatcaaaaaattatcggttcgtgtatcgggcagtgatcggattttatcgcctctcaaccaatcttgggatagttttttcttgaatgatcaagcagttagcgatgattttatgaatgaacgagaaattgcatttcaaccagagcgtgaggcttta

SEQ ID NO: 3210 - protein, 77 aa, Haemophilus influenzae
  Name: NTH1789
MIEASVFMTNRSQAVRLPAEVRFSEEIKKLSVRVSGSDRILSPLNQSWDSFFLNDQAVSDDFMNEREIAFQPEREAL

SEQ ID NO: 3211 - DNA, 396 bp, Haemophilus influenzae
  Name: NTH1790
gtgttgaaatatatgcttgatactaacattgtgatttacgtgattaagcgtaggccattggaaattctttctcgctttaatcaaaatgcaggaaaaatgtgcgtgagtagcattactgtggctgaactctattatggagctgaaaaaagcgaatatcccgaaagaaacattgcggttattgaagatttcttatcacgcctcaccattttagattaccaaccaaagcatgcagctcatttcggcaatattaaagctgaactctctaaacaagggaaattgattggcgaaaatgatattcatatagctgctcatgctcgtagtgaagggttaattctggttagtaacaatttaagagaatttgagcgagttatagcattacgtacagaaaattgggtg

SEQ ID NO: 3212 - protein, 132 aa, Haemophilus influenzae
  Name: NTH1790
VLKYMLDTNIVIYVIKRRPLEILSRFNQNAGKMCVSSITVAELYYGAEKSEYPERNIAVIEDFLSRLTILDYQPKHAAHFGNIKAELSKQGKLIGENDIHIAAHARSEGLILVSNNLREFERVIALRTENWV

SEQ ID NO: 3213 - DNA, 1329 bp, Haemophilus influenzae
  n 1324, 1325, 1326, 1327, 1328: n is any nucleotide
  Name: NTH1791
atgtcaaacctcaaacaacacaaacaagctttgttttgcaacgataacgaagccattaacgattatgaaacagcgatgtataatgcggtgcaagcagtctctgcttggctgaaaaatgaaaaaatgtacacaggcggttcaatcaaacaaatgcgagccttaataagcggttttaatccgacgaaagagggtatgggtgtacagaaatcactcgatcatttggtaaaaattttccttaatccaagccttaaagtacatcatccacactcacttgcccatttacattgcccaacgatggtaacaagccaaattgcggaagtactgattaatgcgaccaaccaatcaatggattcatgggatcaaagcccagcaggttcaattatggaggagcatttgatcaactggctacgccaaaaagcaggctatggcgaaggcacatcaggcgtgttcacttctggtggtactcaatctaacttaatgggcgtattgttggcacgcgattgggcgattgcaaaccactggaaaaacgaagacggctctgaatggtcagtacaacgtgatggtattccagcagaagcaatgcaaaaagtgaaagtgatttgttcagaaaacgcacatttctctgtacaaaaaaatatggcaatgatgggcatggggttccaatcggtcgtgaccgtgccatcaaatgccaatgcacaaatggatcttattgcacttaaacaaacacttgcacagcttaaagctgatggcaaaattactgcctgtattgtcgctaccgcaggcacaacagatgctggcgcaattgatgatttaaaagcaatccgcaaacttgccgatgaatatcaagcgtggttacacgttgatgccgcttggggtggcgcattattgctttccaaagattatcgctatttcttagatggtattgaattaactgattccatcacgcttgatttccacaaacacttcttccaaacgatctcgtgtggggcgttcttgttgaaagatcctgagaactatcgctttatcaattacaaagcggattatctcaattcggaatatgatgaagctcacggcgtgccaaacttagtggcaaaatcgctacaaacaactcgtcgtttcgacgcattaaaattatggtttacccttgaagcattgggcgaagatctttacgcttcaatgatcgatcacggcgtaaaactgaccaaagaagtcgagcaatacatcaacgatactcctgccttagaaatgcttgtgccaagtcagtttgcatcggtgttattccgtgtcgtaccaaaaggggtaccgagtcgatattcgaaaacannnnnt

SEQ ID NO: 3214 - protein, 443 aa, Haemophilus influenzae
  Xaa 442, 443: Xaa is any amino acid
  Name: NTH1791
MSNLKQHKQALFCNDNEAINDYETAMYNAVQAVSAWLKNEKMYTGGSIKQMRALISGFNPTKEGMGVQKSLDHLVKIFLNPSLKVHHPHSLAHLHCPTMVTSQIAEVLINATNQSMDSWDQSPAGSIMEEHLINWLRQKAGYGEGTSGVFTSGGTQSNLMGVLLARDWAIANHWKNEDGSEWSVQRDGIPAEAMQKVKVICSENAHFSVQKNMAMMGMGFQSVVTVPSNANAQMDLIALKQTLAQLKADGKITACIVATAGTTDAGAIDDLKAIRKLADEYQAWLHVDAAWGGALLLSKDYRYFLDGIELTDSITLDFHKHFFQTISCGAFLLKDPENYRFINYKADYLNSEYDEAHGVPNLVAKSLQTTRRFDALKLWFTLEALGEDLYASMIDHGVKLTKEVEQYINDTPALEMLVPSQFASVLFRVVPKGVPSRYSKTXX

SEQ ID NO: 3215 - DNA, 1302 bp, Haemophilus influenzae
  Name: NTH1792
ttgaaccaggtaccgatgccggtcggcgtgacagtacatattccattgccattgctcaaccaagtggaaatgacaggctttgactggcaaattccaggcttgcgtgaagagttggtgattgcgctgattaaatcgctgccgaaatcttatcgccgtaacttcgtgcctgcacctaattatactcctgcttttttaagtcgtgcggtgccgttggaaaagccattattagatacgctgatttatgaattgcgtcgtatgactggcgtcaccgtagaagcggaacattggaattgggaacaaattccaagccatctgaaaatgacgttccgtgtggtggatgaaaacggtaagaaaatcgcagaatccatgaatttggatgagctgaaattcaacttaaaagatcgtgtgcaggaaagtatttctgctgtggcagatgatggcattgagcaaagcaggctgcatatttggagctttgcagatttaccacaatgttatgaacaaaaacaacgtggtttcagcgtcaaagcgttcccagctattgtagatgaaaaagatgcggtgggtatcaaactgtttgaaacagagtttgagcaatcggtggcgatgcaacaaggtttacgtcgtttgttattgctcaatgtgccatcaccaattaaatatcttcatgaaaaattgccgaataaggctaaattgggtctgtattttactccgttcggtcgcgtattggatttgatcgatgactgtattgcttgtgccgtagataagctaattgccaattttggcggttttgtgtgggatgaagcaggatttgaaaaattgcgtgatttcgttcgagaaaaccttaacgaagtgaccgtggatattgcgcagaaagtggagcagattcttactctcacttaccaacttaaccaacgccttaaaggcaaaatggatttcacgatggcatttgcattatccgacatcaaatcgcaacttgcaggtttggtgtatcaaggttttgtgcaaaagagcggttatgatcgcctaccagatttacaacgttatctgcaagccattgataaacgtattgataagttggctcaagatgtaaaccgtgatcgtgctgcgatgctacgcgtggaacaagtgcaacaggcttaccaacaattactggctaaactgccaaaatctaaaccgatttctgatgaaattgcggaaattcgctatatgatcgaggaattgcgtgtgagtttatttgcccagcagttggggacaaaatatcaaatatcagataaaagaatagcaaatattattagtcaatac

SEQ ID NO: 3216 - protein, 434 aa, Haemophilus influenzae
  Name: NTH1792
LNQVPMPVGVTVHIPLPLLNQVEMTGFDWQIPGLREELVIALIKSLPKSYRRNFVPAPNYTPAFLSRAVPLEKPLLDTLIYELRRMTGVTVEAEHWNWEQIPSHLKMTFRVVDENGKKIAESMNLDELKFNLKDRVQESISAVADDGIEQSRLHIWSFADLPQCYEQKQRGFSVKAFPAIVDEKDAVGIKLFETEFEQSVAMQQGLRRLLLLNVPSPIKYLHEKLPNKAKLGLYFTPFGRVLDLIDDCIACAVDKLIANFGGFVWDEAGFEKLRDFVRENLNEVTVDIAQKVEQILTLTYQLNQRLKGKMDFTMAFALSDIKSQLAGLVYQGFVQKSGYDRLPDLQRYLQAIDKRIDKLAQDVNRDRAAMLRVEQVQQAYQQLLAKLPKSKPISDEIAEIRYMIEELRVSLFAQQLGTKYQISDKRIANIISQY

SEQ ID NO: 3217 - DNA, 2340 bp, Haemophilus influenzae
  Name: NTH1793
ttgccgaaaatgtgtttggaattaggtttcggcaatttaggcatgattggtcatactcaaccacgccgtattgctgctcgttcggtggcggcacgtattgcggaagaactggaaacagaacttggcgatttagtggggtataaagtccgttttaacgatcaaatcagcgataacacccaaatcaaattgatgactgacgggattctgctagcagaaattcaaaacgatcgttttctcaatcaatattcttgtttgattatcgatgaagcccacgaacgtagcctaaataacgattttattctcggttatctgaaacagttgttgccacgtcgtcgtgatttaaaacttattatcacttctgcaaccattgatgtggaacgcttttccaaacactttaataatgcaccgatcattgaagtctcaggcagaacctatcctgttgaagtgcgttatcgtcccgtagtggaggacgatcaagatcagctacaaggcattctcaatgcggtggatgaattgcaagcagaaggtcgaggcgatatcttgatctttatgaatggagagcgtgaaattcgtgataccgccgaagctttacaaaaacaaaatctaaaatacacggaaattctaccgctctttgcacgcttgtctgcgcaagaacaaaataaaattttccatccaagcggtttaaatcgcattgtattggcgaccaacgtcgcagaaacctcattgaccgtacctggcattaaatatgtgattgacccaggtacagcgcgcatttcccgttatagctatcgcaccaaagtacaacgtttaccgattgaacctatttcacaggcatctgctaatcagcgtaaaggtcgatgtggtcgtgtaagtgaagggatttgtattcgtttatattcggaagaggattttaattctcgtccagagtttaccgatcctgaaattctacgcaccaatttagcctccgttattttgcaaatgacggcattgggtttggatgatattgaagcgttcccatttgttgatgcgccagataaacgccatattcaagatgggataaaactgttggaagaattgggcgcgtttgaaactgttcaaactaaatcgggtgaaaaacgcctattaactagagttggtcgccaactcgctcaacttccagtcgatccgcgccttgccaaaatgatcctaagtgcggtcaattttggctgcgtttatgaaatgatgatcatcgtctctgcgttatccattcaagatccgcgcgagcgtccacaagaaaaacagcaagcttctgatgaaaaacatcgtcgttttgccgataaaaaatcagatttcttggctttcctcaatctttggtattatctacaagaacaacaaaaagaattgagtaaaaaccaattccgtcgtcagtgccaaaaggatttcttaaattatttacgcattcgtgaatggcaggatatttatcatcaaattcgtttaaccgtgcgtgaaatgggcttaccgattaattctgaaaaagcagaatatcagcaaattcataccgcacttttaagcggtttgctttctcatatcggtttaaaagaagcggagaaacaacaatatcttggcgcacgtaatgcccattttgcgattttccccaattctgtgcttttcaaaaaacaaccgaaatgggtgatggcggcagagttagtggaaacctccaaactttgggggcgtatggtggcagaaatcgagccagaatggattgagccacttgccgagcatctcattaaaaaatcctattcagaaccgcgttggtcgaaatcccgtggcgccgtgattgcagatgaaaaagtcacactttacggtgtgccgattgtggctgcgagaccagtgaattacggtgctattgatccaacggtaagccgtgagatttttattcaatctgccttggtggaagggggttggaataccaagcataaattcttcaaagaaaatcaaaggctcgttcaagaagtagaagaattggaacacaaaagccgccgccgcgatattttggtggatgatcgcacattgtttgaattttacgatcagcgtattggcacggaagtggtttcccagaagcattttgatacgtggtggaaaaaggtgcagcaaaaagatcctgaattgcttaattttgaacgttcatttttgatcaatgatgatgcggaacaagtgagcaaactggatttcccgaatttctggtatcaaggcaatttaaaactcaaattgacttatcaatttgaaccaggtaccgatgccggtcggcgtgacagtacatattccattgccattgctcaaccaagtggaaatgacaggctt

SEQ ID NO: 3218 - protein, 780 aa, Haemophilus influenzae
  Name: NTH1793
LPKMCLELGFGNLGMIGHTQPRRIAARSVAARIAEELETELGDLVGYKVRFNDQISDNTQIKLMTDGILLAEIQNDRFLNQYSCLIIDEAHERSLNNDFILGYLKQLLPRRRDLKLIITSATIDVERFSKHFNNAPIIEVSGRTYPVEVRYRPVVEDDQDQLQGILNAVDELQAEGRGDILIFMNGEREIRDTAEALQKQNLKYTEILPLFARLSAQEQNKIFHPSGLNRIVLATNVAETSLTVPGIKYVIDPGTARISRYSYRTKVQRLPIEPISQASANQRKGRCGRVSEGICIRLYSEEDFNSRPEFTDPEILRTNLASVILQMTALGLDDIEAFPFVDAPDKRHIQDGIKLLEELGAFETVQTKSGEKRLLTRVGRQLAQLPVDPRLAKMILSAVNFGCVYEMMIIVSALSIQDPRERPQEKQQASDEKHRRFADKKSDFLAFLNLWYYLQEQQKELSKNQFRRQCQKDFLNYLRIREWQDIYHQIRLTVREMGLPINSEKAEYQQIHTALLSGLLSHIGLKEAEKQQYLGARNAHFAIFPNSVLFKKQPKWVMAAELVETSKLWGRMVAEIEPEWIEPLAEHLIKKSYSEPRWSKSRGAVIADEKVTLYGVPIVAARPVNYGAIDPTVSREIFIQSALVEGGWNTKHKFFKENQRLVQEVEELEHKSRRRDILVDDRTLFEFYDQRIGTEVVSQKHFDTWWKKVQQKDPELLNFERSFLINDDAEQVSKLDFPNFWYQGNLKLKLTYQFEPGTDAGRRDSTYSIAIAQPSGNDRL

SEQ ID NO: 3219 - DNA, 366 bp, Haemophilus influenzae
  Name: NTH1794
atgaaaaacagctcggtaaaacacacattaactcccttacaacaatctcttttttctcaattaaatgacatcatgcgggtggatcaacgtcgcttatccgcccgcattcatggtattggaaaaattaaaagccaagaggctcaacaagccgttgccgctgaaatccaacagcaaattgaacaagctagattacgtgtagaacaacggaaaagtgcggtacaaaatccgatttttttccagagagtttgcccgttagccaacgcaaagtcgaaattcaaaaactgctttctgaacatcaggtcatcgtggtggcaggggaaactggttcaggtaaaaccacccaattgccgaaaatgtgtttggaat

SEQ ID NO: 3220 - protein, 122 aa, Haemophilus influenzae
  Name: NTH1794
MKNSSVKHTLTPLQQSLFSQLNDIMRVDQRRLSARIHGIGKIKSQEAQQAVAAEIQQQIEQARLRVEQRKSAVQNPIFFQRVCPLANAKSKFKNCFLNIRSSWWQGKLVQVKPPNCRKCVWN

SEQ ID NO: 3221 - DNA, 372 bp, Haemophilus influenzae
  Name: NTH1795
atgaaaaacaaataccttactattgccactttaagcggattcttctgtgtcgcactaggcgcatttgcagctcatggcctaagccatatattagaagccaaagcattatcatggattgatacggggttagaatatcaaatgttccataccattgcagtacttgccgttgcattatctgctttacgtgacaataaattcgcccgattatctatgtcttcttggttaattggaatcttattatttagtggaagtttatacgcacttgctttcgaagcaagcaatgtaattgtatggattacgcctattggcggcactttatttttaatcggatggattagcttagcttacggaagtttcaaaagtaaatcgcta

SEQ ID NO: 3222 - protein, 124 aa, Haemophilus influenzae
  Name: NTH1795
MKNKYLTIATLSGFFCVALGAFAAHGLSHILEAKALSWIDTGLEYQMFHTIAVLAVALSALRDNKFARLSMSSWLIGILLFSGSLYALAFEASNVIVWITPIGGTLFLIGWISLAYGSFKSKSL

SEQ ID NO: 3223 - DNA, 450 bp, Haemophilus influenzae
  Name: NTH1796
atgacattacaactcaataccattgctctattactagtgatacttcttattcttggcgtattaagcaacaacagcgcaattaccatttctgctgccgtattacttatcatgcagcaaacttttttatcttctcatattcctttgctcgaaaaatatggcgttaaaattggtatcattattttaaccattggggttttaagccccttagtttcaggaaaaattcagttgcctgatttatcaggttttcttagttggaaaatggctctttctattgcagttggagtgcttgtggcatggcttgcaggtaaaggtgtgcctttaatgggcgaacaaccgattttagtcactggcttgcttatcggcacaattattggtgtagcatttttaggtggaattcccgttggcccacttattgctgcaggtatattagctttacttttagggaaaatt

SEQ ID NO: 3224 - protein, 150 aa, Haemophilus influenzae
  Name: NTH1796
MTLQLNTIALLLVILLILGVLSNNSAITISAAVLLIMQQTFLSSHIPLLEKYGVKIGIIILTIGVLSPLVSGKIQLPDLSGFLSWKMALSIAVGVLVAWLAGKGVPLMGEQPILVTGLLIGTIIGVAFLGGIPVGPLIAAGILALLLGKI

SEQ ID NO: 3225 - DNA, 96 bp, Haemophilus influenzae
  Name: NTH1798
atgttatatgcgatttgggtagtgggtgtattgtttgcaatttgggctagtgcaaaatgcaccatcaataaagaaaaaaaaggtaaatttgaagaa

SEQ ID NO: 3226 - protein, 32 aa, Haemophilus influenzae
  Name: NTH1798
MLYAIWVVGVLFAIWASAKCTINKEKKGKFEE

SEQ ID NO: 3227 - DNA, 729 bp, Haemophilus influenzae
  Name: NTH1799
gtggcttttggtaatttattacaaggcgttccattccattttaacgaattaactcaagtgacttatacaggttcattttttgagctattaaatccattcgcattattatgtggtgttattagcttatcaatgcttgtcactcacggcgcaaactggttacaaatgaaaaccactgaagtcttacgtgatcgtgctcgttcagtaagtcaaattggttctattgtgactttaattacattcgtattagctggcgtatggttatattctaaagatggttatgtagttactagcactatcgatcatttcgctccatcgtctccaatgaataaagaagttgctgtagaaactggcgcgtggtttagaaatttcaatgaaatgccaattctttggattttccctgctttagctgtagttgctgcattattaaatgctgcattttctaaagcgaatcgttgtggttttgcatttttcttctctgcattaacaatggctggtgtgattattactgcagcagtatcaatgttcccatttgtgatgccttcaagttcacatcctgaacaaagtttattaatgtgggattcgacttcaagtgaattaacattaacattaatgctgatttttgcagttgtttttgtggtcattgctttagcttatactatttggtcttactcaaaaatgtttggtcgtttagatgctaatttcattgataaaaataaacactcattatac

SEQ ID NO: 3228 - protein, 243 aa, Haemophilus influenzae
  Name: NTH1799
VAFGNLLQGVPFHFNELTQVTYTGSFFELLNPFALLCGVISLSMLVTHGANWLQMKTTEVLRDRARSVSQIGSIVTLITFVLAGVWLYSKDGYVVTSTIDHFAPSSPMNKEVAVETGAWFRNFNEMPILWIFPALAVVAALLNAAFSKANRCGFAFFFSALTMAGVIITAAVSMFPFVMPSSSHPEQSLLMWDSTSSELTLTLMLIFAVVFVVIALAYTIWSYSKMFGRLDANFIDKNKHSLY

SEQ ID NO: 3229 - DNA, 594 bp, Haemophilus influenzae
  Name: NTH1800
atggttatgttagaagtagaaaaattagtagaggtaaaaaaagggtcaggcgtttatgtagtaagaacccccgaatcaatacatatggaacattcagatttaccagatgtaggtccatttgaacttttacaagctagacaactattagaaagtagtattgctgaattcgcagcgttacaagcgactaaaaaagatattttaaatttaaaacaaatactgaatcgagagaaagaattacttactcagaatcaagatgactatagtgcagacaaagattttcatttggcacttgcagaaattacacaaaatgatgtgttagtcaaattacaagaacaattgtggcaatatcgctttaatagtgcgatgtgggcacaattacattctcgtattttacaaaatgattatcatcatttatggatagaagatcatcaaacaattttatctgctattcaaaagaaaaatgctaatgaagctagaaaagctatgtggcaacacttagaaaatgtaaaagtaaaattatttgaattatctgatgtagaagatccacattttgatggatacctattcaatacaaatccagttgttgtaggtatc

SEQ ID NO: 3230 - protein, 198 aa, Haemophilus influenzae
  Name: NTH1800
MVMLEVEKLVEVKKGSGVYVVRTPESIHMEHSDLPDVGPFELLQARQLLESSIAEFAALQATKKDILNLKQILNREKELLTQNQDDYSADKDFHLALAEITQNDVLVKLQEQLWQYRFNSAMWAQLHSRILQNDYHHLWIEDHQTILSAIQKKNANEARKAMWQHLENVKVKLFELSDVEDPHFDGYLFNTNPVVVGI

SEQ ID NO: 3231 - DNA, 153 bp, Haemophilus influenzae
  Name: NTH1801
atggaacaagcatggcgttggtatggaccaaaagatcctgtttctttatctgatattcgtcaagcaggcgcaactggtatagtcactgcacttcaccatattcctaacggtgaagtgtggagtatcgaagaaattaaaaacgcaaaactgaaa

SEQ ID NO: 3232 - protein, 51 aa, Haemophilus influenzae
  Name: NTH1801
MEQAWRWYGPKDPVSLSDIRQAGATGIVTALHHIPNGEVWSIEEIKNAKLK

SEQ ID NO: 3233 - DNA, 99 bp, Haemophilus influenzae
  Name: NTH1802
atggctttagaagaagaatttgatattgaaattcctgatgaagaagctgaaaaaattaccactgttcaatctgcgattgattacgtgcaaaacaatcaa

SEQ ID NO: 3234 - protein, 33 aa, Haemophilus influenzae
  Name: NTH1802
MALEEEFDIEIPDEEAEKITTVQSAIDYVQNNQ

SEQ ID NO: 3235 - DNA, 660 bp, Haemophilus influenzae
  n 651, 652, 653, 654, 655: n is any nucleotide
  Name: NTH1803
gtgtttatgctttacttagaatttttatttttactattaatgctttatatcggtagccgttacggcggtatcggattaggtgttgtttctggtatcggtcttgctatcgaggttttcgtatttcgtatgccagtggggaaagcaccgattgatgttatgcttatcattcttgcggtggtgacttgcgcatccgtacttgaagcagctggcggtttgaaatttatgttacaaattgctgaacgcattctccgtaaaaatccaaaacgtgtcactttactcggcccattagtcgtctatttattaacctttatgcttggtactggtcactctgtttacacaattatgccaatcatcggcgatgttgcattgaaaaacaaaattcgtccagaacgtccaatggcagcgtcttcggtagcatcgcaattagccatcacatcaagcccactttctgcagctggtgtattttatctaggtaaaaatacagcaatgcccgcttttgagcatattagtttattagatattatttgtgtaaccgtttctgctactttagcgggtacgaatgcgcctttcttatacagtaatgcgcgggggaaaagaagtagcacaagatcctcgatattcacgttgtttaccagatccactattgccgannnnnttaat

SEQ ID NO: 3236 - protein, 220 aa, Haemophilus influenzae
  Xaa 217, 218, 219: Xaa is any amino acid
  Name: NTH1803
VFMLYLEFLFLLLMLYIGSRYGGIGLGVVSGIGLAIEVFVFRMPVGKAPIDVMLIILAVVTCASVLEAAGGLKFMLQIAERILRKNPKRVTLLGPLVVYLLTFMLGTGHSVYTIMPIIGDVALKNKIRPERPMAASSVASQLAITSSPLSAAGVFYLGKNTAMPAFEHISLLDIICVTVSATLAGTNAPFLYSNARGKRSSTRSSIFTLFTRSTIAXXXN

SEQ ID NO: 3237 - DNA, 105 bp, Haemophilus influenzae
  n 92, 93, 94, 95, 96: n is any nucleotide
  Name: NTH1804
atgcgcctttcttatacagtaatgcgcgggggaaaagaagtagcacaagatcctcgatattcacgttgtttaccagatccactattgccgannnnnttaattaat

SEQ ID NO: 3238 - protein, 35 aa, Haemophilus influenzae
  Xaa 31, 32: Xaa is any amino acid
  Name: NTH1804
MRLSYTVMRGGKEVAQDPRYSRCLPDPLLPXXLIN

SEQ ID NO: 3239 - DNA, 1458 bp, Haemophilus influenzae
  Name: NTH1805
ttgaaattgggctttgacgtgatcgtggaacacgatgcaggttttaaagctagttttgaagatcaagcatttttagaggcaggcgcgaagatcggtacgtcggctgaaatttggcaatcggatattatcttcaaagtaaatgcaccgacagatgaagaaatcgctcaaatgaaggaaggagcaactctcgtgagctttatttggcgcatgcaaaatcctgagttaatgaaaaaactcaccgcgaaaaaaattaatgtgttagcaatggatgcggtgcctcgtatttctcgtgcgcaagcattggatgcgctttcttctatggcgaatatttctggttatcgtgctgtcattgaagctgcgcatgaattcggtagcttctttactgggcaaattactgcagcaggtaaagttccaccagcaaaagtgttggttattggtgcgggtgtggctggtttggcggcaattggtgcagcaaatagccttggggcgattgttcgtgcttttgactctcgtcctgaagtgaaagagcaagttcaaagtatgggtgcgagcttcttagaaattgatttcaaagaagaaggtggcagtggcgatggttatgcgaaagtgatgtcggaagaatttaaccgtcgtgcgatggagctttatgcagaacaagctaaagaagtcgatattattattactacggcagccattccaggtaaaccagcgcctcgtttaatcaccaaagaaatggtagattcaatgaaaccaggttcggtgattgtggatttagccgctgcaactggcggtaactgtgaatatacgcaagcagggaaagttgttacaactgaaaaccaagtgaaagtgattggttatacagatttcccaagccgtttaccaacgcaatcttctcaactttatggcacaaacttagtcaatttattaaaacttttgtgcaaagagaaagatggcaatatcaatattgattttgaagatgtggttcttcgtggtgtaaccgttgttcgtgatggggaagaaattccaccagcacaaattcaagtgtctgcacaaccaaaacaagaaaccaaagctgcaccagtggcagagaaaaaagaatctaaaccaacagatcctcgtgtgaaatacggtgtgatggctggtgttggcgtgttattcctttggttagcttctgtggcgccagctgcatttttatcacatttcaccgtatttgttttagcttgtgtggtgggttattacgtggtttggaatgttagccatgcacttcacacaccattaatggcagtaacaaatgcaatttcaggcattattattgtaggtgcgttattacaaattcgtcagccaacaggcaatctatttatcgatgcgttagcttttgtggcgattttggtggcaagcatcaatatttttggtggtttccgtgtcacacaacgtatgttagcaatgtttagaaaaggt

SEQ ID NO: 3240 - protein, 486 aa, Haemophilus influenzae
  Name: NTH1805
LKLGFDVIVEHDAGFKASFEDQAFLEAGAKIGTSAEIWQSDIIFKVNAPTDEEIAQMKEGATLVSFIWRMQNPELMKKLTAKKINVLAMDAVPRISRAQALDALSSMANISGYRAVIEAAHEFGSFFTGQITAAGKVPPAKVLVIGAGVAGLAAIGAANSLGAIVRAFDSRPEVKEQVQSMGASFLEIDFKEEGGSGDGYAKVMSEEFNRRAMELYAEQAKEVDIIITTAAIPGKPAPRLITKEMVDSMKPGSVIVDLAAATGGNCEYTQAGKVVTTENQVKVIGYTDFPSRLPTQSSQLYGTNLVNLLKLLCKEKDGNINIDFEDVVLRGVTVVRDGEEIPPAQIQVSAQPKQETKAAPVAEKKESKPTDPRVKYGVMAGVGVLFLWLASVAPAAFLSHFTVFVLACVVGYYVVWNVSHALHTPLMAVTNAISGIIIVGALLQIRQPTGNLFIDALAFVAILVASINIFGGFRVTQRMLAMFRKG

SEQ ID NO: 3241 - DNA, 1422 bp, Haemophilus influenzae
  Name: NTH1806
atgtctgaaggtttagtacaggctgcgtatattttagcagcattacttttcattatgagcttggcaggactttctaaacatgaaactgctaaagcaggttgttggttcggtattgttggtatgacaattgcccttatcgcaaccatttttggccctcattctgaaggaacattttggatcattattgcgatgatcattggtggagcaatcggtgttcaacgtgcattaaaagtagaaatgactgaaatgccagaactggtggcgattcttcacagttttgtcggtttagcagctgtactcgttggctttaatagctatggtttacaccatgaggcgttaatgccagaaggattagatgcagcagcacaagccgcatttgtagcagagcaagtagtattaacgaatattcataatgttgaagtatttttaggtatttttatcggtgcagtaactttcactggttctgttgttgcatttggtaaattaagcggaaaaattaattcaaaagcattaatgttaccgcatcgccataaattaaatttagccgcacttgtggtatctgcattattgatggttgcattcttgaataatccagaaagcattttccctgtgttattaatgacagcgattgcgcttgcatttggatggcacttagtggcatcaatcggtggggcagatatgccagttgtggtatcaatgcttaactcttattcaggttgggcagcagctgcggcaggttttatgttgaataatgatttgctgatcgttacaggtgcgcttgttggttcttctggtgcaattctttcttacattatgtgtaaagcgatgaaccgttcatttgtgagcgtcattgcgggtggttttggtaacgatgttcaagtttcttcaagcgaagaacaaggcgaacaccgtgaaactacagcagaagaagtagctgagttgttgaaaaatgcaagttctgtgattatcacgccgggatatggtatggctgttgcacaagcacaatatccagtcgctgatattacggcaaaattgcgtgaacgtggtgtgaacgttcgttttggtattcaccctgttgcaggacgtttaccgggccacatgaacgtgcttttagctgaagcgaaagtaccttacgatgtcgtacttgaaatggatgaaatcaatgatgattttgctgataccgatgtggtattggttataggtgcgaacgatacggtaaacccagcggcgatggaagatccaaatagcccaatcgcgggaatgcctgtgttagaagtatggaaagcacaaaatgtgattgtgttcaaacgttcaatggcagtgggttacgctggcgtacaaaatccattattcttcaaagagaatacgcaaatgctctttggtgatgcaaaagatcgcgttgaagatatcttaaaagcatta

SEQ ID NO: 3242 - protein, 474 aa, Haemophilus influenzae
  Name: NTH1806
MSEGLVQAAYILAALLFIMSLAGLSKHETAKAGCWFGIVGMTIALIATIFGPHSEGTFWIIIAMIIGGAIGVQRALKVEMTEMPELVAILHSFVGLAAVLVGFNSYGLHHEALMPEGLDAAAQAAFVAEQVVLTNIHNVEVFLGIFIGAVTFTGSVVAFGKLSGKINSKALMLPHRHKLNLAALVVSALLMVAFLNNPESIFPVLLMTAIALAFGWHLVASIGGADMPVVVSMLNSYSGWAAAAAGFMLNNDLLIVTGALVGSSGAILSYIMCKAMNRSFVSVIAGGFGNDVQVSSSEEQGEHRETTAEEVAELLKNASSVIITPGYGMAVAQAQYPVADITAKLRERGVNVRFGIHPVAGRLPGHMNVLLAEAKVPYDVVLEMDEINDDFADTDVVLVIGANDTVNPAAMEDPNSPIAGMPVLEVWKAQNVIVFKRSMAVGYAGVQNPLFFKENTQMLFGDAKDRVEDILKAL

SEQ ID NO: 3243 - DNA, 915 bp, Haemophilus influenzae
  Name: NTH1807
atggataaactcaacgcgatttctattttctgcaaagtcattgaaactcaaagttttacattggcagcaaagcaacaaaatatttctgtggcgatggcaagcaaattagtttcacaattagaagaacatttaaaaacacgattgttacaacgtaccaccagaaaaattatgcctactgaagctggaataatgtattatcaacgctgccaaggaattttacttgatttagatgaagcagattccagcatcacccaccttaccagttcattacaaggaaatttactgatttccgttcctcgtgattttggtttactttttattgcaccaaatttacccacttttatggctaagcatcctcatttgcatattgaagttgaatttaatgataagaaaatcgatttattatccgaaggctatgatcttgctcttcgtattggttatatggaagatagctcgttagtttcacgtaaaataggaactactactgttcattttgcagcgtcgcctaattatcttgaaacgaatggtattccacaaacgcctgatgatttagaacatcacaatggcttactttataaaaatgcaatgaatcaggtaaattgggttggttcacgtataaatcaaacccaacgtttcaaaatccaatccaaagtggtaagcaatagcggttttgccttattaaatatggcaaaagcgggactaggtattgctaatttaccaaaatttattttaggtagagcctttgaaaaaggcgagcttattgaaatattaccagaatataaacaacaaaaattagaaattcatgtggtctatccaaacagaagacatttaccaataaaagtacgggcatttattgaatttttatctggcttaggcttgtgttcagaaattttggaaaatcatgaagataatatt

SEQ ID NO: 3244 - protein, 305 aa, Haemophilus influenzae
  Name: NTH1807
MDKLNAISIFCKVIETQSFTLAAKQQNISVAMASKLVSQLEEHLKTRLLQRTTRKIMPTEAGIMYYQRCQGILLDLDEADSSITHLTSSLQGNLLISVPRDFGLLFIAPNLPTFMAKHPHLHIEVEFNDKKIDLLSEGYDLALRIGYMEDSSLVSRKIGTTTVHFAASPNYLETNGIPQTPDDLEHHNGLLYKNAMNQVNWVGSRINQTQRFKIQSKVVSNSGFALLNMAKAGLGIANLPKFILGRAFEKGELIEILPEYKQQKLEIHVVYPNRRHLPIKVRAFIEFLSGLGLCSEILENHEDNI

SEQ ID NO: 3245 - DNA, 210 bp, Haemophilus influenzae
  n 197, 198, 199, 200, 201: n is any nucleotide
  Name: NTH1808
gtgatattaggtaatcaaatgagtaaatccttggtgattgtggagtcgccagcaaaagcaaaaactattaataagtatttaggtagccaatatgtcgtgaaatcgagcgttggacatattcgtgatttgccgacggttggttctagtacaggtgaaaaagctaaaccaatttcaaccaaaggtatggatgccgaagnnnnnttaattaat

SEQ ID NO: 3246 - protein, 70 aa, Haemophilus influenzae
  Xaa 66, 67: Xaa is any amino acid
  Name: NTH1808
VILGNQMSKSLVIVESPAKAKTINKYLGSQYVVKSSVGHIRDLPTVGSSTGEKAKPISTKGMDAEXXLIN

SEQ ID NO: 3247 - DNA, 150 bp, Haemophilus influenzae
  Name: NTH1809
gtgcaagatgtcaataaattacttaaacaattcgatgaaatgcaacgtatgatgaagaaaatgcgtaaaggcggcatggctaaaatgatgcgtggaatgcaaggcttaatgggcggaggcttaggcggtttaggcggaatgtttaaacga

SEQ ID NO: 3248 - protein, 50 aa, Haemophilus influenzae
  Name: NTH1809
VQDVNKLLKQFDEMQRMMKKMRKGGMAKMMRGMQGLMGGGLGGLGGMFKR

SEQ ID NO: 3249 - DNA, 780 bp, Haemophilus influenzae
  Name: NTH1811
ttgcatgatttgaaagaccggttggatgaaaccggcgtgtacgaacaagcggaggtcaacgattttactgaaggctattttgccaataaagacgcacagcaattaagcagtatgattgatgtggctgtccaacgttttgatgatgaattggaattggatttggatcgaaatgaaaaagttgattttaaaatcaaggcaaaacagtttttaaaaatttacgggcaaatggcctccatcatcaattttgaaaatatcgcttgggaaaagctctattggttcctcaaattcttagtacccaaattaaaagtacaagacccgatggatgaatttgatgaaattttagatgcagtggatttaagctcttacggcttggcgcgcaccaagctgaattacagcattaaattagatgatgaagaaacagagcttgacccgcaaaaccccaatccgcgcggtacgcatggtgaagataaagaaaaagatccgattgatgaaattattcgtgtatttaacgaaagatggtttcaagattggagcgcaacgccggatgagcaacgggtaaaatttatcaatattaccgagcgcatccgcagccataaagactttgagcagaaatatcaaaataacccggatattcatacccgtgaattggctttccaagccattttgcgcgatgtgatgagcgaacgccatagggatgaattagagctatacaaactttttgccaaagatgccgcatttagaaccgcttggacgcaaagtttgcaacgggctttggctgga

SEQ ID NO: 3250 - protein, 260 aa, Haemophilus influenzae
  Name: NTH1811
LHDLKDRLDETGVYEQAEVNDFTEGYFANKDAQQLSSMIDVAVQRFDDELELDLDRNEKVDFKIKAKQFLKIYGQMASIINFENIAWEKLYWFLKFLVPKLKVQDPMDEFDEILDAVDLSSYGLARTKLNYSIKLDDEETELDPQNPNPRGTHGEDKEKDPIDEIIRVFNERWFQDWSATPDEQRVKFINITERIRSHKDFEQKYQNNPDIHTRELAFQAILRDVMSERHRDELELYKLFAKDAAFRTAWTQSLQRALAG

SEQ ID NO: 3251 - DNA, 264 bp, Haemophilus influenzae
  n 90: n is any nucleotide
  Name: NTH1812
ttgctggtggtcgccaataaatatctgaccggtttcgatcagccgaaattgtgtgccatgtatgtggataagaaactctccggcgtgctntgcgtgcaggctttatctcgtttgaatcgcagtgcgaataagttgagtaaacgcacggaagatttgtttgtattggacttttttaacagcgttgaagatattcagcaggcattgagccgttttatacttctacttcgttgtcgcaggcaaccgatgtcaatgtcttgcatgatt

SEQ ID NO: 3252 - protein, 88 aa, Haemophilus influenzae
  Name: NTH1812
LLVVANKYLTGFDQPKLCAMYVDKKLSGVLCVQALSRLNRSANKLSKRTEDLFVLDFFNSVEDIQQALSRFILLLRCRRQPMSMSCMI

SEQ ID NO: 3253 - DNA, 1938 bp, Haemophilus influenzae
  Name: NTH1813
atggaaaataagctgggcgagccgaaggctgaatacctgccgcgccatcatggttttaaactggcattttcacaggattttgatgcgcagtttgccatcgacacacgtctgttttggcaattcctgcaaaccagccaagaggcagaacttgcccgttttcaacaactcaacccaaacgactggcagcgtaaaattttggagcgattagaccgccaaataaagaaaaacggcgtgttgcacctgctgaaaaaaggcttggatattgatagcgcccattttgatttgctctaccccgttccgcttgccagcagcggcgaaaaggtcaagcagcgttttgaacagaatttgtttagctgtatgcgtcaagtgccttattctgcctcaagcaatgaaacggtggatatggtgctgtttgccaatggcttgccgattattgcccttgagctgaaaaaccattggacaggtcagacagccattgatgcgcaaaaacaatacctcaaccgtgatttaagccaaacgttgttccatttcgggcgttgtttggcgcattttgccttagatacggaagaagcttatatgaccaccaaattggcggggcctgctacgtttttcttgccgtttaacttgggcaacaactgcggtaagggtaatccgcccaatcccaatggacaccgcacggcgtatttatggcaagaggtgttcggcaaagcaagccttgccaacattattcagcattttatgcgcttagacggttcaaccaaagatccgttggataaacgtaccctctttttccctcgctatcaccaattagatgtggtccgccgtttgattgctgatgtcagtgaacatggcgtgggtaaacgttatttgattcaacattctgccggttcgggcaagtctaattccattacttggctggcgtatcagttgattgaggcatatccgcgcaatgaaaaggcggcaaacggtagagaggcagaccgcccgatttttgattcggtgattgtcgtaaccgaccgtcgtttgttggataagcaactgcgcgacaatatcaaagatttttcagaagttaaaaacattgttgcgccggcgttgagttcggcagagttgcgccaatcgcttgagcagggcaaaaaaatcattattaccacgattcaaaaattcccgtttattgtcgatggcattgctgatttaggcgacaaacaatttgcggtgattattgatgaggcacacagctcacaatcaggttcggcacacgacaatatgaaccgggccatcggcaaaacggaagaccttgatgctgaagatgtgcaagatttgattttacaaaccatgcaatcccgcaaaatgcacggcaatgcgtcgtattttgctttcaccgccacaccgaaaaacagcactttggaaaaattcggcgaaaaacaggcggatggcaagtttaagccgttccacctttattctatgaagcaggcgattgaagaaggctttattttggatgtaatcgccaattacaccacctataaaagtttttatgagatcactaagtcgattgaagataatccggagtttgatagtaaaaaggctcaaagccgtctgaaagcctatgtggagcgttcgcaacaaacgattgatactaaagcggagataatgctggatcattttatttaccaagttttcaaccgtaaaaaactcaaaggcaaagccaagggaatggtggtaacgcaaaatattgaaaccgccatccgctattttcaggcgttaaaacatttgctggccgggcggggtaatccgtttaaaattgcgattgcgttttcaggcagtaaagtggttgacggtgtcgaatacaccgaagcggaaatgaacggctttgcagaaagcgaaaccaaagagttttcgatcaagatgaatatcgtttgctggtggtcgccaataaatatc

SEQ ID NO: 3254 - protein, 646 aa, Haemophilus influenzae
  Name: NTH1813
MENKLGEPKAEYLPRHHGFKLAFSQDFDAQFAIDTRLFWQFLQTSQEAELARFQQLNPNDWQRKILERLDRQIKKNGVLHLLKKGLDIDSAHFDLLYPVPLASSGEKVKQRFEQNLFSCMRQVPYSASSNETVDMVLFANGLPIIALELKNHWTGQTAIDAQKQYLNRDLSQTLFHFGRCLAHFALDTEEAYMTTKLAGPATFFLPFNLGNNCGKGNPPNPNGHRTAYLWQEVFGKASLANIIQHFMRLDGSTKDPLDKRTLFFPRYHQLDVVRRLIADVSEHGVGKRYLIQHSAGSGKSNSITWLAYQLIEAYPRNEKAANGREADRPIFDSVIVVTDRRLLDKQLRDNIKDFSEVKNIVAPALSSAELRQSLEQGKKIIITTIQKFPFIVDGIADLGDKQFAVIIDEAHSSQSGSAHDNMNRAIGKTEDLDAEDVQDLILQTMQSRKMHGNASYFAFTATPKNSTLEKFGEKQADGKFKPFHLYSMKQAIEEGFILDVIANYTTYKSFYEITKSIEDNPEFDSKKAQSRLKAYVERSQQTIDTKAEIMLDHFIYQVFNRKKLKGKAKGMVVTQNIETAIRYFQALKHLLAGRGNPFKIAIAFSGSKVVDGVEYTEAEMNGFAESETKEFSIKMNIVCWWSPINI

SEQ ID NO: 3255 - DNA, 1254 bp, Haemophilus influenzae
  Name: NTH1815
ttgcaaatgagacgatacgagcgttacaaagattcaggtgtggattggctaggggaggtaccgagccattgggagttaaaacgcttgaaacaattatttgttgaaaaaaaacataagcaaagcctgtctcttaattgtggagccattagttttggtaaagttattgaaaaatcggatgataaagtaacagaggcaacaaaacgttcatatcaagaggtgttaaaaggcgagtttttaataaatcctttaaacttaaattatgacctaattagtttgagaattgctttatcagaaatagacgttgttgtaagtgccggttacattgttttaaaagaaaaacaaataattaataaaaaatacttttcgtatttattacatagatacgatgttgcatatatgaaattattaggttcaggtgtaagacaaacgattaactatgggcatatttcagacagtattttggttattccacctctctccgaacaacaaaaaatcgcgcaattcctagacgataaaaccgctaaaatcgatcaggcggtggatttggcggaaaagcagattgccctgttgaaagagcacaagcagatcctgattcaaaatgccgtaacccgaggcttaaaccctgatgtgccgttaaaagattccggcgtggaatggatagggcaagtgccggagcattgggatgtgcaacgttcaaaattcattttcaagaaaatagaaagaaaagtgaatgaggaagaccaaattgttacttgttttagggatgggcaagtaactctgagagctaatcgaagaactgaaggatttacaaatgcgctaaaagaacacggctaccaaggaattagaaaaggtgatttagttattcacgctatggatgcttttgcaggggcaattggtatttctgattcagatggtaaagcaacaccagtttattccgtttgtttgcctcatgataaacaaaaaatcgatgtctatttttacgcttattacttaagaaatcttgcattatcaggatttattagctccttagctaaaggaattagagagcgttcaacagattttcgctattctgattttgcagaattattactacctattcctccatatttagaacagcaaaaaattgccgactacctagataaacaaacctctaaaattgatcgagcaatcgcattaaaaacagcccatattgaaaagctgaaagaatataaaagcgtgttgattaacgatgtggtgaccggcaaggtgcgggta

SEQ ID NO: 3256 - protein, 418 aa, Haemophilus influenzae
  Name: NTH1815
LQMRRYERYKDSGVDWLGEVPSHWELKRLKQLFVEKKHKQSLSLNCGAISFGKVIEKSDDKVTEATKRSYQEVLKGEFLINPLNLNYDLISLRIALSEIDVVVSAGYIVLKEKQIINKKYFSYLLHRYDVAYMKLLGSGVRQTINYGHISDSILVIPPLSEQQKIAQFLDDKTAKIDQAVDLAEKQIALLKEHKQILIQNAVTRGLNPDVPLKDSGVEWIGQVPEHWDVQRSKFIFKKIERKVNEEDQIVTCFRDGQVTLRANRRTEGFTNALKEHGYQGIRKGDLVIHAMDAFAGAIGISDSDGKATPVYSVCLPHDKQKIDVYFYAYYLRNLALSGFISSLAKGIRERSTDFRYSDFAELLLPIPPYLEQQKIADYLDKQTSKIDRAIALKTAHIEKLKEYKSVLINDVVTGKVRV

SEQ ID NO: 3257 - DNA, 108 bp, Haemophilus influenzae
  Name: NTH1816
atgaccgctcttattgatgcaatttgttgtccgtttaactataaaaaaacttgcttatttcatgccaaatcttgcttaaaagataaaaatcattatttttcagcaagt

SEQ ID NO: 3258 - protein, 36 aa, Haemophilus influenzae
  Name: NTH1816
MTALIDAICCPFNYKKTCLFHAKSCLKDKNHYFSAS

SEQ ID NO: 3259 - DNA, 831 bp, Haemophilus influenzae
  n 1: n is any nucleotide
  Name: NTH1817
ntgttttcgaattcggactcggttccccgttacattccttcagcatcagtccgctatgttcgttatgaaggtacagtagcgaaagtcggtactgagcataatgtgataaaagaccaacgttttgaaaataatattccaaagctaattgaggagctgacctattttttaagagcctctttaagggattattactttcttgatgtcaatcagggaaaatttatcaaagtaccggaatatcctgaagaagcttggttagaaggtgttgtaaatgcgctttgtcatcgttcttacaatgttcaaggtaatgttatttatattaaacatttcgacgatcgtcttgaaattagtaatagtggccctctccctgctcaagtcaccattgaaaatattaaaacggaacgattcgctcggaatccacgtatagcacgagttttagaggatcttgggtatgtccgtcagcttaatgaaggcgtttcccgtatttatgagtcaatggaaaaatcattattggcaaagcctgaatatagagaacaaaacaacaatgtttatctaacattgcgcaaccgtgttaccgcacatgaaaaaacggtatctacagccactatgctgcagattgaaaaagaatggacaaactacaacgacacccaaaaagccattttgctttatctatttacaaatggtacggcgatattgtcagaattagttgactatacaaaaatcaatcagaattcgatccgagcgtatttaaatgcctttattcagcaaggtattattgaaagacaaagtgtaaaacagcgtgaccccaatgccaaatatgcttttagaaaagat

SEQ ID NO: 3260 - protein, 277 aa, Haemophilus influenzae
  Xaa 1: Xaa is any amino acid
  Name: NTH1817
XFSNSDSVPRYIPSASVRYVRYEGTVAKVGTEHNVIKDQRFENNIPKLIEELTYFLRASLRDYYFLDVNQGKFIKVPEYPEEAWLEGVVNALCHRSYNVQGNVIYIKHFDDRLEISNSGPLPAQVTIENIKTERFARNPRIARVLEDLGYVRQLNEGVSRIYESMEKSLLAKPEYREQNNNVYLTLRNRVTAHEKTVSTATMLQIEKEWTNYNDTQKAILLYLFTNGTAILSELVDYTKINQNSIRAYLNAFIQQGIIERQSVKQRDPNAKYAFRKD

SEQ ID NO: 3261 - DNA, 567 bp, Haemophilus influenzae
  Name: NTH1818
gtgacattaaataccacaggcactttaactaccgtagtgggttcaagcattaacgcaaacgaaggcaccttagttattaacgcacaagacgccacactaaatggtgatgcatcaggcgaccgtacagaagtgaatgcagtcaacgcaagcggctctggtagcgtaactgcggtaacctcaagcagcgtaaacatcactggagatttaagcacaataaacggattaaacatcatttcgaaaaatggtaaaaacactgtagtgttaaaaggtgctgaaattgatgtgaaatacattcagccaggtgtagcaagcgcagaagaagtaattgaagcgaagcgtgcccttgagaaggtaaaagatttatctgatgaagaaagagaaacgctagccaaacttggtgtaagtgccgtacgttttgttgagccaaataatgccattacggttaatacgcagaacgagtttacaaccagaccatcaagtcaagtgacaatttctgaaggtaaggcgtgtttctcaagtggtgatggcgcagcagtatgtaccaatgttgctgacgatggacagcag

SEQ ID NO: 3262 - protein, 189 aa, Haemophilus influenzae
  Name: NTH1818
VTLNTTGTLTTVVGSSINANEGTLVINAQDATLNGDASGDRTEVNAVNASGSGSVTAVTSSSVNITGDLSTINGLNIISKNGKNTVVLKGAEIDVKYIQPGVASAEEVIEAKRALEKVKDLSDEERETLAKLGVSAVRFVEPNNAITVNTQNEFTTRPSSQVTISEGKACFSSGDGAAVCTNVADDGQQ

SEQ ID NO: 3263 - DNA, 1635 bp, Haemophilus influenzae
  Name: NTH1819
atgaaaaatataaaaagcagattaaaactcagtgcaatatcagtattgcttggcttggcttcttcatcgttgtatgcagaagaagcgtttttagtaaaaggttttcagctatctggcgcacttgaaactttaagtgaagacgcccaattatctgtagcaaaatctttatccaaataccaaggtacgcaaactttaacaaacctaaaaacagcacagcttgaattacaggctgtgctagataaaattgagccaaataaatttgatgtgatattgccacaacaaaccattacggatggcaatatcatgtttgagctagtctcgaaatcagccgcagaaagccaagttttttataaggcgagccagggttatagtgaagaaaatatcgctcgtagcctgccatctttgaaacaaggaaaagtgtatgaagatggtcgtcagtggttcgatttgcgtgaatttaatatggcgaaagagaacccgcttaaggttacccgtgtacattacgaactaaaccctaaaaacaaaacctccaatttgataattgcgggcttctcgccttttggtaaaacgcgtagctttatttcttatgataatttcggtgcaagggagtttaactatcaacgtgtaagtttaggttttgttaatgccaatttaactggacatgatgatgtgttaaacctaaacgcattaaccaatgtgaaagcaccttcaaaatcttatgcggtaggcgtgggatatacttatccgttttatagtaaacaccaatccttaagcctttataccagcatgagttatgctgattctaatgatatcgacggcttaccaagtgcgattaatcgtaaattatcaaaaggtcaatctatctctgcgaatctgaaatggagttattatctcccgacatttaaccttggtatggaagaccagtttaaaattaatttaggctacaactaccgccatattaatcaaacatccgagttaaacaccctgggtgcaacgaagaaaaaatttgcagtatcaggcgtaagtgcaggcattgatggacatatccaatttacccctaaaacaatctttaatattgatttaactcatcattattacgcgagtaaattaccaggctcttttggaatggagcgcattggcgaaacatttaatcgcagctatcacattagcacagccagtttagggttgagtcaagagtttgctcaaggttggcattttagcagtcaattatcgggtcagtctactctacaagatataagtagcatagatttattctctgtaacaggtacttatggcgtcagaggctttaaatacggcggtgcaagtggtgagcgcggtcttgtatggcgtaatgaattaagtatgccaaaatacacccgctttcaaatcagcccttatgcgttttatgatgcaggtcagttccgttataatagcgaaaatgctaaaatttacggtgaagatatgcacacagtatcctctgcggggttaggcattaaaacctctcctacacaaaacttaagcctagatgcttttgttgctcgtcgctttgcaaatgccaatagtgacaatttgaatggcaacaaaaaacgcacaagctcacctacaaccttctggggtagattaacattcagtttc

SEQ ID NO: 3264 - protein, 545 aa, Haemophilus influenzae
  Name: NTH1819
MKNIKSRLKLSAISVLLGLASSSLYAEEAFLVKGFQLSGALETLSEDAQLSVAKSLSKYQGTQTLTNLKTAQLELQAVLDKIEPNKFDVILPQQTITDGNIMFELVSKSAAESQVFYKASQGYSEENIARSLPSLKQGKVYEDGRQWFDLREFNMAKENPLKVTRVHYELNPKNKTSNLIIAGFSPFGKTRSFISYDNFGAREFNYQRVSLGFVNANLTGHDDVLNLNALTNVKAPSKSYAVGVGYTYPFYSKHQSLSLYTSMSYADSNDIDGLPSAINRKLSKGQSISANLKWSYYLPTFNLGMEDQFKINLGYNYRHINQTSELNTLGATKKKFAVSGVSAGIDGHIQFTPKTIFNIDLTHHYYASKLPGSFGMERIGETFNRSYHISTASLGLSQEFAQGWHFSSQLSGQSTLQDISSIDLFSVTGTYGVRGFKYGGASGERGLVWRNELSMPKYTRFQISPYAFYDAGQFRYNSENAKIYGEDMHTVSSAGLGIKTSPTQNLSLDAFVARRFANANSDNLNGNKKRTSSPTTFWGRLTFSF

SEQ ID NO: 3265 - DNA, 282 bp, Haemophilus influenzae
  Name: NTH1820
ttgtatcgccatggtgtggagtatattttagtttatcatataaattgttttttagcattgcttagtttactttacttggttttcttagttttcttagttttcttagttttcttagttttcttagttttcttagttttcttagttttcttagttttcttagttttcttagttttcttagttttcttagttttcttagttttcttagttttcttagttttcttagttttcttagttttcttagttttcttagtttgcttggtttatttatttgatatacagggg

SEQ ID NO: 3266 - protein, 94 aa, Haemophilus influenzae
  Name: NTH1820
LYRHGVEYILVYHINCFLALLSLLYLVFLVFLVFLVFLVFLVFLVFLVFLVFLVFLVFLVFLVFLVFLVFLVFLVFLVFLVFLVCLVYLFDIQG

SEQ ID NO: 3267 - DNA, 351 bp, Haemophilus influenzae
  n 139: n is any nucleotide
  Name: NTH1821
atgacaaaagaaaatttgcaaaacgctccacaaaatacgaccgtttcacttgtggaatcaaacaacaaccaaacttccccgcaaatgcttcaacaatcacccaaacctagcctattgcgcttggaacaacatatcgaanaaaaagattatgagtttgcttgtcgtgaattaatggtgattctggaaaaaatggatgctaattttggaggcgttcacgatattgaatttgacgcacccgctcagctagcatatctacccgaaaactactcatttattttgccactcgtctcgctaatgcaattacaacactcttttccgaccccgaattggcaatttctgaagaaggggcgt

SEQ ID NO: 3268 - protein, 117 aa, Haemophilus influenzae
  Xaa 47: Xaa is any amino acid
  Name: NTH1821
MTKENLQNAPQNTTVSLVESNNNQTSPQMLQQSPKPSLLRLEQHIEXKDYEFACRELMVILEKMDANFGGVHDIEFDAPAQLAYLPENYSFILPLVSLMQLQHSFPTPNWQFLKKGR

SEQ ID NO: 3269 - DNA, 1623 bp, Haemophilus influenzae
  Name: NTH1822
ttggcaatttctgaagaaggggcgttaaagatgattagcctgcaacgctggttgacgctgatttttgcctcttccccctacgttaacgcagaccatattctcaataaatataatatcaacccagattccgaaggtggctttcatttagcaacagacaactcttctattgctaaattctgtattttttacttacccgaatccaatgtcaatatgagtttagatgcgttatgggcagggaatcaacaactttgtgcttcattgtgttttgcgttgcaatcttcacgttttattggtaccgcatctgcgtttcataaaagagcggtagttttacagtggtttcctaaaaaactcgccgaaattgctaatttagatgaattgcctgcaaatatccttcatgatgtatatatgcactgcagttatgatttagcaaaaaacaagcacgatgttaagcgtccattaaacgaacttgtccgcaagcatatcctcacgcaaggatggcaagaccgctacctttacaccttaggtaaaaaggacggtaagcctgtgatgatggtactgcttgaacattttaattcgggacattcgatttatcgcacgcattcaacttcaatgattgctgctcgagaaaaattctatttagtcggcttaggccatgagggcgttgataaaataggtcgagaagtgtttgacgagttctttgaaatcagtagcaataatataatggagagactgttttttatccgtaaacagtgcgaaaccttccaacccgcagtgttctatatgccaagcattggcatggatattaccacgatttttgtgagcaacactcggcttgcccctattcaagctgtagccctgggtcatcctgccactacgcattctgaatttattgattatgtcatcgtagaagatgattatgtgggcagtgaagattgtttcagcgaaacccttttacgcttacccaaagatgccctaccttatgtaccttctgcactcgccccacaaaaagtggattatgtactaagagaaaaccctgaagtagtcaatatcggtattgccgctaccacaatgaaattaaaccctgaatttttggtaacattgcaagaaatcagagataaagctaaagtcaaaatgcattttcatttcgcacttggacaatcaacaggcttgacacacccttatgtcaaatggtttattgaaagctatttaggtgacgatgccactgcacatccccacgcaccttatcacgattatctggcaatattgcgtgattgcgatatgctactaaatccgtttcctttcggtaatacaaacggcataattgatatggttacattaggtttagttggtgtatgcaaaacgggggatgaagtacatgaacatattgatgaaggtctgtttaaacgcttaggactaccagaatggctgatagccgatactcgcgaaacatacattgaatgtgctttacgtttggctgaaaaccaccaagaacgtcttgaactccgtcgttacatcatagaaaacaacggcttacaaaagctttttacaggcgaccctcgtccattgggcaaaatactgcttaagaaaacaaatgaatggaagcggaagcacttgagtaaaaaa

SEQ ID NO: 3270 - protein, 541 aa, Haemophilus influenzae
  Name: NTH1822
LAISEEGALKMISLQRWLTLIFASSPYVNADHILNKYNINPDSEGGFHLATDNSSIAKFCIFYLPESNVNMSLDALWAGNQQLCASLCFALQSSRFIGTASAFHKRAVVLQWFPKKLAEIANLDELPANILHDVYMHCSYDLAKNKHDVKRPLNELVRKHILTQGWQDRYLYTLGKKDGKPVMMVLLEHFNSGHSIYRTHSTSMIAAREKFYLVGLGHEGVDKIGREVFDEFFEISSNNIMERLFFIRKQCETFQPAVFYMPSIGMDITTIFVSNTRLAPIQAVALGHPATTHSEFIDYVIVEDDYVGSEDCFSETLLRLPKDALPYVPSALAPQKVDYVLRENPEVVNIGIAATTMKLNPEFLVTLQEIRDKAKVKMHFHFALGQSTGLTHPYVKWFIESYLGDDATAHPHAPYHDYLAILRDCDMLLNPFPFGNTNGIIDMVTLGLVGVCKTGDEVHEHIDEGLFKRLGLPEWLIADTRETYIECALRLAENHQERLELRRYIIENNGLQKLFTGDPRPLGKILLKKTNEWKRKHLSKK

SEQ ID NO: 3271 - DNA, 330 bp, Haemophilus influenzae
  Name: NTH1824
ttgtctctaatagctatattcagcacgggaggctatcgaagcagaatgaaaaatttcaacagcccgcacaggttttatctggttttatcctgggcaaagaaaattatttataccttagaacacattgaagaaatacccgaagctatttttaaccaacagcaagaaagtatcgaaacacatttaaaagaattggaaaaacaagacatgactgccgaagaacgcgccgtctttagtttaccgtatcagcaattaaatttgattacccaactattgccacaattttatgggtattttaagaaagagataaactgtgagcgcgcgggagcgtta

SEQ ID NO: 3272 - protein, 110 aa, Haemophilus influenzae
  Name: NTH1824
LSLIAIFSTGGYRSRMKNFNSPHRFYLVLSWAKKIIYTLEHIEEIPEAIFNQQQESIETHLKELEKQDMTAEERAVFSLPYQQLNLITQLLPQFYGYFKKEINCERAGAL

SEQ ID NO: 3273 - DNA, 1206 bp, Haemophilus influenzae
  Name: NTH1825
atggctgaacatttacgcttggcggtgtgttattggcataccttttgctggaatgggaatgatatgtttgggctaggttctttggagcgaagttggcagaaaaatccaaatgtgcttgctggcgcagaacaaaaagccgatattgcttttgagtttttgaataagttaggcgtgccttattattgttttcatgatgttgatattgcacctgaaggtaattcagtgcgggaatatgtacaaaattttcatcatattgttgatattttagaacgcaaacaagtagaaacgggtgtaaaactcttatggggaactgcaaattgttttactaatcctcgttatatgtctggtgcagcaaccaatcctaatcctgaggtttttgcttgggctgcaacacaagtgtttaatgcgatgaatgccactcaacgtttaggtggagaaaattacgtattatggggtggacgtgaggggtatgaaactttattgaataccgatttgaaacgtgaacgtgaacaaattggtcgttttatgcaaatggtggtagaacataagcataaaattgggtttaaaggtacattattaattgagccaaaaccgcaagaaccaactaaacatcaatatgattatgatgtggcaacagtgtatggtttcctaaaacaatttggtttagaaaaagaaattaaagttaatattgaagctaaccacgcgacgcttgctggccatacctttcaacatgaaattgcaacagcttgtgcattagatatttttggctcaattgatgctaatcgtggcgatccacaattaggctgggataccgaccaattcccaaatagtgttgaagaaaatacgttagttatgtatgaaattttaaaacatggcggttttactactggaggctttaattttgatgcgaaaattcgccgacaaagtattgatccttatgatttattttacgctcatatcggtgcaattgatgtattggcattatccttaaaacgtgcagcaaaaatgttacaagagaaaaccttacaaaaaattgttaatgcacgctatgcaggttggaatagtgaacttggtcagcatattttgcaaggtaaaacttcacttgaaacacttgcgcaacttgtccaacaaaaagatttagcaccaaaaccagtttcaggtcagcaagaatatttggaaaatttggtaaaccaagttatttatagc

SEQ ID NO: 3274 - protein, 402 aa, Haemophilus influenzae
  Name: NTH1825
MAEHLRLAVCYWHTFCWNGNDMFGLGSLERSWQKNPNVLAGAEQKADIAFEFLNKLGVPYYCFHDVDIAPEGNSVREYVQNFHHIVDILERKQVETGVKLLWGTANCFTNPRYMSGAATNPNPEVFAWAATQVFNAMNATQRLGGENYVLWGGREGYETLLNTDLKREREQIGRFMQMVVEHKHKIGFKGTLLIEPKPQEPTKHQYDYDVATVYGFLKQFGLEKEIKVNIEANHATLAGHTFQHEIATACALDIFGSIDANRGDPQLGWDTDQFPNSVEENTLVMYEILKHGGFTTGGFNFDAKIRRQSIDPYDLFYAHIGAIDVLALSLKRAAKMLQEKTLQKIVNARYAGWNSELGQHILQGKTSLETLAQLVQQKDLAPKPVSGQQEYLENLVNQVIYS

SEQ ID NO: 3275 - DNA, 1479 bp, Haemophilus influenzae
  Name: NTH1826
atgtatataggaattgattgtggcacacaaggaacaaaggcaatagtgcttgattctgtccaaaaaaaagtgattggagttggttacgcaaaacatgaattaattacacaatccaatggaagacgtgaacaacaaccaaattggtggattgaggcattacaacaagcattacaaattgcattgaaacaagcaaaaaattcaccgcacttttcacctaatttagtgaagggaataggcatttcaggacaacaacatggactggtaatgttagataaaaacgatcgtcctctatataaggctaagctttggtgtgatacagaaaccgctacggaaaatgatatactgatcgaaaaattaggcggacaaacagccgtatttgaaaaattaggcatcatttgccaaactggttacacagcttcaaaactaagttggtttcgtcaaaattatcctgacaaatttgccaatattcgcaaaatcatgctgccacacgattatctaaattattggctaacaggaaaattctgcactgaatttggtgatgcttctggtagtggttatttcgatgttgtgaaaagagaatggaaaagagaagtcttcaaatatcttgcaccagaattaaatatggatgaagtgttaccaaaattactttctgctgaacaaaaaatcggtgtgattaaacctgaaattgcgactttatttggttttaatgagaatgtcatcgtctccacaggtggaggcgataatatgatgggagcaattggtacaggaaatattcgagaagggattgctacgatgagtctcggtacttctggtaccttgtatgcttatacgcaaaagccattgcttaatttaccaccaatgatcgcaaatttttgttcaagtaataatggctggttaccactggtttgtgtaatgaatataacctcctcaaataaacagctaatgaatttgctcaatattgatattgaagaattaaatcaacttgctcaacaagcacctattggcgcgaatggcatcactattttgccattctttaatggtgaaagagttccacctttacccaatgcaaaagcgagcattttaggattagattcaagtaatttcacacgagaaaatctttgtcgagcaatgatggaaagtgctacttttacgcttcgctatggcttagatttatttcgtcaagctggcctcgaaacctcacaaattcgcctaattggaggtggcgcgaaaagctcattttggcggcaaatgattgctgatgtgatgaattctgaagtggtatgtttgcaggaagaagaagctgctgcattaggaggagcaattcaagctatgtgggcaaatggagaaggagaactggaatttttatgcgaaaccttcattcacttagatgaaaactcaaaagcttatcccaacttatcacaggtgaaaaattatcaaagtgcttatgagcgttatttaatacatttatcacaattatat

SEQ ID NO: 3276 - protein, 493 aa, Haemophilus influenzae
  Name: NTH1826
MYIGIDCGTQGTKAIVLDSVQKKVIGVGYAKHELITQSNGRREQQPNWWIEALQQALQIALKQAKNSPHFSPNLVKGIGISGQQHGLVMLDKNDRPLYKAKLWCDTETATENDILIEKLGGQTAVFEKLGIICQTGYTASKLSWFRQNYPDKFANIRKIMLPHDYLNYWLTGKFCTEFGDASGSGYFDVVKREWKREVFKYLAPELNMDEVLPKLLSAEQKIGVIKPEIATLFGFNENVIVSTGGGDNMMGAIGTGNIREGIATMSLGTSGTLYAYTQKPLLNLPPMIANFCSSNNGWLPLVCVMNITSSNKQLMNLLNIDIEELNQLAQQAPIGANGITILPFFNGERVPPLPNAKASILGLDSSNFTRENLCRAMMESATFTLRYGLDLFRQAGLETSQIRLIGGGAKSSFWRQMIADVMNSEVVCLQEEEAAALGGAIQAMWANGEGELEFLCETFIHLDENSKAYPNLSQVKNYQSAYERYLIHLSQLY

SEQ ID NO: 3277 - DNA, 924 bp, Haemophilus influenzae
  Name: NTH1827
atgattattgtaacaggcggcgctggttttattggcagtaatattgtcaaagcattgaatgatttagggcgcaaagatattttagtggtggataacttaaaagatggcacgaaatttgcaaatttagttgatttagacatcgcagattattgcgataaagaagatttcattgcttctattattgcgggcgatgaatttggcgatattgatgcggtattccacgagggggcatgttctgcgactacggaatgggatggtaaatacattatgcacaacaactacgaatattctaaagagttgttgcattattgccttgaccgtgaaattccttttttctatgcctcaagcgcagcaacttatggagacaccaaagtattccgtgaagaacgtgaatttgaaggcccattaaatgtgtatggctattctaaattcttgttcgatcaatatgtgcgtaacattttgccagaagcaaaatcgccagtatgtggtttccgttatttcaatgtttacgggccgcgtgaaaatcataaaggttcaatggcgagtgtggcattccacttgaataaccaaatcttaaaaggcgaaaatccaaaattatttgcaggcagcgaaggattccgccgtgattttgtttatgtaggcgatgtggctgcagtgaatatttggtgttggcaaaatggtatttcgggtatttacaaccttggtacaggaaatgcagaaagtttccgtgcggtggctgatgcggtagtgaaattccacggaaaaggcgagattgaaaccattccattcccagagcatttgaaatctcgttatcaagaatatactcaagcagatttaactaaacttcgctcaacaggctacgataaaccattcaaaacagtcgcggaaggcgtgactgaatatatggcgtggttgaatagaaaa

SEQ ID NO: 3278 - protein, 308 aa, Haemophilus influenzae
  Name: NTH1827
MIIVTGGAGFIGSNIVKALNDLGRKDILVVDNLKDGTKFANLVDLDIADYCDKEDFIASIIAGDEFGDIDAVFHEGACSATTEWDGKYIMHNNYEYSKELLHYCLDREIPFFYASSAATYGDTKVFREEREFEGPLNVYGYSKFLFDQYVRNILPEAKSPVCGFRYFNVYGPRENHKGSMASVAFHLNNQILKGENPKLFAGSEGFRRDFVYVGDVAAVNIWCWQNGISGIYNLGTGNAESFRAVADAVVKFHGKGEIETIPFPEHLKSRYQEYTQADLTKLRSTGYDKPFKTVAEGVTEYMAWLNRK

SEQ ID NO: 3279 - DNA, 501 bp, Haemophilus influenzae
  Name: NTH1828
atgaagattaaaaaattactcaagaatggattatccctctttttaacttttattgtgataactagcatactggattttgttcgtcgccctgtagtgccaaaggaaataaataaaatcacgttacaagatcttcaagggagtacgttctctcttgatagtcttgatcaaaacaaacccacattactttatttttggggaacttggtgtggttattgtcgttatacttcgccagcaattaattctttagcaaacgaaggctatcaagttgtatcggtggcattacgctcaggcaatgaggcggacgtaaatgattatttaagtaagcatgactaccacttcactacggttaatgatcctaaaggggaatttgcagaacgatggcaaattaatgtgacacccacaattgtgttgttgagtaaaggcaaaatggatcttgttacgacaggccttacgagttattggggattaaaagtgcggttgtttttcgcagagttttttggc

SEQ ID NO: 3280 - protein, 167 aa, Haemophilus influenzae
  Name: NTH1828
MKIKKLLKNGLSLFLTFIVITSILDFVRRPVVPKEINKITLQDLQGSTFSLDSLDQNKPTLLYFWGTWCGYCRYTSPAINSLANEGYQVVSVALRSGNEADVNDYLSKHDYHFTTVNDPKGEFAERWQINVTPTIVLLSKGKMDLVTTGLTSYWGLKVRLFFAEFFG

SEQ ID NO: 3281 - DNA, 102 bp, Haemophilus influenzae
  Name: NTH1829
ttgagtaattttttaatcttcattttatttattccttatcttgttgagatgattgtaattgagcgtacaaccatagtcaaaaataaagaatttttgctacaa

SEQ ID NO: 3282 - protein, 34 aa, Haemophilus influenzae
  Name: NTH1829
LSNFLIFILFIPYLVEMIVIERTTIVKNKEFLLQ

SEQ ID NO: 3283 - DNA, 669 bp, Haemophilus influenzae
  Name: NTH1830
atgacatcaaatcaacttgctcaatatatcgaccacaccgcacttaccgcagaaaaaaatgaacaagatatttcgacactctgtaatgaagcgattgaacatggattttattctgtatgtatcaattctggttatattccactcgctaaagaaaaacttgctggctcaaatgtaaaaatttgtaccgtagttggcttccctttgggggcgaatttaacctctgtcaaagcatttgaaacgcaagaagctattaaagcgggtgcaaatgagattgatatggtaattaatgtaggttggataaaatcgcaaaaatgggatgcagtaaaacaagatattcaagctgtatttaatgcttgtaatggcacgccattaaaagtaattttagaaacttgtttgctcactaaagatgaaatagtgaaagcctgcgaaatttgtaaagaaatcggtgtagcttttgttaaaacatcaacgggtttcaataaaggcggcgcaactgtagaagatgttgcattgatgaaacaaacggtcggcaatattggtgttaaagcatcaggtggtgtgcgtgatactgaaactgcacttgcaatgattaaggcgggtgcgactcgcattggtgcaagcgctggcattgcaattattagcggtacgcaagacactcaaagcacttac

SEQ ID NO: 3284 - protein, 223 aa, Haemophilus influenzae
  Name: NTH1830
MTSNQLAQYIDHTALTAEKNEQDISTLCNEAIEHGFYSVCINSGYIPLAKEKLAGSNVKICTVVGFPLGANLTSVKAFETQEAIKAGANEIDMVINVGWIKSQKWDAVKQDIQAVFNACNGTPLKVILETCLLTKDEIVKACEICKEIGVAFVKTSTGFNKGGATVEDVALMKQTVGNIGVKASGGVRDTETALAMIKAGATRIGASAGIAIISGTQDTQSTY

SEQ ID NO: 3285 - DNA, 1527 bp, Haemophilus influenzae
  Name: NTH1831
atgtcccttgctattgtttacagccgtgcttctatgggtgtgcaagcaccgctagtcaccattgaggtgcatttaagcaacggaaaaccaggatttacacttgttggtttgccagaaaaaaccgtgaaagaggcacaagatcgggtgcgtagtgcgttgatgaatgcacaatttaaatacccagccaagcgtatcacagtgaatctcgcccctgcggatttaccgaaagaaggcggaagatttgatttgcctattgctatcgggattttagctgcatcagatcagcttgatgcaagccgtttaaagcaatttgaatttgtggcagagcttgcgctgacgggccaattgcgtggcgtacatggtgtgattcccgctattcttgcagcgcaaaagtcaaagcgagagttaattatcgcgaaacaaaatgctaatgaagcctcgctcgtgtctgatcaaaatacttattttgctcaaacgcttttagatgtagtgcaatttctcaatggtcaggaaaaattacccctcgccactgaaattgtgaaagaaagtgcggtaaatttttcaggtaaaaatacgttagatttaacggatattatcggacaacagcacgctaaacgagcattgaccattgccgcagcggggcagcataatttgctctttcttggcccaccgggtacagggaaaaccatgttagccagccgtttgacagggattttacctgaaatgacagatttagaagcgatagaaacagcatctgtaacgagtttagttcaaaacgagttaaattttcataattggaagcaacgtccttttcgcgcaccacaccatagtgcatcaatgccggctttagttggtggcggaacgatccctaaacctggcgaaatatccttagcaacaaatggggcgctttttcttgatgaacttccagaatttgagcgaaaagtgttagatgcactacgccagcctttggaaagtggtgagattattatttctcgtgccaatgcaaaaattcaattcccagctcgttttcaattagtggcagcgatgaatccaagccctacaggccattatactgggacacataaccgcacttcaccacagcaaattatgcgttatttgaatcgactttcagggccatttttagatcgttttgatttatctattgaagtgcctttactgccacaaggtagcttgcaaaatacgggcgatcgtggcgaaaccagcgtgcaagttcgtgaaaaagtgttaaaagtacgtgagattcaaatggaaagagcggggaaaatcaacgcttatttgaacagtaaagagattgagcgtgattgcaagttaaatgataaagatgcctttttccttgaaaaagcactgaataaacttgggctttctgtacgggcttatcatcgtattttgaaagtttctcgaaccattgccgatctacaaggagaacaacaaatttctcaaccgcacttggcggaggccttgggctatcgagcaatggatcgtttgctgcagaaattgtcgaatatg

SEQ ID NO: 3286 - protein, 509 aa, Haemophilus influenzae
  Name: NTH1831
MSLAIVYSRASMGVQAPLVTIEVHLSNGKPGFTLVGLPEKTVKEAQDRVRSALMNAQFKYPAKRITVNLAPADLPKEGGRFDLPIAIGILAASDQLDASRLKQFEFVAELALTGQLRGVHGVIPAILAAQKSKRELIIAKQNANEASLVSDQNTYFAQTLLDVVQFLNGQEKLPLATEIVKESAVNFSGKNTLDLTDIIGQQHAKRALTIAAAGQHNLLFLGPPGTGKTMLASRLTGILPEMTDLEAIETASVTSLVQNELNFHNWKQRPFRAPHHSASMPALVGGGTIPKPGEISLATNGALFLDELPEFERKVLDALRQPLESGEIIISRANAKIQFPARFQLVAAMNPSPTGHYTGTHNRTSPQQIMRYLNRLSGPFLDRFDLSIEVPLLPQGSLQNTGDRGETSVQVREKVLKVREIQMERAGKINAYLNSKEIERDCKLNDKDAFFLEKALNKLGLSVRAYHRILKVSRTIADLQGEQQISQPHLAEALGYRAMDRLLQKLSNM

SEQ ID NO: 3287 - DNA, 93 bp, Haemophilus influenzae
  Name: NTH1832
ttgcgatctagatcgcaaaaaaagcacggaatgaatgatttcattacgtgctttttttatagtgcaaaaactatcttcatttttaccgcactt

SEQ ID NO: 3288 - protein, 31 aa, Haemophilus influenzae
  Name: NTH1832
LRSRSQKKHGMNDFITCFFYSAKTIFIFTAL

SEQ ID NO: 3289 - DNA, 207 bp, Haemophilus influenzae
  n 111: n is any nucleotide
  Name: NTH1833
gtgctttttttgcgatctagatcgcaaaattcatattttatttcgcaaaaagtggcgaaaaccaaaaatctaatttcgccgcccatttatcaataccaattttatttttgngcagtaaaaagcctcaacttgtatatcgcctttgaaacggaagaattgcttcacgcaccatttttactcgtttactacgggcgcttttgcttaaat

SEQ ID NO: 3290 - protein, 69 aa, Haemophilus influenzae
  Xaa 37: Xaa is any amino acid
  Name: NTH1833
VLFLRSRSQNSYFISQKVAKTKNLISPPIYQYQFYFXAVKSLNLYIAFETEELLHAPFLLVYYGRFCLN

SEQ ID NO: 3291 - DNA, 216 bp, Haemophilus influenzae
  Name: NTH1834
gtgattagtttagatattcaaaaaatcgcgattggtggcagtgtgggattagctgagggatatttatctttggttgaaaaatatttacaagattttccttcgatatattgttgtgaaattgaaaccgctaaatttggacaagatgcaggtttaattggcgcagcttattgggtaaaagatgttttactggataagcctgaaggaacaatttatggc

SEQ ID NO: 3292 - protein, 72 aa, Haemophilus influenzae
  Name: NTH1834
VISLDIQKIAIGGSVGLAEGYLSLVEKYLQDFPSIYCCEIETAKFGQDAGLIGAAYWVKDVLLDKPEGTIYG

SEQ ID NO: 3293 - DNA, 864 bp, Haemophilus influenzae
  Name: NTH1835
atggctaaattgggaaatgtgttaaacaaaattggctcactttaccagagtttaactaaatcagagaaaaaaattgccgatacgattttgcgttcgcctgatttagtctctcaatgctccctttcagaaatcgctaaacatttgcaagttggagaagctacgctcgtccgtttttgtcgaaccattggttttaaaggtttcagcgagttcaaactagagctttctattgaacttgcgacgaaagataatcaagatgaaagcatacttgaaacagaaattatgccaagtgatgattcgctcactattgcacaaaaattgcaaacggcggttgctaatgtaatggaagaaacgattaatttacttgatttaaaacagcttgaagaagtcgttaaagtacttaaaaaagcacgccgtatttttttatttggtgtgggttcatctggcgtaacggctgaagatgctaaaaataagctgatgcgtattggttttcaagtggatgcttcaggtaataatcattttatgtatatgcaggcggcattattgacctcttctgatgtggcaattggtttaagccattctggttattctgctgaaacggcacataccatcaaaatcgcaaaacaaaatggtgcaacaacagtggcattgacgcatagtttgcgttcccccgtgacagaatatgctgattatgttttggtaaatggtaataaacaaggcaagttacaaggcgattctattggcaccaaaattgcacagctttttgtattagatttaatttatgctttgttagtgcagggcgaagaagaaattgccgctcaaactaaacaaaaaactctcaatgtaattcttgaacaacgtataaaa

SEQ ID NO: 3294 - protein, 288 aa, Haemophilus influenzae
  Name: NTH1835
MAKLGNVLNKIGSLYQSLTKSEKKIADTILRSPDLVSQCSLSEIAKHLQVGEATLVRFCRTIGFKGFSEFKLELSIELATKDNQDESILETEIMPSDDSLTIAQKLQTAVANVMEETINLLDLKQLEEVVKVLKKARRIFLFGVGSSGVTAEDAKNKLMRIGFQVDASGNNHFMYMQAALLTSSDVAIGLSHSGYSAETAHTIKIAKQNGATTVALTHSLRSPVTEYADYVLVNGNKQGKLQGDSIGTKIAQLFVLDLIYALLVQGEEEIAAQTKQKTLNVILEQRIK

SEQ ID NO: 3295 - DNA, 879 bp, Haemophilus influenzae
  Name: NTH1836
atgcgtgatttaaaaggtattttcagtgcattattagtgtcatttaatgaagatggcaccattaatgaaaaaggtttacgccaaattatccgccataatatcgacaaaatgaaagttgatggcttatatgtgggcggttcaacaggcgaaaactttatgctttcaacggaagagaaaaaagaaatcttccgcattgcaaaagatgaagcaaaagatcaaatcgcactaattgctcaagtgggcagcgtaaacttaaaagaagcagtggaattaggtaaatatgcaacagaattaggctacgactgcttatctgcagtgacgccattctattacaaatttagcttccctgaaattaaacattattacgacaccatcatcgctgaaacgggcaacaatatgattgtgtactcaatcccgttcttaactggcgtgaatatgggcattgaacaattcggtgaactttacaaaaacccgaaagtattaggggtaaaattcacagcaggtgatttctacttattagaacgtttgaaaaaagcttatccaaaccacttaatttgggcaggttttgatgaaatgatgttaccggcagcctcacttggtgtggatggtgcaatcggttcaactttcaacgtaaacggcgttcgtgctcgtcaaatttttgaattaaccaaagcgggtaaattagccgaagcgttagaaatccaacacgtaaccaacgatttaatcgaaggcattttagcgaacggtttatatttaaccatcaaagaattgcttaaattagaaggggtggatgcaggttattgccgtgaaccaatgacatcaaaagcaacagcagaacaggttgcaaaagcaaaagacttgaaagcgaaatttttgtca

SEQ ID NO: 3296 - protein, 293 aa, Haemophilus influenzae
  Name: NTH1836
MRDLKGIFSALLVSFNEDGTINEKGLRQIIRHNIDKMKVDGLYVGGSTGENFMLSTEEKKEIFRIAKDEAKDQIALIAQVGSVNLKEAVELGKYATELGYDCLSAVTPFYYKFSFPEIKHYYDTIIAETGNNMIVYSIPFLTGVNMGIEQFGELYKNPKVLGVKFTAGDFYLLERLKKAYPNHLIWAGFDEMMLPAASLGVDGAIGSTFNVNGVRARQIFELTKAGKLAEALEIQHVTNDLIEGILANGLYLTIKELLKLEGVDAGYCREPMTSKATAEQVAKAKDLKAKFLS

SEQ ID NO: 3297 - DNA, 159 bp, Haemophilus influenzae
  Name: NTH1837
ttgctttcctctgttattccgttacaaacagaacagcaagtcagcaagcactttccttcccctgtttacgggggaaggtgcccgaagggcggaagggggcaacttctattgctttgtcgtaaattattggagcaaaagaatttctttttaaaaacaaga

SEQ ID NO: 3298 - protein, 53 aa, Haemophilus influenzae
  Name: NTH1837
LLSSVIPLQTEQQVSKHFPSPVYGGRCPKGGRGQLLLLCRKLLEQKNFFLKTR

SEQ ID NO: 3299 - DNA, 810 bp, Haemophilus influenzae
  Name: NTH1838
atgcgttttattccattacaaacagaacaacaagtcagttgttgggctgcacaacatatcatcaatcgtatcaacgattttaaacctaccgccgagcgtccttttgtattggggttacctactggtggtacaccactaaaaacttatcaagaactgattcgactttatcaagcaggcaaagtgagtttcaaacacgtagtgactttcaatatggatgaatatgtggctttaccagaggaacaccctgaaagttaccacagctttatgtataacaattttttcaatcatatcgatattttacctgaaaatatcaatattcttaacggcaataccgatgaccataatgcagaatgccatcgttatgaagaaaaaattaaatcctacggcaaaattcatctgtttatggggggggttggcgtagatggacatatcgcatttaatgaacctgcttcttcattaagttctcgcacccgtattaaaacgctaacgcaagatacattaattgcaaattcacgcttctttaataacgatgttactcaagtgccgaaatatgctttaaccattggtgtcggtacattattagatgcagaagaagtgatgattttagcaacaggacatcaaaaagcactggcagtgcaagctgccgttgaaggcagtattaaccatttatggacagtcagtgcattacaaatgcaccgtcatttcgtgcttgtttgtgatgaagctgctcaacaagagttaaaagtgaaaaccgtgaaatattttactgaattagaaggctcggttgctggtacggattatcaggataaa

SEQ ID NO: 3300 - protein, 270 aa, Haemophilus influenzae
  Name: NTH1838
MRFIPLQTEQQVSCWAAQHIINRINDFKPTAERPFVLGLPTGGTPLKTYQELIRLYQAGKVSFKHVVTFNMDEYVALPEEHPESYHSFMYNNFFNHIDILPENINILNGNTDDHNAECHRYEEKIKSYGKIHLFMGGVGVDGHIAFNEPASSLSSRTRIKTLTQDTLIANSRFFNNDVTQVPKYALTIGVGTLLDAEEVMILATGHQKALAVQAAVEGSINHLWTVSALQMHRHFVLVCDEAAQQELKVKTVKYFTELEGSVAGTDYQDK

SEQ ID NO: 3301 - DNA, 1143 bp, Haemophilus influenzae
  Name: NTH1839
atgaaatacgcattaaccaacagtgtgatctacactaaatacgaaattctacgagattatgcggtagtaattgatagcgaaactattgaagcagtgatcccccaagctgaattagaaacaggtatcaaaaccattgatttacaaggtaataatttaacggctggttttattgatctgcaattaaatggctgtggtggcgtgatgtttaacgaccaaactagcgttgaaaccttggaaattatgcaggaaactaacttaaaatcaggttgtacaagtttccttcccacttttattaccgcgcctgatgaaaatataaaaagtgcggtaaaaattatgcgtgaatatttaaacaagcataaaaaccaagcacttggtttacatattgaagggccttatctcagcattgagaaaaaaggcgtacaccgccccgaatatattcgtgaaattacgcctgaaatgaaagattttctctgtgaaaatggcgatgtgattacaaaaataaccattgccgcagaaaacccaaccattaactatacgcctgattttgtgaaagcgggcattattgtctctgtaggtcattctaatgccacttatgaagtggctaaagccgcattccacaaaggcgcaacatttgcaacccacttacataatgcaatgtcgccaattagttctggacgtgaaatgggcgtagtgggcgcagtattagattctgatgtttacactggcattatcgtggatggtgtgcatatcaattatggcaatgttcgcattgataaaaaaatcaaaggcgacaaactttgtattgtgactgactctattgcagcggcaggcgcaccgccagaactagaaaattttacctttgtgggaaaaacaatttatatcaaagatgggcgttgctatgatgctaatggcacgattgcaggggcatcaatcacaatgatggaatccattaaaaatgcggtagaatatgttgaaattcctcttgctgaagccattagaatgagtaacctttatcctgcacgagcaattggtatagatgatcgtttaggttcggtagaaaaaggtaagatagcaaacttagcagtgtttacgccaaattaccaagtaatcggcacagtagtaaacggaaagtggaaagagaat

SEQ ID NO: 3302 - protein, 381 aa, Haemophilus influenzae
  Name: NTH1839
MKYALTNSVIYTKYEILRDYAVVIDSETIEAVIPQAELETGIKTIDLQGNNLTAGFIDLQLNGCGGVMFNDQTSVETLEIMQETNLKSGCTSFLPTFITAPDENIKSAVKIMREYLNKHKNQALGLHIEGPYLSIEKKGVHRPEYIREITPEMKDFLCENGDVITKITIAAENPTINYTPDFVKAGIIVSVGHSNATYEVAKAAFHKGATFATHLHNAMSPISSGREMGVVGAVLDSDVYTGIIVDGVHINYGNVRIDKKIKGDKLCIVTDSIAAAGAPPELENFTFVGKTIYIKDGRCYDANGTIAGASITMMESIKNAVEYVEIPLAEAIRMSNLYPARAIGIDDRLGSVEKGKIANLAVFTPNYQVIGTVVNGKWKEN

SEQ ID NO: 3303 - DNA, 321 bp, Haemophilus influenzae
  Name: NTH1840
gtgtctctattagtggctatgcaaaaactaaaaactataaagataaacacgataaaaagctatttcgtatctccaggtttccaatatgaattaatggaagatactaatgtctatggcaacttcaaatatgaacgcgattctgtagatcaaggtaaaaaaacacgtgaacaagcagtgttattcggtgtagatcataaacttcacaaacaagtattaacctatattgaaggtgcttacgctagaactagaacaactgagcaagctaaaggcgtaaaaactgaaaaagaaaaatcagtgggtgtaggtttacgcgtttacttc

SEQ ID NO: 3304 - protein, 107 aa, Haemophilus influenzae
  Name: NTH1840
VSLLVAMQKLKTIKINTIKSYFVSPGFQYELMEDTNVYGNFKYERDSVDQGKKTREQAVLFGVDHKLHKQVLTYIEGAYARTRTTEQAKGVKTEKEKSVGVGLRVYF

SEQ ID NO: 3305 - DNA, 114 bp, Haemophilus influenzae
  n 101, 102, 103, 104, 105: n is any nucleotide
  Name: NTH1841
atgaccgcactttacccttggctaatgccaatttatcatcaaattgctcaaacctttgacgaagggttggggcatcatgctgtgctgattaaagctgattnnnnnttaattaat

SEQ ID NO: 3306 - protein, 38 aa, Haemophilus influenzae
  Xaa 34, 35: Xaa is any amino acid
  Name: NTH1841
MTALYPWLMPIYHQIAQTFDEGLGHHAVLIKADXXLIN

SEQ ID NO: 3307 - DNA, 126 bp, Haemophilus influenzae
  Name: NTH1842
ttggttcaaattttttctatttatttcttatttattaaaagtaaacgtttgctttttgctattttgtcaagccagtttgaaaatgtgtataattgccctcgttatttacaaaaatttcaggaaaaa

SEQ ID NO: 3308 - protein, 42 aa, Haemophilus influenzae
  Name: NTH1842
LVQIFSIYFLFIKSKRLLFAILSSQFENVYNCPRYLQKFQEK

SEQ ID NO: 3309 - DNA, 2148 bp, Haemophilus influenzae
  Name: NTH1845
ttgttcagttttatactagaattcacgccccatttatttttacttgacaaaggaaaatttattatgaaactcgaagcaagcaagcaagcaagcaagcaagcaagcaagcaagcaagcaagcaagcaagcaagcaagcaagcaagcaagcaagcaagcagaagtttaaaaaatcatttattataagtctatttttttctattctttatacctctccgcttttggctgttgttgattatacttatgacaattctaaattaacaaatgagcaaattgaacgattaaaaaaactccgcgatagaaatagtgaatattggaaaaaggaaacttatctcctgaaaagtcccccctcaaactttccagacattccagtattattccctaaagattcttccgttccattcgaaaacatcgataactcaaaagcgatttctttttatgatcaaaaatatactgaagattaccttgttggttttgcccaaggtttcggggttgcaaaaagaaatggggatacagaagagccggtacgaaaatattttaaggaatgtctaaatactgggaactataacaatgacaattgtaaggctaatccattagcttccagcgtatccataaaaagcgatattttcaccccacggccaacaataaaaaatagccatatcaacagcgaaattttggctgtcggtaattatacagaattgatgttagctgcccaaccttctgcttcttcgtgggcagagcatctctattccgatccaggattatctcttactgttcaagataactcacacgttatcggacaaacgattgatttgggattcttacaattaacaaattctctttgggagccacgttggaattctaatatcgattatttagtaacagaaaatgctgaaattcgttttaatactaaaaatgaaagtttactcgtagaaggttattatgccggcggagctcgttttcgttttgcttacgatctaaaagataaagcccctgaaacaccagttttaacttttgaacaaaatataaccggcacctccgacatcatcttcgaaaatccaatagacgatttaaaaagcctagacggacatcaaattgtcaaagtaaatggcaccgcagataaaaatgcatttagactttctggtaaataccgaaaagggatttatacgctctctttacaacaacgcctagagggcttttttaccaaattgcaagaacgcgatgatattgcgatttatgcacaacaggctcaagccgccaataccttattcgctttgcgtttaaacgacaaaaacagcgatatttttgaccgcactttgccgcgcaaaggcttgtggttgcgtgtgattgacggacactccagccaatgggtgcaaggcaaaacggcacctctagaaggctatcgaaaaggtgtgcaactcggtggcgaagtattcacatggcaaaacgaaagtaatcaattttccgttggcttaatgggtggacaagcagaacaacgcagcactttccgcaatccagatacagataatcttacaacgggaaatatgaaaggcttgggcgcaggcgtttacgccacttggcatcaacttcaggacaaacagacaggtgcgtatgttgatagctgggcacaatatcaacgcttccgccaccgcattaacactgaagatggcacagaacgctttacttcaaaaggtatcaccgcctcaattgaagcaggttacaatgctttattagcagaacacttaacggggaaaggaactcaaattcgtttttacctacaaccacaggcacaattgacttatttgggggtaaacggaaaattcagcgatagcgaaaattcccaagtgaatctacttggctcccgccaattacaaagccgagtgggcgttcaagctaaagcgcaatttttactcaataaaaatatcgtcattcagcctttcgccgctgtgaacacgctttaccacagcaaaccgttcggcgtggaaatagacggagagcgtcgagtaataaacaacaaaaccgcgattgaaagccaatttggtatagcagtgaaaatcaaatctcacttaactttacaagccacattcaatcgccaaacaggcaaacatcaccacgctaaacaaggtgcactgaatttacagtggacgttt

SEQ ID NO: 3310 - protein, 716 aa, Haemophilus influenzae
  Name: NTH1845
LFSFILEFTPHLFLLDKGKFIMKLEASKQASKQASKQASKQASKQASKQASKQKFKKSFIISLFFSILYTSPLLAVVDYTYDNSKLTNEQIERLKKLRDRNSEYWKKETYLLKSPPSNFPDIPVLFPKDSSVPFENIDNSKAISFYDQKYTEDYLVGFAQGFGVAKRNGDTEEPVRKYFKECLNTGNYNNDNCKANPLASSVSIKSDIFTPRPTIKNSHINSEILAVGNYTELMLAAQPSASSWAEHLYSDPGLSLTVQDNSHVIGQTIDLGFLQLTNSLWEPRWNSNIDYLVTENAEIRFNTKNESLLVEGYYAGGARFRFAYDLKDKAPETPVLTFEQNITGTSDIIFENPIDDLKSLDGHQIVKVNGTADKNAFRLSGKYRKGIYTLSLQQRLEGFFTKLQERDDIAIYAQQAQAANTLFALRLNDKNSDIFDRTLPRKGLWLRVIDGHSSQWVQGKTAPLEGYRKGVQLGGEVFTWQNESNQFSVGLMGGQAEQRSTFRNPDTDNLTTGNMKGLGAGVYATWHQLQDKQTGAYVDSWAQYQRFRHRINTEDGTERFTSKGITASIEAGYNALLAEHLTGKGTQIRFYLQPQAQLTYLGVNGKFSDSENSQVNLLGSRQLQSRVGVQAKAQFLLNKNIVIQPFAAVNTLYHSKPFGVEIDGERRVINNKTAIESQFGIAVKIKSHLTLQATFNRQTGKHHHAKQGALNLQWTF

SEQ ID NO: 3311 - DNA, 711 bp, Haemophilus influenzae
  Name: NTH1846
atgaacataacaaagcggtgcaagaatatttacgctggtatcgcagccagaaaaatgccaaataaaagtgcggaagaaaatatgaaaggaaagtttattgtcattgagggcttagaaggtgcggggaaaagctccgctcatcagtctgttgtgcaagtcttgcatgaacttggtattcaagatgtcgtgtttacacgcgaaccgggtggaacgccactggctgagaaattacgtcatctcatcaaacatgaaaccgaagaacccgtgacagataaagcagagttattaatgctttatgcggctcgtattcagttggtggataacataattaaacctgcgttaatgcaagggaaatgggtggtgggcgatcgtcacgatatgtcatctcaggcgtatcaaggtggcggacgtcaattagatccgcattttatgcttactttgaaagaaaccgtattaggtgattttgagccagatctcacaatttatttggatatagatccaattgtcggtttagcgcgagctcgtggacgtggtgaattagatcgtattgagcaaatggatttagattttttccatcgcactcgagcacgctatttagcgttagtaaaagagaatccaaaagcagtcgtaattaatgctgagcagagtattgaacttgttcaagctgatatcgaaagagcggtaaaaaattggtggaaatcaaacgaaaaa

SEQ ID NO: 3312 - protein, 237 aa, Haemophilus influenzae
  Name: NTH1846
MNITKRCKNIYAGIAARKMPNKSAEENMKGKFIVIEGLEGAGKSSAHQSVVQVLHELGIQDVVFTREPGGTPLAEKLRHLIKHETEEPVTDKAELLMLYAARIQLVDNIIKPALMQGKWVVGDRHDMSSQAYQGGGRQLDPHFMLTLKETVLGDFEPDLTIYLDIDPIVGLARARGRGELDRIEQMDLDFFHRTRARYLALVKENPKAVVINAEQSIELVQADIERAVKNWWKSNEK

SEQ ID NO: 3313 - DNA, 990 bp, Haemophilus influenzae
  Name: NTH1847
gtggcgagttttgcttattacaaaatgactgaatttgtaaaaacaccagtaaatgtgcaggcagatcaacttttaactattgaacgtggcacaacaggtttaaaattagccgcactttttgagcaagaaaagttaattgatgatgggaaattattgccttatttgcttaagttgaaacctgagctaaataaaataaaagcagggacttattctcttgagaatgttaaaactgtgcaagatttactggatttgctcaattccggtaaagaagtgcagttcaatgtaaaatggattgaaggaaaaacctttaaagattggcgaaaagatcttgaaaatgcaccgcacttggtgcaaaccttgaaagataagagtaacgaagaaattttcacattacttgacttgcctgatattggtcaaaatcttgaactaaaaaatgtggaaggttggctttatcctgatacttataattatacgcctaaatccacagacttagagctacttaagcgatcggctgagcgaatgaaaaaggcgttaaataaggcttggaacgagcgcgacgaggatttacctttggcgaacccttatgaaatgttgattttggcttctatcgtggaaaaagaaacgggtattgctaatgagagggcaaaagtagcctctgtatttatcaaccgcttaaaagcaaaaatgaaattacaaacggatccaacggtaatttatggtatgggtgagaattacagcggtaatattcgtaaaaaagatttagaaaccccaacgccttataatacttatgtgattgatggattgccgccaacgcctattgctatgccaagtgaaagttcgttacaggctgttgcaaaacctgaaaaaacagatttctattattttgtggcagatggttctggtgggcataaatttacccgaaatttgaatgaacataacaaagcggtgcaagaatatttacgctggtatcgcagccagaaaaatgccaaa

SEQ ID NO: 3314 - protein, 330 aa, Haemophilus influenzae
  Name: NTH1847
VASFAYYKMTEFVKTPVNVQADQLLTIERGTTGLKLAALFEQEKLIDDGKLLPYLLKLKPELNKIKAGTYSLENVKTVQDLLDLLNSGKEVQFNVKWIEGKTFKDWRKDLENAPHLVQTLKDKSNEEIFTLLDLPDIGQNLELKNVEGWLYPDTYNYTPKSTDLELLKRSAERMKKALNKAWNERDEDLPLANPYEMLILASIVEKETGIANERAKVASVFINRLKAKMKLQTDPTVIYGMGENYSGNIRKKDLETPTPYNTYVIDGLPPTPIAMPSESSLQAVAKPEKTDFYYFVADGSGGHKFTRNLNEHNKAVQEYLRWYRSQKNAK

SEQ ID NO: 3315 - DNA, 795 bp, Haemophilus influenzae
  Name: NTH1848
atggttttgactattaaaatgtccgttgaaaaagcctattccactgattccaatatgctcggcgcaacccatgaagcaaaagacttagaacaattaagcacaggaatgaaaattgttaagccgattatgggtgtcgcattttgggatgaaaaggttgaaattaaacctgaaacagtcacagtcacttttgaagatggcgtgcctgtggcattaaatggcaaacattttgataatgctgttgatcttattctagaagccaatcgtattggtgggcgtcacggtttaggaatgtcagaccaaatcgaaaatcgtattattgaagccaaatctcgtggtatttatgaagcaccaggaatggcattattgcatatcgcttacgaacgtttagtcacaggtattcacaatgaagataccatcgaacaatatcgtattaatggcattcgcttaggtcgtttgttatatcaaggtcgttggtttgatccgcaagcattaatgttgcgtgaaacagcacaacgttgggtggcaaaagcaattacaggcacagtaacccttgaacttcgtcgtggtaacgacttcacaattttaaataccgaatcgccaaacttaacctacgaagcagagcgtttaagtatggaaaaagtggaagatgcgccatttgatccagttgatcgtatcggtcaattaacaatgcgtaatttagatgtatcagacacccgaggtaaacttggcatctatgcacaaacaggtttattaagcgcaattaaagattccgtattgccacaattaggcaaaaaa

SEQ ID NO: 3316 - protein, 265 aa, Haemophilus influenzae
  Name: NTH1848
MVLTIKMSVEKAYSTDSNMLGATHEAKDLEQLSTGMKIVKPIMGVAFWDEKVEIKPETVTVTFEDGVPVALNGKHFDNAVDLILEANRIGGRHGLGMSDQIENRIIEAKSRGIYEAPGMALLHIAYERLVTGIHNEDTIEQYRINGIRLGRLLYQGRWFDPQALMLRETAQRWVAKAITGTVTLELRRGNDFTILNTESPNLTYEAERLSMEKVEDAPFDPVDRIGQLTMRNLDVSDTRGKLGIYAQTGLLSAIKDSVLPQLGKK

SEQ ID NO: 3317 - DNA, 264 bp, Haemophilus influenzae
  Name: NTH1849
ttggattatgcttttattgtgatttctactgttgttttagtcactgtggaaaagcctgctgcggtattagtctttgtgggaacattaaatggcttaatattgccgattgcattggcattaattttgttagctgcttacagaagtgatattgttggcacttataaacaccctgtttttttagctttttcaggctggtttgttgtgattattatggcaatattaagtggaaaaacgattatttcttatatttctagtttttttagc

SEQ ID NO: 3318 - protein, 88 aa, Haemophilus influenzae
  Name: NTH1849
LDYAFIVISTVVLVTVEKPAAVLVFVGTLNGLILPIALALILLAAYRSDIVGTYKHPVFLAFSGWFVVIIMAILSGKTIISYISSFFS

SEQ ID NO: 3319 - DNA, 945 bp, Haemophilus influenzae
  Name: NTH1850
atggcatcaattactcacagacgaaatgcggttttaggggcagctttcttaatggcgacatccgccataggccctggatttttaactcaaaccgcaacctttacaaatactttattagcgagttttggctttgttattttattatcaattttgttagatattggggctcaacttaatatttggcgaattgttattgtgtctggcaaacgcgcgcaagatatttctaatgcggtttttccgaaagcagggtattttcttgctgcgctgattgtgatgggcgggctggcttttaacattggcaatgttggcggcgcggggcttggtttaaattctatttttggtatagcaccagaaatgggcgcagtgattagtggtattattgctattttgatttttttgcgtaaagaagcaggcttattaatggatcgttttgcgcaattaatgggctttattatggttgcgctcacattttatgtaatgtttaaaactgaaccacctgtggctgaagcagcgtatcattcctttattccagaaaaaattgatcctattgctattgttacattagtggggggaaccgtaggcggttatattacttttgcaggcgcgcatcgtttattagatgcgggcattcaaggcgaaaaagcaatggctgaagtgagccgtagttctgtatcagccattttaattgcttcaacaatgcgtgttgtattatttcttgcggtgcttggcgtggtgtcaaaaggtgtgtctcttaatcctaaaaatccagctgaaacgccttttgaatatgtagcaggcaattttggtcaagtgttatttggagtggttatttgggcagcgtctgtcacatctgttattggtgcggcttatacttcagtttctttcttaacgaccctttgtccaaccattgaacgcaatcgtaatcgttggattatgcttttattg

SEQ ID NO: 3320 - protein, 315 aa, Haemophilus influenzae
  Name: NTH1850
MASITHRRNAVLGAAFLMATSAIGPGFLTQTATFTNTLLASFGFVILLSILLDIGAQLNIWRIVIVSGKRAQDISNAVFPKAGYFLAALIVMGGLAFNIGNVGGAGLGLNSIFGIAPEMGAVISGIIAILIFLRKEAGLLMDRFAQLMGFIMVALTFYVMFKTEPPVAEAAYHSFIPEKIDPIAIVTLVGGTVGGYITFAGAHRLLDAGIQGEKAMAEVSRSSVSAILIASTMRVVLFLAVLGVVSKGVSLNPKNPAETPFEYVAGNFGQVLFGVVIWAASVTSVIGAAYTSVSFLTTLCPTIERNRNRWIMLLL

SEQ ID NO: 3321 - DNA, 771 bp, Haemophilus influenzae
  Name: NTH1851
atgaaatataccttgatcaaattaggagaattgttgatgaaaaaaattgatttaaatgcagatattgcagagggttttccttttgatgaaagtttattgcagttgctttcttctgcaaatattgcttgtggcttacacgctgggggcgcaaaggaaatgcaaagtgcggtcaaatttgcgaaagaaaataaggtgcgtattggtgcacatcctagttttcctgatcgcgaaaattttggtcgtacggcaatggcgttgtcttcacaggaattaatcgcacatttgcgttatcaattgggggcattaaaagcgatttgtgatggcgagggggcggtaattagttatgttaaacctcacggtgcgttatataaccaagcagcaaaagatgaaaaaatagcgcgtgtaattgcacaaaccgtttatcaatttgatccgaatttgaaattaatggggttagcaggcagtttaatgttgcgcatcgcagaggaagaaaaattgcaaacgatttctgaagtttttgccgatcgacattatatgcctgatgggagtttggtgcctcgttctcaaccaaatgcaatggtggaatctgataaggaagccattcaacaagtgttacaaatggtaacaaaggggcaagtcaatgccattgatggaagccttgtgcctgtaaaagcagaaagtatttgcttacacggcgataatcaacattctttacaatttgctaaacgcattgtggaagaattagaaaaaaatcatatcaaaataacggca

SEQ ID NO: 3322 - protein, 257 aa, Haemophilus influenzae
  Name: NTH1851
MKYTLIKLGELLMKKIDLNADIAEGFPFDESLLQLLSSANIACGLHAGGAKEMQSAVKFAKENKVRIGAHPSFPDRENFGRTAMALSSQELIAHLRYQLGALKAICDGEGAVISYVKPHGALYNQAAKDEKIARVIAQTVYQFDPNLKLMGLAGSLMLRIAEEEKLQTISEVFADRHYMPDGSLVPRSQPNAMVESDKEAIQQVLQMVTKGQVNAIDGSLVPVKAESICLHGDNQHSLQFAKRIVEELEKNHIKITA

SEQ ID NO: 3323 - DNA, 927 bp, Haemophilus influenzae
  Name: NTH1852
atgattgatattcttgatgtgaaatcccgcgccaccattcaagatttagggcgttttggtttacgccgatttggcattagccattgtggggcaatggataaattagcattacgcgcaggcaatattttattgggcaatgcagagaatgttcctgccattgaagtgcctttaggcggtattacattgcaatttcagcaagatatgaatttttgtgtgactggtgctttttatgaaatgatgttagatgataagcccgtttttgcttattggcgttatcaagtgcgagcaggtcaaatattaaaaatgacacgtgcaaaaattggaatgtatggttatttatgtgttcaaggtggttttgttttgcctcaagcattgaattcttgcagcacggatttgagagcggaaatagggggcattgaggggcgttgtttgcaggcgggcgatcaactacaaacggcaaatgatcatattttgcgtagcgaaattggtattgcaccgattccgcttcgagatgttattcgtgctttgccatcttctgaatatcaggcgtttaaacgaaaatcccaatattattggtggcgaaatgaatggacgttgcaaagtaacagtgatcgtatgggttatcgttttcaaggtcagacattagaattaaagcagccgttggaaatgctatctcacgccattcagtttggtagtgtgcaagttccaccaagtggtcagcctattattttgatggctgatgcgcaaaccacaggcggttatcctaaaatcgctaatgtgattgatgctgatcttggggctttggcacaggtacgtttaggttcaacgattaaatttgaagcggttagcttacaagaggctgctaaattacgccgtaaaaatgaaatataccttgatcaaattaggagaattgttgatgaaaaaaat

SEQ ID NO: 3324 - protein, 309 aa, Haemophilus influenzae
  Name: NTH1852
MIDILDVKSRATIQDLGRFGLRRFGISHCGAMDKLALRAGNILLGNAENVPAIEVPLGGITLQFQQDMNFCVTGAFYEMMLDDKPVFAYWRYQVRAGQILKMTRAKIGMYGYLCVQGGFVLPQALNSCSTDLRAEIGGIEGRCLQAGDQLQTANDHILRSEIGIAPIPLRDVIRALPSSEYQAFKRKSQYYWWRNEWTLQSNSDRMGYRFQGQTLELKQPLEMLSHAIQFGSVQVPPSGQPIILMADAQTTGGYPKIANVIDADLGALAQVRLGSTIKFEAVSLQEAAKLRRKNEIYLDQIRRIVDEKN

SEQ ID NO: 3325 - DNA, 639 bp, Haemophilus influenzae
  Name: NTH1853
atgaatatcgttccgatcagtgaatcggcggtggtttgctctttgccacccccagcttccattcaacaacaacgccaattatgggcgtttgctcgtcaattgcaatcagaacaagatattgtagaagttgtcttgggaatgaataatcttacggtttttaccgattttttcgtggattttaagccgcttgtgcaacgtttagaacaactttgggctgagttgaaagtatcggattttcaagggcgtcatattgaaattcctgttatttatgggggagagcgaggtcaggatttatctgatgtagcgaaatttcatcagacaacaccaaagcggattattcagatgcacagtgagcctatttatactgtgtatatgattggcttccaagcgggctttccttatttgggtggtttacctgaaaatttacacacgccgcgtcgcgccacgccaagaacggttgttcctgctggttctgttggtattgggggtgcgcaaacggggatttatcctttttcttcgccaggtgggtggcagttgatcggttatactaaacaagcactttttgataaaaatcaagcacaaccaaccttattacaagctggcgatactgtgaaatttattgtggatgggattgaacta

SEQ ID NO: 3326 - protein, 213 aa, Haemophilus influenzae
  Name: NTH1853
MNIVPISESAVVCSLPPPASIQQQRQLWAFARQLQSEQDIVEVVLGMNNLTVFTDFFVDFKPLVQRLEQLWAELKVSDFQGRHIEIPVIYGGERGQDLSDVAKFHQTTPKRIIQMHSEPIYTVYMIGFQAGFPYLGGLPENLHTPRRATPRTVVPAGSVGIGGAQTGIYPFSSPGGWQLIGYTKQALFDKNQAQPTLLQAGDTVKFIVDGIEL

SEQ ID NO: 3327 - DNA, 93 bp, Haemophilus influenzae
  Name: NTH1854
ttgcctaaaacctgctttcaatgccagaaagcaggtttttcttttaatttttaccgcacttttcaacaaaaaacacctaaaatgggtcaagat

SEQ ID NO: 3328 - protein, 31 aa, Haemophilus influenzae
  Name: NTH1854
LPKTCFQCQKAGFSFNFYRTFQQKTPKMGQD

SEQ ID NO: 3329 - DNA, 291 bp, Haemophilus influenzae
  Name: NTH1855
ttggctatattgccgttatcttgcaccgaagtggctgaaaatgtggaatttaatgcagaagtgcaagatgtaatgcgtggtggattacgtgtgcaattattagaaaatggcgcctcaatgtttatacctgcgtccactttacataataataaagaagaaatgcaggtgaattcagatgagattgccctttatattaaaggcgaacgcacttacaaaataggcgacattgtgaaagtgaaactcacagaagtgaaagaagcaactcgcagtattgtgggcgaaatacttcaa

SEQ ID NO: 3330 - protein, 97 aa, Haemophilus influenzae
  Name: NTH1855
LAILPLSCTEVAENVEFNAEVQDVMRGGLRVQLLENGASMFIPASTLHNNKEEMQVNSDEIALYIKGERTYKIGDIVKVKLTEVKEATRSIVGEILQ

SEQ ID NO: 3331 - DNA, 111 bp, Haemophilus influenzae
  n 102, 103, 104, 105, 106: n is any nucleotide
  Name: NTH1857
gtgcaagataacggcaatatagccaatctgcaatatcacgttctacgaggcgattttggcggcgagcctcttgcaaacgtgccaacacgtcatttgtgtttnnnnnttaat

SEQ ID NO: 3332 - protein, 37 aa, Haemophilus influenzae
  Xaa 34, 35, 36: Xaa is any amino acid
  Name: NTH1857
VQDNGNIANLQYHVLRGDFGGEPLANVPTRHLCXXXN

SEQ ID NO: 3333 - DNA, 564 bp, Haemophilus influenzae
  n 551, 552, 553, 554, 555: n is any nucleotide
  Name: NTH1858
atgattatttcatcagctagcgattatcgtgaagcggcgcgccgccgtgttcctccctttatgttccattatgccgatggcggttcttatgccgagcaaacacttgcgcgtaatgtgagtgatttggaaaatattgctttaagacaacgtgtcttaaaagatatgtctgaattggatactagtatagaattatttggtgaaaaactttcaatgccaactattcttgcaccagttggggcgtgcggaatgtatgcacgtcgtggagaagtacaagcagcacaagcggcagataataaaggtgtgccgtttaccctttcaacagtatcaatttgtccaattgaagaagtcgcccctgcgattaagcgtccaatgtggtttcagctttatgtgttaaaagatcgtggttttatgaaaaacgcacttgagcgtgcgaaagcagcaggctgttctactttagtgtttacggtcgatatgcctactccaggtgcgcgttatcgtgatatgcactcaggtagaatggggggtaccgagtctgatattcgtataccagnnnnnttaattaat

SEQ ID NO: 3334 - protein, 188 aa, Haemophilus influenzae
  Xaa 184, 185: Xaa is any amino acid
  Name: NTH1858
MIISSASDYREAARRRVPPFMFHYADGGSYAEQTLARNVSDLENIALRQRVLKDMSELDTSIELFGEKLSMPTILAPVGACGMYARRGEVQAAQAADNKGVPFTLSTVSICPIEEVAPAIKRPMWFQLYVLKDRGFMKNALERAKAAGCSTLVFTVDMPTPGARYRDMHSGRMGGTESDIRIPXXLIN

SEQ ID NO: 3335 - DNA, 807 bp, Haemophilus influenzae
  Name: NTH1859
atggataaaaaagaaaaacgcccaactgtacttttttttgactctggagtgggtgggtttagcgtataccgtgaagctaaaaaattattacccaattggcattatctctattgctttgataatgcgggattcccttattcagaacgcgaagaagaaagtattattcaccgcactttagcggcgtgtcagcttattaatcaacgttatccattagatgcaatcgtgatagcttgcaatacagcgagtactgttgtgcttccgcctttgcgagctgcttttgagattcctatcattgggactgttcccgctattaaacctgcatcagaaataacaaagacaaaacatattggtttattagctacaaagggtacagtaaagcgtcattatatcgatgagttgattgataaatttgcgcaagattgtattgttgagagactgggaacgacaaaattagtcgaaattgcggagcaaaaaattcgtggtcattccgttgatctcattagtttaaaagatgagttatcttcgtgggcaggcatggcagatttggatacattagttttaggttgtactcactttcctctcatcaaagatgaaattcagttatgcttgccacaagttaaatattttatggatccgagcgcagcaattgctaaacggatcaaatatttacttgatgataaaaatctacaagtgcaaaatgaaaaatataatcaaatgttttgcaccgcacattttcccgaagaatctcaatttaaaaaagctttacatctatggggatttgaatctttggaagtaatcaaaatagat

SEQ ID NO: 3336 - protein, 269 aa, Haemophilus influenzae
  Name: NTH1859
MDKKEKRPTVLFFDSGVGGFSVYREAKKLLPNWHYLYCFDNAGFPYSEREEESIIHRTLAACQLINQRYPLDAIVIACNTASTVVLPPLRAAFEIPIIGTVPAIKPASEITKTKHIGLLATKGTVKRHYIDELIDKFAQDCIVERLGTTKLVEIAEQKIRGHSVDLISLKDELSSWAGMADLDTLVLGCTHFPLIKDEIQLCLPQVKYFMDPSAAIAKRIKYLLDDKNLQVQNEKYNQMFCTAHFPEESQFKKALHLWGFESLEVIKID

SEQ ID NO: 3337 - DNA, 2079 bp, Haemophilus influenzae
  Name: NTH1860
atgagccttgaacttctcgatgccgtgcctttgaccagcctttctggtgtgggggctgccatttctaataaactggctaaaatcggcattcagaatctgcaagatttactctttcatttacctattcgctatgaagatcgtacgcgaattacgccaatcgctaatcttcgccctgaacaatattttactatagagggaattgtacaaacctgtgaagtcgcttttggccgtcgcccgattttatcggtaagtttgtcagacggcacatcgaaaattatgttacgttttttcaattttaatgcgggaatgcgtaatagttttcaagcaggtgtgcgagtaaaggcctttggcgaagtgaaacgtggtcgccatatgccagaaattcatcatccagaatatcaaattgtgcgagataatgcgcccatagtattggaagaaaccctaacgccgatttattccacaacggaggggttaaaacaaaattcattacgaaaattaacggatcaggctttgacattactcgacaaggttcagattgcagaaattttgcctaatgaatttaatccacatcaatatagcttaaaagaggcattgcgattattgcatcgtccgccgccagatatttcattagaaatgttagagcaaggtaagcatcctgcacaacaacgattaatttttgaagagcttctggcacataatttagctatgcaaaaagtgcggttaggaacgcaacaattttctgccttaccgctacattatcaaacagatttgaaacagcgatttttagccaccttgccatttcaaccaactaatgcgcaaaagcgagtagtgtccgatattgaacaagatcttatcaaagattatccgatgatgcgcttagtgcaaggggatgtaggctcgggaaaaacattggttgccgcattggctgctttaactgcaattgataatggcaaacaagtcgccttaatggcgccaacagaaattcttgcagaacagcatgcgaataattttagacggtggtttgagcctttcggtattgaagttggctggttggcaggtaaagtaaaaggaaaatcaagacaagcagagcttgaaaaaatcaaaactggtgccgtgcaaatggtggtggggacgcatgctttattccaagaagaagtcgagttttccgacttagcattagtgattattgatgaacaacatcgttttggggtgcatcaacgattaatgttgcgtgaaaaaggcgaaaaagcgggatttcatccccatcagttaattatgacggccacaccgattccgagaacgttggcaatgaccgtatatgcagatttggatacatcaattattgatgaattgcctccaggtcgtacgccgataacaaccgtagtggtttctgaagaacgtcgcgctgaaattgtgatgcgtgtaaaaaacgcttgtgttaatgaaaaacgtcaagcctattgggtgtgtacgttaattgatgaatcagaggtgttagaagctcaagcagctgaagcgatttgggaagatttaacgaaagcgttaccgatgttaaatattggtttagtgcacgggcgcatgaaaccccaagaaaaacaagatgtcatgatgcgttttaaaaatgcagaattggatttattggtggcgacgacagtcatcgaagtgggggttgatgttccgaatgcaagtttgatgattatcgaaaatgcagaacgtttaggtttatcgcagcttcatcagttacgagggcgcgtcggtcgaggcagcacggcttctttttgtgtactaatgtataaacctccgctaggtaaagtttcgcaaaagcgtttgcaagtgctaagagatagccaagatgggtttgttatttcggaaaaagatttagaaattcgtgggccaggtgaagtacttggaacgaaacaaacgggaattgctgaattgcgaatagcaaatttaatgcgagatagaaaaatgataccaacggtgcaacattatgcgaaatcacttatccaaaaataccctgatgtggcagaaagcctaatctgtcgctggctcaataataaagaaatttactcgaacgct

SEQ ID NO: 3338 - protein, 693 aa, Haemophilus influenzae
  Name: NTH1860
MSLELLDAVPLTSLSGVGAAISNKLAKIGIQNLQDLLFHLPIRYEDRTRITPIANLRPEQYFTIEGIVQTCEVAFGRRPILSVSLSDGTSKIMLRFFNFNAGMRNSFQAGVRVKAFGEVKRGRHMPEIHHPEYQIVRDNAPIVLEETLTPIYSTTEGLKQNSLRKLTDQALTLLDKVQIAEILPNEFNPHQYSLKEALRLLHRPPPDISLEMLEQGKHPAQQRLIFEELLAHNLAMQKVRLGTQQFSALPLHYQTDLKQRFLATLPFQPTNAQKRVVSDIEQDLIKDYPMMRLVQGDVGSGKTLVAALAALTAIDNGKQVALMAPTEILAEQHANNFRRWFEPFGIEVGWLAGKVKGKSRQAELEKIKTGAVQMVVGTHALFQEEVEFSDLALVIIDEQHRFGVHQRLMLREKGEKAGFHPHQLIMTATPIPRTLAMTVYADLDTSIIDELPPGRTPITTVVVSEERRAEIVMRVKNACVNEKRQAYWVCTLIDESEVLEAQAAEAIWEDLTKALPMLNIGLVHGRMKPQEKQDVMMRFKNAELDLLVATTVIEVGVDVPNASLMIIENAERLGLSQLHQLRGRVGRGSTASFCVLMYKPPLGKVSQKRLQVLRDSQDGFVISEKDLEIRGPGEVLGTKQTGIAELRIANLMRDRKMIPTVQHYAKSLIQKYPDVAESLICRWLNNKEIYSNA

SEQ ID NO: 3339 - DNA, 1545 bp, Haemophilus influenzae
  Name: NTH1861
atgcatccacatcgttatgaggtgttaaaaaaactcgttgatgtggcacggagtaatcgacaagatttaatcgaacgtatttcacaagagattaaagtgcggttagaaaacgcaggcatttttgcccgagtgtggggacgtgaaaaacatctttataagatctatcaaaaaatgcgtataaaggatcaagaattccactctattatggatatttatgcgttccgtgtgattgtgaaaaatgttgatgattgttatcgcattttggggcaaatgcataatctttataagccacgtccaggccgagttaaggattatatcgccgtacctaaagcaaatggctatcaatctttgcaaacttcaatgattgggccgaaaggagttcccgtagaagttcatatccatactgaggatatggaacaagtcgctgaaatgggcattactgcgcattgggtttataaagaaaatggtaaaaacgatagtacaaccgcacaaatccgcgtacaacgctggttgcaaagtttggtcgaaattcaacaaagtgtaggtaattcgtttgagtttattgagaatgtaaaatcagagtttttcccgaaagaaatttatgtttttacgccaaaaggtcgaattgttgaattaccaatgggcgcaacagcagtagatttcgcttatgctgtgcattcagatgtggggaatacttgtgttggcgtgactgttgagcataaaccttatccactttcaaaagcccttgaatcagggcaaacagtcaatattattactgatccaaatgcgcatcctgaagtcgcatggttaaattttgtggtaacggctcgtgcgaaaacacggattcgccattatctcaaacagcgttgtgaagaggatgcggtgaaattaggcgaagttgagcttaatgtagcattgcagccgcataatttaggtgatttttctattcaacaaattagcactgtattagatgctttagccctttcttctttagatgaattattacgagaaattggtttaggtaatcagtcagcctccatgattgcgcatcaatttgtgggcgtgccgttagaatctgctaatactaagaatctcgaatttgaatcaaaaatactcactattgcaccaatgcaagtgggtaaaacacaatttgcgcaatgttgccatccaatcctaggtgatcctattgtgggatgttgtacagaaaaaaatacagttgtggtacaccatcaacattgtgcaagtttgaaaaatgcttgtcgtcaatcgttggctaaatgggataacgttcaaagtgcggtgaattttgaggctgaattacaaatagaaatattgaatgagcagaatgccttgcttagtttaatgaccgcaatttcagcgagcgaaagcagtctccaaaatatttggacggaagaattagagaacaatttattgcttgtgattttgcaggtttgtgtaaaagatatcaaacaccttgccaatatcgttcatcgtattaaaggcatcactggcgtcgttaatgtcaaacgcaatattaatgagcta

SEQ ID NO: 3340 - protein, 515 aa, Haemophilus influenzae
  Name: NTH1861
MHPHRYEVLKKLVDVARSNRQDLIERISQEIKVRLENAGIFARVWGREKHLYKIYQKMRIKDQEFHSIMDIYAFRVIVKNVDDCYRILGQMHNLYKPRPGRVKDYIAVPKANGYQSLQTSMIGPKGVPVEVHIHTEDMEQVAEMGITAHWVYKENGKNDSTTAQIRVQRWLQSLVEIQQSVGNSFEFIENVKSEFFPKEIYVFTPKGRIVELPMGATAVDFAYAVHSDVGNTCVGVTVEHKPYPLSKALESGQTVNIITDPNAHPEVAWLNFVVTARAKTRIRHYLKQRCEEDAVKLGEVELNVALQPHNLGDFSIQQISTVLDALALSSLDELLREIGLGNQSASMIAHQFVGVPLESANTKNLEFESKILTIAPMQVGKTQFAQCCHPILGDPIVGCCTEKNTVVVHHQHCASLKNACRQSLAKWDNVQSAVNFEAELQIEILNEQNALLSLMTAISASESSLQNIWTEELENNLLLVILQVCVKDIKHLANIVHRIKGITGVVNVKRNINEL

SEQ ID NO: 3341 - DNA, 450 bp, Haemophilus influenzae
  n 445, 446, 447, 448, 449: n is any nucleotide
  Name: NTH1862
atgggtaatttagcactgaaactcggttatattcatcgtgataataaaaatcgtatcatattgaaacgagagactataagggaaaacataaaaactagttatatcaatggacgtccattcggtgttgatatttatactttccaacttaacaatatagaaccttggaaattaggtaaaacttattggactacgtcacttggttttgattggttaaatacaaaacgagctgatggcgaagaatttgatctaaataaacttgtttctttagatggtaaattaatgacttatcgtgaaatgttacgacaagttaatagtaacactgaagattggattgctcgtttaggtattgatatgacgataccaaattacgatattacttggtcaaataaagtgtatatgaaagcaccaattcgtcgttatgatttgattaacagcggtggggatnnnnnt

SEQ ID NO: 3342 - protein, 150 aa, Haemophilus influenzae
  Xaa 149, 150: Xaa is any amino acid
  Name: NTH1862
MGNLALKLGYIHRDNKNRIILKRETIRENIKTSYINGRPFGVDIYTFQLNNIEPWKLGKTYWTTSLGFDWLNTKRADGEEFDLNKLVSLDGKLMTYREMLRQVNSNTEDWIARLGIDMTIPNYDITWSNKVYMKAPIRRYDLINSGGDXX

SEQ ID NO: 3343 - DNA, 1044 bp, Haemophilus influenzae
  Name: NTH1863
atgcaagttgtacccggaattagtcacactcaagcttatttctttgatgcgactatgctttctaaagtggaggtacaagatagtaatatttctgctagcttagggggatttatggggggtgccgttatagccaaaacaaaacaatatagcggcactgatagcataaaacttaaatatcgcacgacaaattcctcttgggcaaaaatggaagctggagactcagtacaaaaaatacttaaacaagtaagaccagatcttgtcggagtggcagagctacaacctaaatatgataaacaaacattcaatattttggctgaaaaaaggctaaatgataatttaggaatggtttttggctatagccgtagaacatcatctattgaacaaaatcgtttaattggctttgatcaaaatgccaataataaagcacagttagacaaacaaaatcatcaacgactttccgataatcttttattaaatttcaattggacaccgcaagaaaaagaacgtattgaactcggtttacgttattcaaattataaagaattgaaatatttccaggaaaatataaataacaacgtaagcgattatcatcaagcattggggacaacactagcttgggtgcattcattcaactctggcgtttggacaaataccttagcatacgatcgttttaaagataagcgtaaatcatcctcaaatagtgttgaaacaacatctgtgttagatgaatattatgaagcgctttataattttgaaaaaggcgggcatggtaatagccgtttaacccaagataatttacatttttctactgaatatgtaatggatcctttttatttagcttctacggagcattctgtttctattggtggaatttatcaggcaactaaatatcaattctatcgtccacaagatgttcattcaaaaataacattatctactttgcaaagtgatgggagtatgaatattttcagatcagataaaagtacaacaccaaaagtcgtgttaaaaccagctatcaaaatatcgctatttatgctgaagatt

SEQ ID NO: 3344 - protein, 348 aa, Haemophilus influenzae
  Name: NTH1863
MQVVPGISHTQAYFFDATMLSKVEVQDSNISASLGGFMGGAVIAKTKQYSGTDSIKLKYRTTNSSWAKMEAGDSVQKILKQVRPDLVGVAELQPKYDKQTFNILAEKRLNDNLGMVFGYSRRTSSIEQNRLIGFDQNANNKAQLDKQNHQRLSDNLLLNFNWTPQEKERIELGLRYSNYKELKYFQENINNNVSDYHQALGTTLAWVHSFNSGVWTNTLAYDRFKDKRKSSSNSVETTSVLDEYYEALYNFEKGGHGNSRLTQDNLHFSTEYVMDPFYLASTEHSVSIGGIYQATKYQFYRPQDVHSKITLSTLQSDGSMNIFRSDKSTTPKVVLKPAIKISLFMLKI

SEQ ID NO: 3345 - DNA, 204 bp, Haemophilus influenzae
  Name: NTH1865
atgtatcaaaaaaagccattaatgttgttattctgcacaacatttgttagtccatttgttatggggaaaactattgaaacaaccaacaaccaacaaccaacaaccaacaaccaacaaccaacaaaaatatattgcccgaaattgttgtgtatggcgacaataataaatcactttcttccgttaaaacactctcttctgacgaga

SEQ ID NO: 3346 - protein, 68 aa, Haemophilus influenzae
  Name: NTH1865
MYQKKPLMLLFCTTFVSPFVMGKTIETTNNQQPTTNNQQPTKIYCPKLLCMATIINHFLPLKHSLLTR

SEQ ID NO: 3347 - DNA, 207 bp, Haemophilus influenzae
  Name: NTH1867
atgaaaattagtgcaagaaaccaactaaaaggtaaagttgtttcaatcgaaaacggttcagtaaatgcaatcgttcacattgatatcggtggcggtaacgtgctttcttctactgtgtctttagctgcagttaaagaattaaacttagaagttggtaaagaagcatacgcaatcatcaaagcaacttctgtaatggttggcgtagaa

SEQ ID NO: 3348 - protein, 69 aa, Haemophilus influenzae
  Name: NTH1867
MKISARNQLKGKVVSIENGSVNAIVHIDIGGGNVLSSTVSLAAVKELNLEVGKEAYAIIKATSVMVGVE

SEQ ID NO: 3349 - DNA, 327 bp, Haemophilus influenzae
  Name: NTH1868
atgttgaatatcaatggaattgaagttgaaactgataaagatggttatttgctccacagccaacaatggaacgaagatgtcgctcgtgctattgctcggttagaaagtatcgaattaacagatgcccattgggaagtgatttactttgtacgagacttttatcaagaatataacacctctccagccatccgtatgttggtaaaagccatggctgaaaagcttggtgcagataaaggtaatagccgctatttgcaacgcttatttcctgaaggccctgcaaaacaagctacaaaattagcaggtttgccgaaacctgcaaaatgccta

SEQ ID NO: 3350 - protein, 109 aa, Haemophilus influenzae
  Name: NTH1868
MLNINGIEVETDKDGYLLHSQQWNEDVARAIARLESIELTDAHWEVIYFVRDFYQEYNTSPAIRMLVKAMAEKLGADKGNSRYLQRLFPEGPAKQATKLAGLPKPAKCL

SEQ ID NO: 3351 - DNA, 930 bp, Haemophilus influenzae
  Name: NTH1869
atgacccagttagcccaacaagaaaaaaaacaaacctataattttaataaattacaaaaacgtcttcgccgtaacgtaggcaacgccattacagattttggaatgatcgaagatggcgataaagtcatggtgtgtttatccggaggcaaagacagttatacgcttctcgatattttgttgaatttacagcaaaatgcaccgattaaatttgatattgtggcagtgaatctcgatcaaaaacaaccagggtttccagaacacgtattgcctgaatatttagaaagcattggcgtagattacaaaattgtacaagaaaatacttacggaattgtgaaagaaaaaattccagaaggaaaaaccacttgttcgctctgctctcgcctacgccgtggaattttatatcgtactgccacagaacttggtgcaaccaaaatcgctttaggacatcaccgagacgatatgttagcgaccctatttttaaatatgttttatggcggcaaaatgaaatccatgccacctaaattgatttctgacgatggtaaacaaattgtgattcgtccgcttgcttattgcaaagaaaaagacattgagaaatatgccatcgcgaaggaatttccgattattccttgtaacctatgtggctcacaaccaaatcttcaacgccaagttgtaaaagaaatgcttaatacttgggatcgccaatatccgggacgcttagaaaccatgttcagtgcaatgcaaaacattacattgtcacatatgtgtgatccgaaattatttgatttcaaaggaatcaaacatggacaactaattgatggcattgaaggcgatacagcatttgatgaagaaaaaatcacaccaatgcaatttgaagacgaagatcaaactgatttttcaaacaacgaaatgattaactttaaagaagtaaat

SEQ ID NO: 3352 - protein, 310 aa, Haemophilus influenzae
  Name: NTH1869
MTQLAQQEKKQTYNFNKLQKRLRRNVGNAITDFGMIEDGDKVMVCLSGGKDSYTLLDILLNLQQNAPIKFDIVAVNLDQKQPGFPEHVLPEYLESIGVDYKIVQENTYGIVKEKIPEGKTTCSLCSRLRRGILYRTATELGATKIALGHHRDDMLATLFLNMFYGGKMKSMPPKLISDDGKQIVIRPLAYCKEKDIEKYAIAKEFPIIPCNLCGSQPNLQRQVVKEMLNTWDRQYPGRLETMFSAMQNITLSHMCDPKLFDFKGIKHGQLIDGIEGDTAFDEEKITPMQFEDEDQTDFSNNEMINFKEVN

SEQ ID NO: 3353 - DNA, 1179 bp, Haemophilus influenzae
  Name: NTH1870
gtgcggtcaattcaaaagaagatttttaagatccgcaaaaaatcctgtataatctttccaattttttgttcaattttaacgctttgcaattcaatgattgaaacatcccaaactattcctgaactcgtctcttgggcaaaagatcgcgagttttctttgaatttacctaccgaacgcttggttttcctgctggcgattgcaatttataacaacgaacgtttagacggcgaaatgttagaagccgatcttgtggatattttccgccacacgatgaatgcttttgagcaatccaccgatgccattgcaacacgagcgaataatgcaattaatgaattagtgaaacaacgtttgttaaatcgttttagtagcgaatttactgagggcttggcgatttatcgtttaacaccattaggtgttggtgtgtctgattattacattcgtcagcgtgaattttccgcattgcgtctttcagtgcaactttccattgtggcagatgaaattcaacgtgcttctgattctgcggaagagggtgtggagaataatgaaagtgaacattattggcgtcgtaatgtgtttgcgccattaaaatattccgttgcagagatttttgatagcatcgatctttcacaacgtattatggatgaaaatcagcaaagtattaaagatgaaattgcagagcttcttactaaagattggcaagcggcaatttcaagctgtgaacgtttattagatgaaacatctgggaatttgcgtgaattgcaagatacgctaaatgccgcaggggataaacttcaagcgcaattattgcgtattcaagattgtgtgattgggcgagatgatttgtattttatcgatcagttgattacggatttgcaatccaaactagaccgtattattagctggggacaacaagccattgatttatggattggttatgaccgccatgtacataaatttatccgaactgccattgatatggataaaaatcgtgtgttctcacaacgtttacgtaattctattcatcattattttgagcatccttggttcttatggacagcgcaagctgagcgtttagtcgatctgcgtgatgaagaaatggtgctgcgtgaagatgatgctttaggggaattaccagaagaattgcataccaatccctttctgatttacaccatcaaattg

SEQ ID NO: 3354 - protein, 393 aa, Haemophilus influenzae
  Name: NTH1870
VRSIQKKIFKIRKKSCIIFPIFCSILTLCNSMIETSQTIPELVSWAKDREFSLNLPTERLVFLLAIAIYNNERLDGEMLEADLVDIFRHTMNAFEQSTDAIATRANNAINELVKQRLLNRFSSEFTEGLAIYRLTPLGVGVSDYYIRQREFSALRLSVQLSIVADEIQRASDSAEEGVENNESEHYWRRNVFAPLKYSVAEIFDSIDLSQRIMDENQQSIKDEIAELLTKDWQAAISSCERLLDETSGNLRELQDTLNAAGDKLQAQLLRIQDCVIGRDDLYFIDQLITDLQSKLDRIISWGQQAIDLWIGYDRHVHKFIRTAIDMDKNRVFSQRLRNSIHHYFEHPWFLWTAQAERLVDLRDEEMVLREDDALGELPEELHTNPFLIYTIKL

SEQ ID NO: 3355 - DNA, 1029 bp, Haemophilus influenzae
  Name: NTH1871
atgatcgatttagacggaaccgaaaacaaatctaactttggtgcaaatgcaatcttggcggtatctttagcaaacgcaaaagcagctgcagcatctaaaggtttaccactttacgcttacattgcagaattaaatggcactgctggtgtttattctatgccattaccaatgatgaacatcattaacggtggcgaacatgcagataacaacgttgatatccaagaattcatgattcaaccagttggtgcgaaaacattacgtgaagcacttcgtatcggtgctgaagtattccacaaccttgcaaaagtattaaaatctaaaggcatgagcactgcagttggtgacgaaggtggtttcgcaccaaacttagcctctaacgcagacgctttagcctgtatcaaagaagcagtagaaaaagcaggttatgtattaggtaaagacgttactttagcgatggactgcgcatcttctgagttctataacaaagaaaatggtatgtacgaaatgaaaggtgaaggtaaatcattcacttctcaagagttcacacactatcttgaagaattaactaaacaatacccaatcgtgtctatcgaagatggtcaagatgaatctgactgggaaggttttgcataccaaactaaagtgttaggcgaccgtgttcaattagtgggcgatgatttattcgtaactaacaccaaaatcttaaaagaaggtatcgaaaaaggtatcgcaaactctatcttaatcaaattcaatcaaatcggttctttaactgaaactttagcagcaattaaaatggcgaaagatgcaggttacaccgctgtaatctctcaccgttcaggcgaaactgaagatgcaactatcgctgatttagcggtgggtacagcagcaggtcaaatcaaaactggttctatgagccgttctgaccgtattgcgaaatacaaccaattaatccgtatcgaagaagcattagaacgcgctggtactccagcagcattcccaggcttaaaagcggttaaaggtcaagcg

SEQ ID NO: 3356 - protein, 343 aa, Haemophilus influenzae
  Name: NTH1871
MIDLDGTENKSNFGANAILAVSLANAKAAAASKGLPLYAYIAELNGTAGVYSMPLPMMNIINGGEHADNNVDIQEFMIQPVGAKTLREALRIGAEVFHNLAKVLKSKGMSTAVGDEGGFAPNLASNADALACIKEAVEKAGYVLGKDVTLAMDCASSEFYNKENGMYEMKGEGKSFTSQEFTHYLEELTKQYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 3357 - DNA, 465 bp, Haemophilus influenzae
  Name: NTH1872
ttgtataaaagtgcggtgtttttatatctaatatttaaaggaaagagaatgttacatttaactttagaggacgaactctttttaggaacgccaaagcaagtgggaacacattcgacagtatttgagcattttgccgtaatgtttgaagatgacggcgaaactggctatttttatgcgctcgatatgcgtcaaaatgctcaaccgatagtggatatgttgcacgtgtataatgttgattcaacctctaatcatcatgaagcacgcaaacttgaaatttgttgggatgagagtggttatttagccttgttgcttattaatggctatcctcatgctgtatttgattttgcccgtttagtcggctataacagcaataaatatccacaaccagatttaatgagtatgtggactcgtgaagaaattactaataaacaggctgagcaatggctaggcgtgaaaaccattcga

SEQ ID NO: 3358 - protein, 155 aa, Haemophilus influenzae
  Name: NTH1872
LYKSAVFLYLIFKGKRMLHLTLEDELFLGTPKQVGTHSTVFEHFAVMFEDDGETGYFYALDMRQNAQPIVDMLHVYNVDSTSNHHEARKLEICWDESGYLALLLINGYPHAVFDFARLVGYNSNKYPQPDLMSMWTREEITNKQAEQWLGVKTIR

SEQ ID NO: 3359 - DNA, 588 bp, Haemophilus influenzae
  Name: NTH1873
ttgagaacaatgaaaaagaaaaatcagattttagttagtttatctattgtggccttattaggaggctgttcagaagagcaagtacaacgtgatgtgtatcagtctttagacgattgtttagcggattggaaaaaaattgagctttgtgaggcagataaaaatactgaaagtactcagaaaactgaaactacaccacagcaggggcttggtttaaatattcgtgataatggtaatgcagaaagtgcggtaaaaaatccagctgaaaataatgtacaagctaatcaaagcgagaacaatgctgaatcaactgcaaaagctgaaagtaccgatccttctttaggagccgcaattgctggtggcgttatagggtatatggcggctcgtgcaattagtagtttccttggcccaagctatcatcctggaaatcgagctgtcaccacaccaacagggcaagttgtgcaacctcaaacgaatcgttctgttggaaaaccaatgctcgtgaaaggaaatgcaggaagcatgaatagcaaacctgtatctcgtggtggttttagtagcccaaataatactcatcgtagcagtgggggc

SEQ ID NO: 3360 - protein, 196 aa, Haemophilus influenzae
  Name: NTH1873
LRTMKKKNQILVSLSIVALLGGCSEEQVQRDVYQSLDDCLADWKKIELCEADKNTESTQKTETTPQQGLGLNIRDNGNAESAVKNPAENNVQANQSENNAESTAKAESTDPSLGAAIAGGVIGYMAARAISSFLGPSYHPGNRAVTTPTGQVVQPQTNRSVGKPMLVKGNAGSMNSKPVSRGGFSSPNNTHRSSGG

SEQ ID NO: 3361 - DNA, 1179 bp, Haemophilus influenzae
  Name: NTH1874
atgaaacgtgtaactgggtttcctactcgaccaaatatggtgcaacagctacttaatgttggatttgattattataacttgccttccagtgatggatctcattattggtctgataatgttgcctatgaatttaccttagcggaaattgatcgcattgaggatacaactaatgaattgcattcaatatgtttagattttgcggcggatgaaattaaaaaaggcgattatgaaaattatcattttacggagttgcaaaaacagcttgttgaaacctcttggcgtaatcaagatccttatttatatggacgctttgattttggctatgatggcaacaacctaaaaatgtttgaatataacgccgatacaccaacatctttgttggaggcagcgattgtccaatggcagtggttggagcaaattgagggcttgaaacatcgtgatcaatttaactggattcatgaagaattaataaaacatttccaatttttgaaacaacaaagtggcaaaacagatttccatttgagtgccatgcaggatgctggccgtgaagattggggcaatgtggattatttagctgatgtggcttataacgcaggttggaatattcatcaattagcggtggaagatattggctataacagcgaaacaaaaaaatttgtagatttaaatgatcaacctattgaaatgttatttaaattgtatccgctagaatggctaagccacgctgagtttgctcgccatattacaacggctgaaacacgatttattgaaccagcgtggaaaatgttgttaagtaataaagcactattggcaaaactttgggcgcgttatcctaatcatccgaatttattgcctgcttattttacgccttttgaattaccaaaagatttattgatgtgggtgaaaaaaccattgttaggtcgagaaggtgccaatgttttctattatgagaaaaataatggtgtagaatttgcagcgaaaggaagcgaacactcaacgttttatgctaattcaggttatgtttatcaacaaaaatttgaattgccaagttttgatggaatgtatccaattatcggctcttgggttgtgggggatgtggcttgcggtatgggattacgcgaagattttactgcagtgacggggaatgatagccattttatacctcattattttgtgcca

SEQ ID NO: 3362 - protein, 393 aa, Haemophilus influenzae
  Name: NTH1874
MKRVTGFPTRPNMVQQLLNVGFDYYNLPSSDGSHYWSDNVAYEFTLAEIDRIEDTTNELHSICLDFAADEIKKGDYENYHFTELQKQLVETSWRNQDPYLYGRFDFGYDGNNLKMFEYNADTPTSLLEAAIVQWQWLEQIEGLKHRDQFNWIHEELIKHFQFLKQQSGKTDFHLSAMQDAGREDWGNVDYLADVAYNAGWNIHQLAVEDIGYNSETKKFVDLNDQPIEMLFKLYPLEWLSHAEFARHITTAETRFIEPAWKMLLSNKALLAKLWARYPNHPNLLPAYFTPFELPKDLLMWVKKPLLGREGANVFYYEKNNGVEFAAKGSEHSTFYANSGYVYQQKFELPSFDGMYPIIGSWVVGDVACGMGLREDFTAVTGNDSHFIPHYFVP

SEQ ID NO: 3363 - DNA, 1524 bp, Haemophilus influenzae
  Name: NTH1875
atgagttctcaatgtcctttctcgcacttagctgcaacaaacttaacaatgggtaacggtgcacccgttgctgataaccaaaacagcttaacagctggtccgcgtggtccattacttgcacaagatttatggcttaatgaaaaattagctgatttcgtacgtgaagtgatcccagagcgtcgtatgcacgctaaaggttctggtgcatttggtacttttactgtcacacacgatattactaaatatactcgtgcaaaaatttttagtgaagtgggtaaaaaaacggaaatgttcgcacgttttactaccgtggcaggcgaacgtggtgcagcagatgctgagcgtgatattcgtggttttgcattaaaattctatactgaagaaggtaactgggatttagtaggtaacaatacgccagtattcttcttacgtgatccacgtaaattcccagatttaaataaagcagtaaaacgtgatcctcgcactaatatgcgttcagcaactaataactgggatttctggacattattaccagaagcattacaccaagtcactgttgtaatgagtgatcgtggtattccagcaagttatcgtcatatgcacggtttcggttctcacacttatagtttctggaacgaagcgggcgaacgtttttgggtaaaattccacttccatacacaacaaggcatcaaaaacttaactgatgcagaagcggctgcagtcatcgcaagtgatcgtgaaagccatcaacgtgatttatatgaagcgattgaacgtggtgatttccctaaatggacattatttgtacaaattatgccagaagcagatgcggaaaaagtgccttaccacccgttcgacctaaccaaagtgtggccgaaaaaagattatccgttaattgaagtcggcgagtttgaattaaaccgtaacccagaaaacttcttcgctgatgtagaacaatctgcatttgcaccaagtaacttggttccgggtattggcgcaagccctgacagaatgttacaagctcgtttatttaactatgcggatgcacaacgttaccgtttaggtgtgaactaccgtcaaattccagtaaaccgtccacgttgccctgttcatagcaaccaacgtgatggtcaaggtcgtgtagatggtaactacggtagcttgccacactacgagccaaacagcttcagccaatggcaacaacaaccagactttgctgaaccaccacttcgtatcaacggagatgcagcacactgggattatcgtaacgatgataacgattacttcagccaacctcgtgcattatttaacttaatgaatgcagatcaaaaacaatcattattcaacaacacggcagcagcaatgggcgatgcgcctgatttcatcaaatatcgtcatattcgtaactgccactggtgtgatgccgcatacggtgaaggcgttgcgaaagcattaggtttaaccgttgaagatgcattaaaagctcgtgatactgatcctgcattaggtcaaggtggattgtta

SEQ ID NO: 3364 - protein, 508 aa, Haemophilus influenzae
  Name: NTH1875
MSSQCPFSHLAATNLTMGNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDLVGNNTPVFFLRDPRKFPDLNKAVKRDPRTNMRSATNNWDFWTLLPEALHQVTVVMSDRGIPASYRHMHGFGSHTYSFWNEAGERFWVKFHFHTQQGIKNLTDAEAAAVIASDRESHQRDLYEAIERGDFPKWTLFVQIMPEADAEKVPYHPFDLTKVWPKKDYPLIEVGEFELNRNPENFFADVEQSAFAPSNLVPGIGASPDRMLQARLFNYADAQRYRLGVNYRQIPVNRPRCPVHSNQRDGQGRVDGNYGSLPHYEPNSFSQWQQQPDFAEPPLRINGDAAHWDYRNDDNDYFSQPRALFNLMNADQKQSLFNNTAAAMGDAPDFIKYRHIRNCHWCDAAYGEGVAKALGLTVEDALKARDTDPALGQGGLL

SEQ ID NO: 3365 - DNA, 150 bp, Haemophilus influenzae
  Name: NTH1876
gtgatcgctcacctcgttgaatgggaaatgcgtagcacggattcccttttagaggctgtgcagaaatcggtaaaacaactcacgggcgcatatggtatggtggtaatggacagccgtcatcctgaacatttagtggcagctcgttctggg

SEQ ID NO: 3366 - protein, 50 aa, Haemophilus influenzae
  Name: NTH1876
VIAHLVEWEMRSTDSLLEAVQKSVKQLTGAYGMVVMDSRHPEHLVAARSG

SEQ ID NO: 3367 - DNA, 696 bp, Haemophilus influenzae
  n 687, 688, 689, 690, 691: n is any nucleotide
  Name: NTH1877
atgaaaatactacacgtttgttcggaactctatccgctcttaaaaacaggcgggcttgccgatgttttaggggcattaccccaagcacagaaccaaattgggctagatgctcgcgttttattgcctgcttatcccgcaattatagcaggcattcagaatactcaagtggttgccgaatttgacaacttcgctgggcacgtggtgttgcgttatggagaatataatggtgtcgggatctatttgattgacgcaccgcacttatacggtcgcgaaggcaatccttatcacgatgcctattacaacgactacggcgacaactacaaacgttttgctttgctcggttgggtgggggcagaattagccacaggtttagatagctggtggcgtgcagaagtggtacacgctcatgattggcacgcaggtttgtgtgcagcatatctgttcaacaaaggtcgccctgcgaaatcggtgttcaccattcacaacttggcatatcaagggcagttttcttatcatcatttgtatgaaatcggcttgccgacagggatgttccacgtagaaggcttggaattatttgggcagatttcttacttgaaatcaggtttgttctattctgatgcaagcacggcagttagcccaactatgcagaagaatccacggggtaccgagtccgatattcggtaccannnnnttaat

SEQ ID NO: 3368 - protein, 232 aa, Haemophilus influenzae
  Xaa 229, 230, 231: Xaa is any amino acid
  Name: NTH1877
MKILHVCSELYPLLKTGGLADVLGALPQAQNQIGLDARVLLPAYPAIIAGIQNTQVVAEFDNFAGHVVLRYGEYNGVGIYLIDAPHLYGREGNPYHDAYYNDYGDNYKRFALLGWVGAELATGLDSWWRAEVVHAHDWHAGLCAAYLFNKGRPAKSVFTIHNLAYQGQFSYHHLYEIGLPTGMFHVEGLELFGQISYLKSGLFYSDASTAVSPTMQKNPRGTESDIRYXXXN

SEQ ID NO: 3369 - DNA, 522 bp, Haemophilus influenzae
  Name: NTH1879
atgggacgcaacaccgagggcgaaatttactggcgtgatgtagggacacttgatagcttctggcaatctaatatcgacttagtctctgaaaatccacaattagatatttacgaccaaagctggccaattcgtggtaatccggttcaggcttatccgtctaaattcttctataaacactctaacgtgcacccagtagataactcattgattggcgggggctgtgtgattaccgatgcatcgatcagcaattccgtgctttttgatcgcattaaaattgattccttttcaaaagtcgatcactgcgtggtgttaccacaagttaaaatcggtaaaaattgcgtgttgaaaaattgtattatcgaccgcgaatgcgaaattcctgatggtatgcaaattggtgtggatatggaagaagataaaaatcgcttccgtattagctcaacaggcaaagtcattcttgtaaccccgaaaatgctaaagatacttgagggacacgagattggcgaagaaggtcatttagat

SEQ ID NO: 3370 - protein, 174 aa, Haemophilus influenzae
  Name: NTH1879
MGRNTEGEIYWRDVGTLDSFWQSNIDLVSENPQLDIYDQSWPIRGNPVQAYPSKFFYKHSNVHPVDNSLIGGGCVITDASISNSVLFDRIKIDSFSKVDHCVVLPQVKIGKNCVLKNCIIDRECEIPDGMQIGVDMEEDKNRFRISSTGKVILVTPKMLKILEGHEIGEEGHLD

SEQ ID NO: 3371 - DNA, 849 bp, Haemophilus influenzae
  Name: NTH1880
atgacgaataacaataagactatggagatccttatgaaatctggcgaccttaacaaatatgatttagttaaaaacactttggtgcttgtacttgcaggtggacgtggttcacgtttacacgaattgacagataaacgtgcaaaaccagcgctttattttggtggtaatcgtcgcattattgatttcgcactttctaattgtattaactcaggtttaaaccgaattggggtcgtgactcaatatgcggcacactccttgcttcgtcatttgcaaacaggatggtcttttttaccacaagagagaggggaatttgtcgatatgttgccagctcgtcagcaaattgacgattctacttggtatcgtggcacggcggatgcggtatatcaaaatatggctattattaaaaatcactatcgcccgaaatatattttgatcttagcgggcgaccatatttacaaacaagattacagcgtgatgttaatggatcacgtcaatagtggggcaaaatgtactattggttgcattgaagtgccccgttctgaagcacacgaatttggcgtaatggctgtaaacgaaaacttgaaagtaaaagctttcgtggaaaaaccaaaagatccgccagcaatggtgggtaaacctgatgtttcgcttacttcaatggggatttatgtgtttgatgcggattatctttacaaaatgttagatcgtgaagttggcaccccgaacaccagccacgatttcggtaaagatgtattgccaaaatgtttagaagaggcgcgctttatgctcacccatttagccgttcttgcatgggacgcaacaccgagggcgaaatttactggcgtgatg

SEQ ID NO: 3372 - protein, 283 aa, Haemophilus influenzae
  Name: NTH1880
MTNNNKTMEILMKSGDLNKYDLVKNTLVLVLAGGRGSRLHELTDKRAKPALYFGGNRRIIDFALSNCINSGLNRIGVVTQYAAHSLLRHLQTGWSFLPQERGEFVDMLPARQQIDDSTWYRGTADAVYQNMAIIKNHYRPKYILILAGDHIYKQDYSVMLMDHVNSGAKCTIGCIEVPRSEAHEFGVMAVNENLKVKAFVEKPKDPPAMVGKPDVSLTSMGIYVFDADYLYKMLDREVGTPNTSHDFGKDVLPKCLEEARFMLTHLAVLAWDATPRAKFTGVM

SEQ ID NO: 3373 - DNA, 1305 bp, Haemophilus influenzae
  Name: NTH1881
atgtttgcggtggaacctaaatatgcggcaacaaataatccattagctgaatttaaagcgatggtaaaggcgtttcacaatgagggtattgaagttatcttagatgtggtgtttaaccattctgcagaatcagagcaaacttacccaacattctgccagcgtggtattgatgatcaaacttactattggcgcaacgatcaagggcgttatatcaattggacaggctgcggcaatatgctcaatttatcctctgatgtagggcgaaagtgggtggtggattgcctgcgttattgggtggagcaatgccacattgatggtttccgttttgatttagcctccgtgcttggtcgtgatacaccagattttaattcgtcagctcagctttttactgacataaaaaatgagccaagtttacaaaatattaaattgattgccgagccttgggatattggacattacggttatcaagtcggcaatttcccaagttattttgccgaatggaacgaccgattccgtgatgatctctgccgtttctggctatggaaaagtggcgaaatcggtgcatttgcagaacgttttgcaggctctatcgatttatttaagaaaaatgaccgcttgccacatactacacttaattttattaccgctcacgatggttttacgcttaaagatttagtgagttacaaccaaaaacataatgaagcgaacggcgaagaaaatcacgacggcagaaacgaaaattacagttacaaccacggagtagaaggttctacagaatccctttctgaaccgcaaaaaagtgcggtggaaaataaccgcacttttgcacaaagtggattattaatgagtttattgctggcgaatggcgcacctatgcttttggcgggcgatgagttcggcaacactcaatatggtaacaataatgcttattgccaagataacgagattacttggctgaaatgggcaaattttaacgaagaattatttgaactgaccaagcaaacgatcgcactccgcaaaagaatgggcagtttaaaccaagatcaatggtggtcggatgagaatgtgcaatggcttaacattgcaggcgaaccgatgacagttgaagattggcaaaatcaacaaaccaaagcattacaggtggttttagacaatcgttggcttttgttgattaatgccaaagccgaaggtcaggtgtttcacttgcctaatgggaaatggaagccccaaatcggcacacataatgtaacccttgaagaacaagccgaacttagttcaatgggcttttgtatgctgaatgacgaa

SEQ ID NO: 3374 - protein, 435 aa, Haemophilus influenzae
  Name: NTH1881
MFAVEPKYAATNNPLAEFKAMVKAFHNEGIEVILDVVFNHSAESEQTYPTFCQRGIDDQTYYWRNDQGRYINWTGCGNMLNLSSDVGRKWVVDCLRYWVEQCHIDGFRFDLASVLGRDTPDFNSSAQLFTDIKNEPSLQNIKLIAEPWDIGHYGYQVGNFPSYFAEWNDRFRDDLCRFWLWKSGEIGAFAERFAGSIDLFKKNDRLPHTTLNFITAHDGFTLKDLVSYNQKHNEANGEENHDGRNENYSYNHGVEGSTESLSEPQKSAVENNRTFAQSGLLMSLLLANGAPMLLAGDEFGNTQYGNNNAYCQDNEITWLKWANFNEELFELTKQTIALRKRMGSLNQDQWWSDENVQWLNIAGEPMTVEDWQNQQTKALQVVLDNRWLLLINAKAEGQVFHLPNGKWKPQIGTHNVTLEEQAELSSMGFCMLNDE

SEQ ID NO: 3375 - DNA, 687 bp, Haemophilus influenzae
  Name: NTH1882
atgttcaaaatctacaacaacggcaatcctattccaatgggatactcacaagcggtcgaaaacaacgtgcaaattaccaatttcgccctgttttccgctgcggcaataggcgtagaactttgcctttttgacgaacaaaatcaagaaacacgcttgccgatggtgcgtactgaaaatgtgtggcatttggcggtaactggcgtgaaaactggtacggaatatggatttcgtattcacggcgaatttgccaacccgaataaattaatgctcgatccctatgcgaaagccgtaaatggtaaacctgatttaagtagcgaagaaagttgttcttggttcttgctttcggataatcgcgacaacgcgcatcttgccccaagagcggttgtgatttcggaagattttaattgggaaaatgatactttacccaatacgccttgggctgaaaccattgtgtatgaattacacgttaaagggtttagccagtttaacgagaaaatccctgcggcgttgcgtggtacttatactggattagcacatcctgtgaatttggcgtatttgaaagaattaggcgtaactgtggtggagttgctgcctgtaaatttccatataaatgaaccgcacttacaggcacgaggcttacaaaattattggggatacaatccccttagcgatgtttgcggtggaacc

SEQ ID NO: 3376 - protein, 229 aa, Haemophilus influenzae
  Name: NTH1882
MFKIYNNGNPIPMGYSQAVENNVQITNFALFSAAAIGVELCLFDEQNQETRLPMVRTENVWHLAVTGVKTGTEYGFRIHGEFANPNKLMLDPYAKAVNGKPDLSSEESCSWFLLSDNRDNAHLAPRAVVISEDFNWENDTLPNTPWAETIVYELHVKGFSQFNEKIPAALRGTYTGLAHPVNLAYLKELGVTVVELLPVNFHINEPHLQARGLQNYWGYNPLSDVCGGT

SEQ ID NO: 3377 - DNA, 2055 bp, Haemophilus influenzae
  Name: NTH1883
atggtggtgattgagcgtgaaagtggtaaagaaataacggaactggattgtgtcgatgagcgtggattttttgttggtgttattccaaattgtcgtcaattttttgcttatcaattacaggttttttggggtaatgaagcacaaattatcgaagatccttatcgttttcatccaatgattgacgatttagaacaatggctactttctgaaggatctatgcttcgcccatatgaagtgcttggtgcacattttatggaatgtgatggtgtgagcggggtgaatttccgcttgtgggcacctaatgcaagacgagtttctattgtaggcgatttcaactattgggatggtcgccgccacccgatgcgtttccacccgaaaagcggtgtgtgggaattattcctgccgaaagccagccttggtcagctctataaatttgaattgattgattgctatggcaatcttcgtttgaaagcggatccttatgcctttagttcgcaacttcgccctgatacagcttcacaaattagtgcattaccaaatgtggtggaaatgacggaacaacgtcgtcaagcaaatcaagcaaatcaaccgatttctatttatgaagtgcatttaggatcttggcgtcgtaatttagaaaacaatttttggctagattacgatcaaattgctgatgaattaattccttatgtaaaagagatgggctttacccatatagaatttttaccgctttctgaatttccgtttgatggttcttggggctatcaaccacttgggctttattcgccaaccagtcgttttggctcacctgaggcatttcgccgtttagtaaaacgtgctcacgaagcaggcatcaacgtgattttagattgggtgccagggcatttcccaagtgatacccatggtttagtcgcatttgatggcacagccttgtatgaacatgaagaccctcgcgaaggctatcatcaagattggaataccttgatttataactatggacgcaacgaagtgaaaaatttcctgtccagcaatgccctttactggcttgaacgctttggcgtagatggtattcgcatggatgctgtggcttcaatgatctaccgcgattacagccgtgcggagggcgagtggattccaaaccaatacggcggacgtgaaaatttagaagccattgagtttttaaaacacaccaactggaaaattcacagcgaaatggcgggagcaatttctattgcggaggaatctacctcttttgcaggcgtaacccacccaagcgaagacggcggcttgggcttcaatttcaaatggaatatgggctggatgaacgatacactggcttatatgaagcttgaccccatttaccgccaatatcatcacaacaaaatgacctttggaatggtatatcaatacagcgaaaattttgttctaccactttctcacgatgaagtggttcacggtaaatattcacttcttggcaagatgccaggcgatacgtggcaaaaattcgctaacttgcgtgcatattacggttatatgtggggctacccaggcaaaaaattgctctttatggggaatgaatttgcccaaggtcgtgagtggaattatgaagaaagtttggactggttcttgcttgatgaaaatattggcggaggttggcacaaaggcgtattgaagctggttaaagacctcaatcaaatttatcaaaaaaatcgaccgctctttgagctcgacaactccccagagggtttcgattggcttgtcgttgatgatgcggcaaattctgtgttcgcctttgaacgtcgcagttcaaacggagaacgtattattgtcgtcagtaactttacccctgtgcctcgccacaattaccgcatcggcgtgaatgttgcaggaaaatacgaagaaattttaaataccgattcgatgtattacgaaggttcaaacgtgggcaattttggttgtgtcgcaagtgaaaaaatcgaaagccacggacgagaaaattcgatttcagtgtccattccgccgttagcaacagtttatttgagattgaaggcgaaa

SEQ ID NO: 3378 - protein, 685 aa, Haemophilus influenzae
  Name: NTH1883
MVVIERESGKEITELDCVDERGFFVGVIPNCRQFFAYQLQVFWGNEAQIIEDPYRFHPMIDDLEQWLLSEGSMLRPYEVLGAHFMECDGVSGVNFRLWAPNARRVSIVGDFNYWDGRRHPMRFHPKSGVWELFLPKASLGQLYKFELIDCYGNLRLKADPYAFSSQLRPDTASQISALPNVVEMTEQRRQANQANQPISIYEVHLGSWRRNLENNFWLDYDQIADELIPYVKEMGFTHIEFLPLSEFPFDGSWGYQPLGLYSPTSRFGSPEAFRRLVKRAHEAGINVILDWVPGHFPSDTHGLVAFDGTALYEHEDPREGYHQDWNTLIYNYGRNEVKNFLSSNALYWLERFGVDGIRMDAVASMIYRDYSRAEGEWIPNQYGGRENLEAIEFLKHTNWKIHSEMAGAISIAEESTSFAGVTHPSEDGGLGFNFKWNMGWMNDTLAYMKLDPIYRQYHHNKMTFGMVYQYSENFVLPLSHDEVVHGKYSLLGKMPGDTWQKFANLRAYYGYMWGYPGKKLLFMGNEFAQGREWNYEESLDWFLLDENIGGGWHKGVLKLVKDLNQIYQKNRPLFELDNSPEGFDWLVVDDAANSVFAFERRSSNGERIIVVSNFTPVPRHNYRIGVNVAGKYEEILNTDSMYYEGSNVGNFGCVASEKIESHGRENSISVSIPPLATVYLRLKAK

SEQ ID NO: 3379 - DNA, 357 bp, Haemophilus influenzae
  Name: NTH1884
ttggtgttagtttttttattagctaaattttattggagctctggtctaatgcagaaccaaagaatccgtatccgcttaaaagctttcgatcaccgtttgatcgatcaatctactgcggagatcgtagaaacagctaaacgtactggcgcacaagttcgtggtccaattcctttaccaactcgtaaagagcgtttcaccgtgttgatttctccacacgtaaacaaagacgcacgtgaccaatacgaaattcgtactcacaaacgtttagtagatatcgtagagccaacagaaaaaactgttgatgcattaatgcgtttagatttggctgccggcgtggacgtgcagatcagcctaggt

SEQ ID NO: 3380 - protein, 119 aa, Haemophilus influenzae
  Name: NTH1884
LVLVFLLAKFYWSSGLMQNQRIRIRLKAFDHRLIDQSTAEIVETAKRTGAQVRGPIPLPTRKERFTVLISPHVNKDARDQYEIRTHKRLVDIVEPTEKTVDALMRLDLAAGVDVQISLG

SEQ ID NO: 3381 - DNA, 945 bp, Haemophilus influenzae
  Name: NTH1885
gtgctatattttgtaaaaatggcagtccttaggggggtgaaaatgatggatattaggcatctaagatattttgtttcaatcgtagataatgattttaatttaagccgagcgtctcaaaatttatatgtgtctcaacctgcattaagtatgatgattacggagtttgagaatcgtgaaaatattcagatatttaaacgggcatcaggaaaaattattggactaacctttgcgggggaaaattattatcgtgatgcaaaagaagtgatcaagcgttacaatgatatgagaacaaatctttataaatcaaaagattgtaagaaaggcacgataacaattggtattcctcccttagttttatcagccgtgttctcttctgtattgcctcatcttattcttaagaatccagatattaattttattattaaagaaattggagcttatgctctaaagagtgaacttcttttagataaagttgatttagccgtgttgttatatcccgagcgaatatcaaaaaatattattgattcaattgaaattcatagttctgaattagccttatttctttcaccaaagcatgtcttagcaaaaaaacaacaaatcacatgggctgatttacatcagcagaaaatggcaatttttgatcaaacatttatgattcatcatcatttgaaggaagcttttgagcgcaataattgttatccagatattgttttggattcgagttgttgggattttctgctaagtgcggtcaaaacaaacaaagaattattaactattctaccgttacctatggctgagctttatcattcaaaagaatttttgtgtcgtaaaatcgaaagtcctgttccgtggaaagtgacactatgtcgtcaaagaaaaacggtttacacacaccttgaagaatatatttttgataaattattagaggcttttaggccaacaaaa

SEQ ID NO: 3382 - protein, 315 aa, Haemophilus influenzae
  Name: NTH1885
VLYFVKMAVLRGVKMMDIRHLRYFVSIVDNDFNLSRASQNLYVSQPALSMMITEFENRENIQIFKRASGKIIGLTFAGENYYRDAKEVIKRYNDMRTNLYKSKDCKKGTITIGIPPLVLSAVFSSVLPHLILKNPDINFIIKEIGAYALKSELLLDKVDLAVLLYPERISKNIIDSIEIHSSELALFLSPKHVLAKKQQITWADLHQQKMAIFDQTFMIHHHLKEAFERNNCYPDIVLDSSCWDFLLSAVKTNKELLTILPLPMAELYHSKEFLCRKIESPVPWKVTLCRQRKTVYTHLEEYIFDKLLEAFRPTK

SEQ ID NO: 3383 - DNA, 651 bp, Haemophilus influenzae
  Name: NTH1886
atgacacaaaaacatcttaagcttaataatctaaatcaacacctacatgatggtatgagcatcatgtttggtggatttatgggtatcggcactccagccaaacttgtccaacaaatcttagattctggcgtaaaggatctcacactcataggcaatgacacagcctttattgacactggcgtagggcctttaattgtaaataatcgagtcaaacgtttaattacatcccatattggtacaaatccagaaactggcaaaaaaatgattgctggtgaaatagatgtagaactcgttccacagggtaccttagctgaacggattcgtgcaggtggcgccggattaggtggtattttaacaccaacgggtgtcggcactgttgttgaagaaggaaaacaaaaaattcaaattgatggcaaagaatatttacttgaactcccactaaaagctgatattgccattatccatgctcaaaaaggtgacatgaatggcaatttagcttatgaattatctgctaggaactttaatccactagttgctttagcagccaaaactgtcattgcccaagttgataatctactagaggtcggtcagttacccccagatgaagtcatcacgccagccgcattaattgattacattgtttgttcagaa

SEQ ID NO: 3384 - protein, 217 aa, Haemophilus influenzae
  Name: NTH1886
MTQKHLKLNNLNQHLHDGMSIMFGGFMGIGTPAKLVQQILDSGVKDLTLIGNDTAFIDTGVGPLIVNNRVKRLITSHIGTNPETGKKMIAGEIDVELVPQGTLAERIRAGGAGLGGILTPTGVGTVVEEGKQKIQIDGKEYLLELPLKADIAIIHAQKGDMNGNLAYELSARNFNPLVALAAKTVIAQVDNLLEVGQLPPDEVITPAALIDYIVCSE

SEQ ID NO: 3385 - DNA, 699 bp, Haemophilus influenzae
  Name: NTH1887
ttgattacattgtttgttcagaataaggagaacgccatgaatgcaaaagaattaatcgctcgccgaattgcgatggaattacatgatggagatattgttaatctcggtattggtttaccaacacaggttgttaattatttacctgataatgtcaatattacacttcaatcagaaaatggctttcttggtttaactgcatttgacccagaaaatgctaattcaaacttagtaaatgctggtggtcagccttgtggaattaaaaaaggcggcgctacttttgatagtgctttttctttcgctttaattcgtggcggtcatgttgatgcctgtgtgctaggtggacttgaagttgatcaagaagcaaatctcgctaactggatggtgcctggcaaaatggtaccaggaatgggcggagcaatggacttagtgactggtgcaaaaaaagtgattattggcatggaacattgtgccaagtcaggttcctcaaaaattctaaagaaatgtacattaccgctcacagcaagtaaaaaagttgccatggtggttaccgaattggcagtatttaacttcattgaaggcagattagttctaaaagaacatgctcctcatgtggatttagaaacaattaaagccaaaacagaagccgatttcattgttgccgatgatttcaaagaaatgcaaatcagccagaaaggactt

SEQ ID NO: 3386 - protein, 233 aa, Haemophilus influenzae
  Name: NTH1887
LITLFVQNKENAMNAKELIARRIAMELHDGDIVNLGIGLPTQVVNYLPDNVNITLQSENGFLGLTAFDPENANSNLVNAGGQPCGIKKGGATFDSAFSFALIRGGHVDACVLGGLEVDQEANLANWMVPGKMVPGMGGAMDLVTGAKKVIIGMEHCAKSGSSKILKKCTLPLTASKKVAMVVTELAVFNFIEGRLVLKEHAPHVDLETIKAKTEADFIVADDFKEMQISQKGL

SEQ ID NO: 3387 - DNA, 1032 bp, Haemophilus influenzae
  Name: NTH1888
atgattagtcgcgtttctcgttttatgacgacattcgtcagtaaatacctgccagacccacttatttttgccgtgttacgcacctttgtcacattcatttgtgcttggggattaaccgatagtacacctgttgatttagttaatatgtggggtaatggcttttggaatttacttggttttggtatgcaaatggcattaattgtcgtaactggtaatgctcttgcaacctcaccacaaattcgtaagtttctttctacaatcgcttcaatagcaaaaacaccagcacaaggtgttgtcttagttacgtttatgggttcaattgcctgtatcattaactggggcttcggtttggtcgttggtgcgatgtttgcaaaagaagtcgcgcggagaataaaaggcagtgactacgccttactgattgcctgcgcctatattgcatttatgacatggggtggaggtttttcaggctcaatgccacttttagccgcaacaccaggcaacccagttgctcatttaatggtgagcgaaagcaacccacaaggtattattcctgcagttagtacgcttttctctgggtacaatatttttatcacgttaagtttagtcatttgcttgcctttcattacctatatgatgatgcccaaaaatggcgaagcaaaaagtattgatccaaaacttattgcgcccgatccaacatttgataaaaaattggataaagatgcaacacttgctgaaaaaatggaagaaagccgcttcttagcctatacaatcggggcattaggatatagttacctcggtatgtatttctacaaaaacggattcaatctcacaattaataatgtaaaccttattttcttaatcacaggaattgtgcttcatggctcgccaatggcctatatgcgagcaattattaatgccacaagaagcacagcagggatcttagtgcaattcccattctatgcgggtgtgcaactaatgatggagcattcaggcttaggtggtttaatcacagaatttctttatcaatgttgc

SEQ ID NO: 3388 - protein, 344 aa, Haemophilus influenzae
  Name: NTH1888
MISRVSRFMTTFVSKYLPDPLIFAVLRTFVTFICAWGLTDSTPVDLVNMWGNGFWNLLGFGMQMALIVVTGNALATSPQIRKFLSTIASIAKTPAQGVVLVTFMGSIACIINWGFGLVVGAMFAKEVARRIKGSDYALLIACAYIAFMTWGGGFSGSMPLLAATPGNPVAHLMVSESNPQGIIPAVSTLFSGYNIFITLSLVICLPFITYMMMPKNGEAKSIDPKLIAPDPTFDKKLDKDATLAEKMEESRFLAYTIGALGYSYLGMYFYKNGFNLTINNVNLIFLITGIVLHGSPMAYMRAIINATRSTAGILVQFPFYAGVQLMMEHSGLGGLITEFLYQCC

SEQ ID NO: 3389 - DNA, 252 bp, Haemophilus influenzae
  Name: NTH1889
gtgccttctggtggcggtcactgggtcatccaaggaccatttgttatccctgctgctcaagcattaggtacagatctgggtaagtctacaatggcaattgcctatggtgagcaatggatgaacatggctcagccattttgggcattaccagcactgggtatcgcagggcttggcgtgagagatattatgggcttctgtatgaccgcacttatcttcaccgcaccaatttttattattggtttatatttctta

SEQ ID NO: 3390 - protein, 84 aa, Haemophilus influenzae
  Name: NTH1889
VPSGGGHWVIQGPFVIPAAQALGTDLGKSTMAIAYGEQWMNMAQPFWALPALGIAGLGVRDIMGFCMTALIFTAPIFIIGLYFL

SEQ ID NO: 3391 - DNA, 1179 bp, Haemophilus influenzae
  Name: NTH1890
atggaaaatgttgttattgttagtgcagttagaacaccgatcggcagctttaatggtgcattatcttccgtaagtgcggttgatttaggcgcaattgtgatacaagaagccatcaaacgtgccaacattgaaagtgcattagttaatgaagtcatcatggggaacgtattacaagcaggactagggcaaaatccagcccgtcaagcagcattaaaagcaggaatagagaaagaaatcccttctttaacaatcaataaagtatgtggatctggtctaaaaagtgtcgcattaggtgcacagtctattatcagtggtgatgctgatattgttgttgtgggtggcatggaaaatatgagccaagcaccttatcttttagatagcaaagtacgacaaggcgtcaaaatgggtaatctcacattaagggacacaatgattgaagacggactaacttgtgctagcaatcactatcatatggggattactgccgaaaatattgcagaacaatatggtattagccgccaagcacaagatgaactcgcattacgttcacaaaccttagcatctcaagccgtgcaattaggtgtatttgataaggaaattatccctgttatggtaaaaactcgcaaaggtgacattattgtttcacgagacgagtatcctaaagcagatactacagctgaaggtttagctaaattaaaacctgctttcaaaaaagagggtactgtcaccgcaggtaacgcttctggcattaatgatggtgctgcagcacttattttagttagcgaaagcaaagctcatgcacttggattaaaagccattgcaaaaattagaagctatgccagcggtggggtagatccatctgttatgggattaggtccagttccagcaacgcaaaaagcattgaaaaaagcaggaataaatcttgatgatatcgatctgatagaagcaaatgaagcctttgcctcacagttcttaggtgttggcaaagatctcaatttggatatgaataaaaccaatattcatggtggagctatcgcacttgggcatccaatcggtgcgagtggtgcaaggattttagtaacgttattgcacaatcttatcgaaaaagataaaaaacttggacttgctacactttgtattggcggtggtcaaggtatttctatgattgtagaacgctta

SEQ ID NO: 3392 - protein, 393 aa, Haemophilus influenzae
  Name: NTH1890
MENVVIVSAVRTPIGSFNGALSSVSAVDLGAIVIQEAIKRANIESALVNEVIMGNVLQAGLGQNPARQAALKAGIEKEIPSLTINKVCGSGLKSVALGAQSIISGDADIVVVGGMENMSQAPYLLDSKVRQGVKMGNLTLRDTMIEDGLTCASNHYHMGITAENIAEQYGISRQAQDELALRSQTLASQAVQLGVFDKEIIPVMVKTRKGDIIVSRDEYPKADTTAEGLAKLKPAFKKEGTVTAGNASGINDGAAALILVSESKAHALGLKAIAKIRSYASGGVDPSVMGLGPVPATQKALKKAGINLDDIDLIEANEAFASQFLGVGKDLNLDMNKTNIHGGAIALGHPIGASGARILVTLLHNLIEKDKKLGLATLCIGGGQGISMIVERL

SEQ ID NO: 3393 - DNA, 930 bp, Haemophilus influenzae
  Name: NTH1891
atgagccgatcaacggatgcatctgtttttgttcaaacagcctatactttgcgtgcagtatgggcggatttatggcaacgtaaatttggcacgctgctcacgattttagtgattgccgtttcgcttacgatcccgactgtgagctatttaatgtggaaaaatttgcatttagccaccactcaattttatcctgacagtgaattgactatttatcttcataaaaatttaagtgaggaaaacgcgaatttagtggtagaaaaaatccgccagcaaaaaggcgtagaatcactgaattatgtttctcgtcaagaaagtttaaaggaatttaaaagctggtctggctttggcgaagaattggaaattttagatgataatccattgcctgcggtcgtgatagtaaaaccgacgagcgaatttaatgtgtcagaaaaacgtgatgagttacgtaccaatttaaataaaatcaaaggggtacaagaagttcgcttggataatgattggatggaaaaattaaccgcactttcttggttaaccgcccatgtggcaattttctgtacggtattaatgacgatagcggtatttttagttattggtaacagtattcgctctgatgtgtacagtagccgctcaagtattgatgtgatgaaattgcttggtgcaacagatcagtttatccttcgtccttatctttatacggggatgatttatgccgtgttaggtgggttagttgcagcaatttttagtagttttattatcagctattttacttctgcagtgaaatacgtaacggatatttttgccgtccaattcagtttgaatggattaggcgttggcgagtttgtattcttattagtgtgctgtttaattatgggctatgttggggcgtggattgccgcgacaaggcatattgcgatgatggagaggaaagaa

SEQ ID NO: 3394 - protein, 310 aa, Haemophilus influenzae
  Name: NTH1891
MSRSTDASVFVQTAYTLRAVWADLWQRKFGTLLTILVIAVSLTIPTVSYLMWKNLHLATTQFYPDSELTIYLHKNLSEENANLVVEKIRQQKGVESLNYVSRQESLKEFKSWSGFGEELEILDDNPLPAVVIVKPTSEFNVSEKRDELRTNLNKIKGVQEVRLDNDWMEKLTALSWLTAHVAIFCTVLMTIAVFLVIGNSIRSDVYSSRSSIDVMKLLGATDQFILRPYLYTGMIYAVLGGLVAAIFSSFIISYFTSAVKYVTDIFAVQFSLNGLGVGEFVFLLVCCLIMGYVGAWIAATRHIAMMERKE

SEQ ID NO: 3395 - DNA, 357 bp, Haemophilus influenzae
  Name: NTH1892
atgtggccattgccattgattattgcaggtatgcatccaaaagatgcgcatacacgtgcgatggcatctttagatcgtgtaggattgcgtaataaagcccactatttgccaccacaaatttctggcggtgagcagcaacgcgttgatatcgcgcgtgcgattgtgcataaacctcagctcttactagcagatgaaccaacgggtaatttagacgatgaactttctttaggcatttttaatttgtttgaagaatttaatcgtctaggaatgactgtgttaatcgctactcacgacattaatttaattcaacaaaaaccaaaaccttgtcttgtgcttgaacaaggttatttacgttat

SEQ ID NO: 3396 - protein, 119 aa, Haemophilus influenzae
  Name: NTH1892
MWPLPLIIAGMHPKDAHTRAMASLDRVGLRNKAHYLPPQISGGEQQRVDIARAIVHKPQLLLADEPTGNLDDELSLGIFNLFEEFNRLGMTVLIATHDINLIQQKPKPCLVLEQGYLRY

SEQ ID NO: 3397 - DNA, 387 bp, Haemophilus influenzae
  Name: NTH1893
gtgattaagttctcaaatgtttctaaagcctatcatggtgcaacgcagccagccttacaaggcttgaattttcatcttccagtgggaagtatgacttacttagttgggcattcaggcgcagggaaaagtacattactcaagcttattatggggatggaaaaagccaatgctggtcagatttggtttaacggacacgatattactcgcttgtcaaaatatgaaattccatttttgcgtcgccaaattggcatggttcaccaagattatcgtttattaacagatcgtacagtggcggaaaatgtggccattgccattgattattgcaggtatgcatccaaaagatgcgcatacacgtgcgatggcatctttagatcgtgtaggattgcg

SEQ ID NO: 3398 - protein, 129 aa, Haemophilus influenzae
  Name: NTH1893
VIKFSNVSKAYHGATQPALQGLNFHLPVGSMTYLVGHSGAGKSTLLKLIMGMEKANAGQIWFNGHDITRLSKYEIPFLRRQIGMVHQDYRLLTDRTVAENVAIAIDYCRYASKRCAYTCDGIFRSCRIA

SEQ ID NO: 3399 - DNA, 525 bp, Haemophilus influenzae
  Name: NTH1894
gtgatgctcgcagcaggtgatactttccgcgcagcggctgttgagcagcttcaagtttggggagaacgcaatcatattccagttgttgcgcaaagcacgggttctgattctgcgtctgtgatttttgatgcgatgcaatcagcggctgcacgcaatattgatattcttattgcggatacggcgggtcgtttacaaaataaaaataacttaatggacgaactgaaaaaaattgttcgtgttatgaaaaaatatgacgaaactgcaccacatgaaattatgcttacgctggatgctggcacgggacaaaatgctattagccaagcgaaattatttaatgaggctgtgggtttaacagggatctctctaactaaattagatggcacggcaaaaggtggcgtgatttttgccatagccgatcagtttaagttgcctattcgctatatcggtgtaggcgagaaaattgaagatttacgtgagtttaatgcgaaagaatttattgaggcattattcgttcatgaagaagaa

SEQ ID NO: 3400 - protein, 175 aa, Haemophilus influenzae
  Name: NTH1894
VMLAAGDTFRAAAVEQLQVWGERNHIPVVAQSTGSDSASVIFDAMQSAAARNIDILIADTAGRLQNKNNLMDELKKIVRVMKKYDETAPHEIMLTLDAGTGQNAISQAKLFNEAVGLTGISLTKLDGTAKGGVIFAIADQFKLPIRYIGVGEKIEDLREFNAKEFIEALFVHEEE

SEQ ID NO: 3401 - DNA, 729 bp, Haemophilus influenzae
  n 724, 725, 726, 727, 728: n is any nucleotide
  Name: NTH1895
atggcacttttagacatttgtaacctcaatattgaaattcaaacctccaatggacgtataaaaattgtagatggcgtcaatctttcccttaacgaaggggaaatcagtggattagttggcgaatcaggctcaggaaaaagcttaatcgctaaagtcatttgtaatgcaatcaaagaaaattggattattactgccgatcgctttcgttttcacgatatcgaattactaaaactcagtcctaataaacgacgtaagattgtcggcaaagaaatatccatgattttccaaaatcccttatcttgccttgatccaagtcgaaaaatagggaaacaactcatccaaaatattcctaattggacatttaaaaataaatggtggaaatggtttgggtggaaaaaaagacgtgctattgaattgttacatcgcgtaggaattaaagatcatcgtgatattatggcaagctatcctaacgaactgacagaaggcgaaggacaaaaaggtttgatcgcaatggctgtcgctaatccgcccacgtttatattcgcggatgacccaacaatacctttggaatcacccctgccgtcacaggttttggttactttccagtatgaaccaaatcagggaacaacaattttacttacgagtaacgatattaaaagtattagtgaatggggcgatcaaaatttcagtgcctttattggggggcaaataccggaatctgcannnnnt

SEQ ID NO: 3402 - protein, 243 aa, Haemophilus influenzae
  Xaa 242, 243: Xaa is any amino acid
  Name: NTH1895
MALLDICNLNIEIQTSNGRIKIVDGVNLSLNEGEISGLVGESGSGKSLIAKVICNAIKENWIITADRFRFHDIELLKLSPNKRRKIVGKEISMIFQNPLSCLDPSRKIGKQLIQNIPNWTFKNKWWKWFGWKKRRAIELLHRVGIKDHRDIMASYPNELTEGEGQKGLIAMAVANPPTFIFADDPTIPLESPLPSQVLVTFQYEPNQGTTILLTSNDIKSISEWGDQNFSAFIGGQIPESAXX

SEQ ID NO: 3403 - DNA, 315 bp, Haemophilus influenzae
  Name: NTH1896
atgctaaaacttgaaggcatttccaatcaaaccttattaaaaagcactattttaccgaatattactgttatttatattcaagaagtggctcatgcttttgttatagccgtgttggatattagcgcattaagttttatttctcttggtgcacaacgacctacaccagaatggggggcaatgataaaagactctttggaactactttatcttgcaccttggacagtacttttacccggtttcgctattatttttactattttattaagtattattttcagtaatggcttaactaaagccatcaatcaacatcaagaa

SEQ ID NO: 3404 - protein, 105 aa, Haemophilus influenzae
  Name: NTH1896
MLKLEGISNQTLLKSTILPNITVIYIQEVAHAFVIAVLDISALSFISLGAQRPTPEWGAMIKDSLELLYLAPWTVLLPGFAIIFTILLSIIFSNGLTKAINQHQE

SEQ ID NO: 3405 - DNA, 150 bp, Haemophilus influenzae
  Name: NTH1897
ttgccgttgttatttcaaccattaatggaaccaagtttatggaatgcaatgtttgctacgctattagcaattttgccttatttcatttcacactatctatcgcgctattcaaaaagaattagaaaaggattatgttgtaatgctaaaact

SEQ ID NO: 3406 - protein, 50 aa, Haemophilus influenzae
  Name: NTH1897
LPLLFQPLMEPSLWNAMFATLLAILPYFISHYLSRYSKRIRKGLCCNAKT

SEQ ID NO: 3407 - DNA, 552 bp, Haemophilus influenzae
  Name: NTH1898
atgcaagataaagaacctgatgaattccgcgaaagcacctcaatctttcaaatttggttacgctttcgtcaaaataccatcgcactttttagcttttatttattaatcgcattaatttttaccgcactttttgctagttatcttgcaccttatgctgataatcgacaatttattgggcaagaattaatgcctccttcttgggtagatagaggaaaaattgcttttttctttggtactgatgatataggtcgcgacatattaagtcgtttaattatgggtactcgttataccttaggttctgctttactggttgtcttttcagtggcaataataggcggcgcactaggaattattgcaggactactgaaaggtattaaagctcgttttgtcgggcatatttttgatgcttttttatcgttacctattctattaattgccgttgttatttcaaccattaatggaaccaagtttatggaatgcaatgtttgctacgctattagcaattttgccttatttcatttcacactatctatcgcgctattcaaaaagaat

SEQ ID NO: 3408 - protein, 184 aa, Haemophilus influenzae
  Name: NTH1898
MQDKEPDEFRESTSIFQIWLRFRQNTIALFSFYLLIALIFTALFASYLAPYADNRQFIGQELMPPSWVDRGKIAFFFGTDDIGRDILSRLIMGTRYTLGSALLVVFSVAIIGGALGIIAGLLKGIKARFVGHIFDAFLSLPILLIAVVISTINGTKFMECNVCYAISNFALFHFTLSIALFKKN

SEQ ID NO: 3409 - DNA, 963 bp, Haemophilus influenzae
  Name: NTH1899
atgttctggtcggttcttcgccatattctgtgggtggcattattattactcgtattatcgctattaggctttgttattttattgcgcgatcctcttaatgcgaatcttgttacacaaaacatttatatcggctatttccattatttaggcaccttgttacaaggtgattttggcattacctataacggtggaaaatcattaatgaaccttattcttacggttcttcctcccacattggaactttgtttcattacattgtttttggcatttatttttggtttgccacttggcattataagtgcggtcaattctgaacaagtttttgcaaaaagtttacaaatcctatcttatgtagggctatctattccaatattttggttagcccccattttactgtatgttgccgcgctctcacattgggaaattgccgctattggacaatataatttgctttacgaaattaaacccattacgggatttcctgttattgatatgtggtttatggaagtaccttatcgtacaaaaatcgtacaaaacatattgcaacatttagccttaccaacattggtattgtgtattttgccaacaatggaaattatccgtattattcatcaacgagcagaatatattttgaatcaaaatttttctaaagtagcgacaacacggggttggtcaaaatggaaaattctccatcaatatgtattccgtaatacttttcccctgcttgttccacaagtaccacgtgtattcacattagtattaacgcaatgtatgttggtagaaacggctttaggttggcctggcattggtcgttggttaattaatgccgtaaatgaacaagattacaacagcattgccgcaggtgtaattgttattggtgtatgtattattttgattgatacattcactaaaatattcacttttatactcgatccatttaaaaagaaaggttggtatgcaaga

SEQ ID NO: 3410 - protein, 321 aa, Haemophilus influenzae
  Name: NTH1899
MFWSVLRHILWVALLLLVLSLLGFVILLRDPLNANLVTQNIYIGYFHYLGTLLQGDFGITYNGGKSLMNLILTVLPPTLELCFITLFLAFIFGLPLGIISAVNSEQVFAKSLQILSYVGLSIPIFWLAPILLYVAALSHWEIAAIGQYNLLYEIKPITGFPVIDMWFMEVPYRTKIVQNILQHLALPTLVLCILPTMEIIRIIHQRAEYILNQNFSKVATTRGWSKWKILHQYVFRNTFPLLVPQVPRVFTLVLTQCMLVETALGWPGIGRWLINAVNEQDYNSIAAGVIVIGVCIILIDTFTKIFTFILDPFKKKGWYAR

SEQ ID NO: 3411 - DNA, 1692 bp, Haemophilus influenzae
  Name: NTH1900
atgttacgtctaaatctgagatttttatcttttctgctctgtataagccaaagtgtagaattacaggctgcgccaagtgttccaacatttttaactgaaaatggcttaacttattgcacccacgcttcaggtttttcatttaatccgcaaacagcagatgcaggaaccagtatgaatgtggtcacggaacaaatttataacaaattatttgatataaaaaatcacagtgcaacattaacaccaatgctggcacaatcttattccatttcagctgatggtaaagaaattttattaaatttacgtcacggcgtaaaatttcaccaaaccccttggtttaccccaacacgtgattttaacgctgaagacgtagtattttcgattaatcgtgtattagggcataatacttatttaccaaccttagcagaggcgaatgttacctatagtaatccacaatatagagtgtttcacgaacaagcaagaaaagtgcgttttccttattttgatagcattaaacttaacgaaaaaatcaaatctgtgaccgcactttcgccttatcaagtaaaaattgaattatttgcaccagattcctccattttgtcgcatcttgccagccagtatgccattattttttcacaagaatatgcctatcaattaagcgcagatgacaaccttgctcaattagatacccacccagtaggcacagggccttatcaagtaaaagattatgtatataaccaatatgttcgcttagtgcgtaacgaaaactattggaaaaaagaagccaagatagaacatattattgtggatctttctactgatcgcagcggacgtttagtcaaatttttcaataatgaatgtcaaatcgcctcttatcctgaagtaagccaaattggcttattaaaaaatgatgacaaacattattatatgcaatctactgatggtatgaatttagcctatttagcgtttaattttgataagccattaatgcgagatcacgaaatccgtgctgctatttcacaaagtttaaaccgagctcgaatcattcatagcatttaccataacacagcaactgttgctaataacattattcctgaagtgtcttgggcttcaactgtcaatacgccagaatttgagtttgattaccatcccaaaatcgccaaaaataaattagcagataaaaaccttttgttaaatttatgggtaattaatgaagaacaagtctataatccagcaccttttaaaatggctgaaatgatcaaatgggatttagctcaagcgggtgtgaaagttaaagtgcgtgccgtaactcgtccatttttaactgcacaattacgcaatcaatcggaaaattatgatttgattctatctggttggttagctggtaatcttgatcctgatggttttatgcgtccaattttaagctgtggaacaaaaaatgaactcactaatttatctaattggtgtaatgaagaatttgatcaatttatggatcgtgccattaccacctcacatttaagttcacgcgcaaaagcctataatgaagcccaagaactcgttctacgtgaattacccattattcctattgccaatgtaaaacgaattttagtcgcaaatagtcgtgtgaaaggagtaaaaatgacgccttttggtagcttagatttttccaccttttattttattcaggagaaacac

SEQ ID NO: 3412 - protein, 564 aa, Haemophilus influenzae
  Name: NTH1900
MLRLNLRFLSFLLCISQSVELQAAPSVPTFLTENGLTYCTHASGFSFNPQTADAGTSMNVVTEQIYNKLFDIKNHSATLTPMLAQSYSISADGKEILLNLRHGVKFHQTPWFTPTRDFNAEDVVFSINRVLGHNTYLPTLAEANVTYSNPQYRVFHEQARKVRFPYFDSIKLNEKIKSVTALSPYQVKIELFAPDSSILSHLASQYAIIFSQEYAYQLSADDNLAQLDTHPVGTGPYQVKDYVYNQYVRLVRNENYWKKEAKIEHIIVDLSTDRSGRLVKFFNNECQIASYPEVSQIGLLKNDDKHYYMQSTDGMNLAYLAFNFDKPLMRDHEIRAAISQSLNRARIIHSIYHNTATVANNIIPEVSWASTVNTPEFEFDYHPKIAKNKLADKNLLLNLWVINEEQVYNPAPFKMAEMIKWDLAQAGVKVKVRAVTRPFLTAQLRNQSENYDLILSGWLAGNLDPDGFMRPILSCGTKNELTNLSNWCNEEFDQFMDRAITTSHLSSRAKAYNEAQELVLRELPIIPIANVKRILVANSRVKGVKMTPFGSLDFSTFYFIQEKH

SEQ ID NO: 3413 - DNA, 1410 bp, Haemophilus influenzae
  Name: NTH1901
atgtttaatcgggttcaaaaggaaatcaatcaaattattaatcgtggttttgatcgcactttgcgtttagcggtaacagggttaagtcggagtggaaaaacggcgtttattacaagtttaatcaatcaacttctctccattaatcaacattcatcacagaatttgcccttgtttgaagcagcgagaaatggtgcgatcttggcagtcaaacgagtatcccaacaagatctcagcgtgccacgttttgattatgaaagtaatttaaatgatttgtcacaaaatccgcctcaatggattcaatctactcgtggcgtgagtgaaacgcgtttagccattcgttttcaacgccaatctggcttgctacgccatttgaaagaacgaggcacgctttatctagatatttttgattatccaggggaatggctgatcgatttgccgttattaaatctagattttcaacaatggtcacaagagcaaattaaggtaacaacaggcattcgtgaagaattggcggagaattggctcgctatgttgcaggatttggatttaagtgcggtcgcaaatgaagatgttttagccaagatagcgaaaagttatacggattatttacatcaatgcaaagtgcaaggcatgcaatttattcagcctgggcgatttgtattgccgagtgatttagagggcacgcccgcattacaatttttcccattaattcatctttcagaagaacagtggcgaaccttgaaaaaaacagcaaaatcaaatagctattttgctgtgctgacaaaacgttatgattattatcgcaataaaattgtgaaaggtttttacgaaaattatttttctacctttgatcgtcaagttattttggcggattgtttaacgcctttaaatcacagtcagcaagcctttttagatatgcaaatgggcttaaatcagttatttaataatttccattatggcagcagaaattttcttcatcgtttgttttctccgcgaattgatcgattaatgtttgttgcgacaaaggcggatcatattactcgtgatcaaattcctaatttagtaagtttaatgcgccaaattgtgcaagagggtggtcgccatgtggaatttgaaggaatcgatacggaatataccgccattgcggctgttcgtaccacaaagcaagtgattgtgaatcagcaaggaaaagaaattaaagcaattcaaggggttcgttctattgataaacagctgattacactttatccgggaacggtgccgagcaaattaccaagagcagaattttggcaaaaacaaccgcactttgattttgatagttttgaacctcagcctttagaacaaggggagagcattcctcatttgagaatggatgcggttttacaatttttattaagtgatcgatttgaa

SEQ ID NO: 3414 - protein, 470 aa, Haemophilus influenzae
  Name: NTH1901
MFNRVQKEINQIINRGFDRTLRLAVTGLSRSGKTAFITSLINQLLSINQHSSQNLPLFEAARNGAILAVKRVSQQDLSVPRFDYESNLNDLSQNPPQWIQSTRGVSETRLAIRFQRQSGLLRHLKERGTLYLDIFDYPGEWLIDLPLLNLDFQQWSQEQIKVTTGIREELAENWLAMLQDLDLSAVANEDVLAKIAKSYTDYLHQCKVQGMQFIQPGRFVLPSDLEGTPALQFFPLIHLSEEQWRTLKKTAKSNSYFAVLTKRYDYYRNKIVKGFYENYFSTFDRQVILADCLTPLNHSQQAFLDMQMGLNQLFNNFHYGSRNFLHRLFSPRIDRLMFVATKADHITRDQIPNLVSLMRQIVQEGGRHVEFEGIDTEYTAIAAVRTTKQVIVNQQGKEIKAIQGVRSIDKQLITLYPGTVPSKLPRAEFWQKQPHFDFDSFEPQPLEQGESIPHLRMDAVLQFLLSDRFE

SEQ ID NO: 3415 - DNA, 216 bp, Haemophilus influenzae
  Name: NTH1903
gtgctttcactttctcaccaaagtgaattgatgtctgatttaccttggattgcagattcaattgcattacgtaatatctacacggatccactcaatctactgcaagtggaattgcttcaccgtttccgtgaaaatccagagcaagtcaatcccgatgtggaacaagcattgatgattaccatcacaggtatcgcggctgggatgcgcaatacaggc

SEQ ID NO: 3416 - protein, 72 aa, Haemophilus influenzae
  Name: NTH1903
VLSLSHQSELMSDLPWIADSIALRNIYTDPLNLLQVELLHRFRENPEQVNPDVEQALMITITGIAAGMRNTG

SEQ ID NO: 3417 - DNA, 93 bp, Haemophilus influenzae
  Name: NTH1904
ttgaatttgcctcattgctaccttttgacaaattcaattcctttgtttacgccaaaggaacgttcaaaagtgcgcttattatcctataaaaat

SEQ ID NO: 3418 - protein, 31 aa, Haemophilus influenzae
  Name: NTH1904
LNLPHCYLLTNSIPLFTPKERSKVRLLSYKN

SEQ ID NO: 3419 - DNA, 1011 bp, Haemophilus influenzae
  Name: NTH1905
atgttgccaagtctaaatcgcattcctcaaattgaacaatatgtacttgattatcttgatgatcttcaacaccaacattttgagggggatattgcgacaaattattcggatagattaagtctggctacggataacagcgtttaccaacagcttccacaggcgattctttttccgaaaactattgctgatatagtgcgtataaccaaattggcaaatttatctgaatatcaatcaatcagctttacgcctcgcggtggaggcactggcactaatggtcaatccatcaataacaatataatagtggatctttctcgtcatatgactgccatcttagaactcaatgtaaaagaacgttgggttaaagtacaagcaggtgtcgtaaaagatcaacttaatcaatttttaaaaccacatggtttattctttgccccagagctatccaccagcaatcgagcgactttaggcggaatgattaacacagatgcctcggggcaaggttcattgcaatacggtaaaacctctaatcatgttttggcattacgtgccgtattaatgaacggtgaaattttagatacaagtgcggtcaattctgttgatgttttagaaaacattgatgcgcttgaattaagtgagagcagcaaaagactccatcaaacaatcgcgcaacactgtaaagaaaaaagagcggcaatcattaaagatttaccacaacttaaccgttttttaacgggatacgatctcaaaaatgtattcaatgaagatgaaagtgaatttaatctcacgagaattctcactggttctgaaggttctctcgcatttatttgcgaagccaaactcaatcttctgcctattccgcagtatcgcacgctcatcaatattaaatatcgttcttttgacgcggcattacgcaatgcaccttttatggtgaaagccaatgcgctttctgtggaaaccgttgattccaaagtcttaaacctcgccaaacaagaatattatttggcattctgtgaa

SEQ ID NO: 3420 - protein, 337 aa, Haemophilus influenzae
  Name: NTH1905
MLPSLNRIPQIEQYVLDYLDDLQHQHFEGDIATNYSDRLSLATDNSVYQQLPQAILFPKTIADIVRITKLANLSEYQSISFTPRGGGTGTNGQSINNNIIVDLSRHMTAILELNVKERWVKVQAGVVKDQLNQFLKPHGLFFAPELSTSNRATLGGMINTDASGQGSLQYGKTSNHVLALRAVLMNGEILDTSAVNSVDVLENIDALELSESSKRLHQTIAQHCKEKRAAIIKDLPQLNRFLTGYDLKNVFNEDESEFNLTRILTGSEGSLAFICEAKLNLLPIPQYRTLINIKYRSFDAALRNAPFMVKANALSVETVDSKVLNLAKQEYYLAFCE

SEQ ID NO: 3421 - DNA, 1872 bp, Haemophilus influenzae
  Name: NTH1906
atgcgaaaaaaagcagtgggcttacttggtaatgcaaaaggtgcagccaaaccgattcctttcgtggaagatacttgtgtccccccagaaaatcttgcggattacatcagtgaatttcgcgctttattagaccagcaccatttacaatatggcatgtttggtcacgtggatgctggtgtgttacacgttcgccctgcacttgatttatgcgataaagaacaagtgaaattatttaaacaaatttcagatgaagtggcagaacttacgattaaatatggtggattactctggggagaacatggaaaaggcgtgcgatcccattacggcgaaaaattctttaccccagaactctggtacgaacttcgttatatcaaaaccttgtttgatccgaacaatcgcttaaatcccggcaaaatctgtacacctttggattcccaagaggaactttattctattctttcgccaatgcgagctgataaggatcgccaaattcctatccaagtgcgtgatgaatttaagggtgcgatgaactgcaatggaaacggattatgtttcaattttgatgaacacagcattatgtgcccatcgatgaaagtcagtaaaaaccgtgtattttcgccgaaaggtcgcgcagcaatggttcgagaatggcttcgattgatggcgaatgaaaatgtttcgcccgcacaattagacttccgtaaaacagaaataaaactaaccgcacttgtgaaaagactaagcaatacggttaaaaaatggcgaggcgattatgatttttctcacgaagtaaaagtcgcaatggatacttgccttgcttgtaaagcctgtgcgagccaatgcccgattaaaatcgatgtaccaagtttccgtgcgaaattctttcatttctatcacagccgctacttacgccccgcaaaagatcacattgtggcaaatttagaaatcgctgcgccttatatggcaaaacaggcaaaattctttaattattttaccaagctaaaagtcacgcaaacattagtggaaaaaacgctaggcatgaccgatttgcccttgctttctgaacccaatttgcaacaacagctggtagaaattcattatcaaggcaaatccttggaagaattggaaggcctaagtgcggtagaaaaaaacgatattttatttattgtgcaagatccttatacctcttactatgatgcgaaagtggtacgagattttgttatgcttacgcagaaattaggcttcacaccaattctgttgccatttaaaccaaacggcaaagcaatgcacattaaaggtttcttaaaacgctttagcaaaacagcagaaaaccaagccgagtttttaaatcgaatggcaaaattaggcattcctcttgtgggcgttgatccagccatcgtgctgtcttatcgagatgaatacaaagaagcactacaagaaaaacgtggcgattttcacgttctcaccgcacacgaatggttaaaacaaagattacaaaatgcggatttacaagagaagttaaaaaacatcgccaaaactgaccgcactttcgattggtatttattccagcattgtacggaatctacctttatgccaaacagcccaaaagaatggcaagaaatttttggaagatttggacaacaacttaatgtagaaaaagtaggatgttgcggtatggctggtgtatttggacatgaagtgcaaaatcaaaaaatgagccgagaaatctacgatgtatcctggcacaaaaaactgcatgaaaaagatccgcacttttgtttagcaactggttattcttgccgcagtcaggtaaaacgttatgaacatgtggtgttaaaacaccctgtgcaggcattattagaaattttagcg

SEQ ID NO: 3422 - protein, 624 aa, Haemophilus influenzae
  Name: NTH1906
MRKKAVGLLGNAKGAAKPIPFVEDTCVPPENLADYISEFRALLDQHHLQYGMFGHVDAGVLHVRPALDLCDKEQVKLFKQISDEVAELTIKYGGLLWGEHGKGVRSHYGEKFFTPELWYELRYIKTLFDPNNRLNPGKICTPLDSQEELYSILSPMRADKDRQIPIQVRDEFKGAMNCNGNGLCFNFDEHSIMCPSMKVSKNRVFSPKGRAAMVREWLRLMANENVSPAQLDFRKTEIKLTALVKRLSNTVKKWRGDYDFSHEVKVAMDTCLACKACASQCPIKIDVPSFRAKFFHFYHSRYLRPAKDHIVANLEIAAPYMAKQAKFFNYFTKLKVTQTLVEKTLGMTDLPLLSEPNLQQQLVEIHYQGKSLEELEGLSAVEKNDILFIVQDPYTSYYDAKVVRDFVMLTQKLGFTPILLPFKPNGKAMHIKGFLKRFSKTAENQAEFLNRMAKLGIPLVGVDPAIVLSYRDEYKEALQEKRGDFHVLTAHEWLKQRLQNADLQEKLKNIAKTDRTFDWYLFQHCTESTFMPNSPKEWQEIFGRFGQQLNVEKVGCCGMAGVFGHEVQNQKMSREIYDVSWHKKLHEKDPHFCLATGYSCRSQVKRYEHVVLKHPVQALLEILA

SEQ ID NO: 3423 - DNA, 414 bp, Haemophilus influenzae
  Name: NTH1907
atgatttggcaaaaaaacttcacgctcgaaaacttaaatcaactttgctccaacagtgcagttagccatcttggcattgaaatttctgcttttggcgaggattggattgaagcgacaatgccggtggattatcgtactatgcagccgtttggtgtattgcatggaggggtttctgttgctttagctgaaacaattggttcccttgcgggttcgctttgtttagaagaaggcaaaactgcggtgggattggatattaacgccaatcatcttcgcccggttagttcaggtaaagtgaccgcgagagccacgccaattaatttgggcagaaatatccaagtttggcaaattgacatccgcacagaagagaataaactttgttgtgtttctagattaaccctttccgtaatcaattta

SEQ ID NO: 3424 - protein, 138 aa, Haemophilus influenzae
  Name: NTH1907
MIWQKNFTLENLNQLCSNSAVSHLGIEISAFGEDWIEATMPVDYRTMQPFGVLHGGVSVALAETIGSLAGSLCLEEGKTAVGLDINANHLRPVSSGKVTARATPINLGRNIQVWQIDIRTEENKLCCVSRLTLSVINL

SEQ ID NO: 3425 - DNA, 969 bp, Haemophilus influenzae
  Name: NTH1908
atgacaaaatccgcaaaaatcggcgtattacttgccaatctaggcacgccagatagcccaacaccgaagtcaatcagccgttatttatggcaatttttaacggatcctcgcgtggtagatttaccccgttgcaaatggtatccactgcttaaagccattattttaccattgcgttcaaaacgtatcgccaaaaattatcaagcaatctggacagaacaaggttcgcctttacttgccatttcacgacaacaaaaagacgcattacaagcctatttagatacgcaaaatatcaatgctcaagtagaaattgccatgacgtacggcaatccatcaatacaaagtacggtaaaaaatttgcttaaaaatcaagttgaacgaattattgttttgccactttatccgcaatactctagctcaaccacgggcgcagtatttgatgctttcgctaatgcccttaaagaagaacgaggattagtgccttttgatttcatccattcttatcatattgatgaaaattacattaacgccttagcaaactccataaaagtgcggttaaaatccgatgaatttttactattttcttatcacggtattcctctgcgttatgaaaaaatgggcgattattatcgtgaacattgtaaacaaacgactattgcagttgttaataagctgggcttaacagaaaaccaatggggaatgacgtttcaatcgcgctttgggcgtgaagaatggctacagccttacaccgataaatttttagaatcagctgcaacacagaacattcaaaaaattgccgttatttgcccgggtttctccgtagattgtttagaaaccattgaagaaattgataaagaaaatcgagaaaatttcttaaccaatggcgggcaatcttatcaatatattcccgcactaaatgtagagcatacacatattgaaatgatgggaaaattgatcctagaaaaacttgct

SEQ ID NO: 3426 - protein, 323 aa, Haemophilus influenzae
  Name: NTH1908
MTKSAKIGVLLANLGTPDSPTPKSISRYLWQFLTDPRVVDLPRCKWYPLLKAIILPLRSKRIAKNYQAIWTEQGSPLLAISRQQKDALQAYLDTQNINAQVEIAMTYGNPSIQSTVKNLLKNQVERIIVLPLYPQYSSSTTGAVFDAFANALKEERGLVPFDFIHSYHIDENYINALANSIKVRLKSDEFLLFSYHGIPLRYEKMGDYYREHCKQTTIAVVNKLGLTENQWGMTFQSRFGREEWLQPYTDKFLESAATQNIQKIAVICPGFSVDCLETIEEIDKENRENFLTNGGQSYQYIPALNVEHTHIEMMGKLILEKLA

SEQ ID NO: 3427 - DNA, 204 bp, Haemophilus influenzae
  Name: NTH1910
atggctgattttccttttatcgttgagatcaacgaacaaaatcttactgaaatactgcaacaatccttagaaaaaccacttgtcatcaatttttacgcgccaacccataaagaatcggcggattttttggtgctacttgagcaagttgcagaacaatatcaaggacaatttattcttggaaaagtagattgtgaaaagagcaaa

SEQ ID NO: 3428 - protein, 68 aa, Haemophilus influenzae
  Name: NTH1910
MADFPFIVEINEQNLTEILQQSLEKPLVINFYAPTHKESADFLVLLEQVAEQYQGQFILGKVDCEKSK

SEQ ID NO: 3429 - DNA, 132 bp, Haemophilus influenzae
  Name: NTH1911
atgattgccgcacaattccgcatccaagcattgccaaccacctattttgttaaagaagcacaggcattagagggcattccaggcatgcttgataaagcatcattaattccacgatttaagctttattttacc

SEQ ID NO: 3430 - protein, 44 aa, Haemophilus influenzae
  Name: NTH1911
MIAAQFRIQALPTTYFVKEAQALEGIPGMLDKASLIPRFKLYFT

SEQ ID NO: 3431 - DNA, 483 bp, Haemophilus influenzae
  n 12, 48, 58, 60: n is any nucleotide
  Name: NTH1912
ttgcaagtaganaattacgaagccgcattgccattgttgaaagacgcnatgggaactntnccgataagaaaaaccagtgatgttgccctgctctatgcggaaacctatattgcaatgaagaaaacggagccagcacaagaaattttaaatcaaattccattgcaagatcgagatagccgttggcacggattacaagcacaaattgagctacaaattcaagcagccgatacacctgaaatccaacaattacaggctgattatgctaaaaacccaacagctgaaattgcaataaaacttgccgtacaacttcatcaagctggacgaaatgaagaagcattaacactacttttcggcattttaaaaacagatttaagcgcgcagaatggcgaagttaaacaacaatttttatctattttaagcgcaatgggcaatgctgatccgctgacaaataaatttcgtcgattgctttattcgctgctttat

SEQ ID NO: 3432 - protein, 161 aa, Haemophilus influenzae
  Xaa 4, 20: Xaa is any amino acid
  Name: NTH1912
LQVXNYEAALPLLKDAMGTXPIRKTSDVALLYAETYIAMKKTEPAQEILNQIPLQDRDSRWHGLQAQIELQIQAADTPEIQQLQADYAKNPTAEIAIKLAVQLHQAGRNEEALTLLFGILKTDLSAQNGEVKQQFLSILSAMGNADPLTNKFRRLLYSLLY

SEQ ID NO: 3433 - DNA, 963 bp, Haemophilus influenzae
  n 957: n is any nucleotide
  Name: NTH1913
atgtcagatatcaaacacgcaaaacttttaattttaggctcaggccctgctggttatacagcagccatttatgcggcacgtgcaaacttaaaacccgtactggtgactggtttacaacaaggtgggcagctgactaccacagatgaaattgagaactggccgggtgattttgagatgactactggttcaggtttaatgcaacgtatgttgcaacatgcagaaaaatttgaaacagaaatcgtcttcgatcatatcaatcgcgtagatttatcttctcgcccattcaaactttttggcgatgtgcaaaatttcacttgtgatgcattaattatcgcaacgggtgcctctgcacgctatattggcttaccttcagaagaaaactacaaaggtcgtggggtttctgcttgtgcaacctgtgatggtttcttttatcgtaataagcctgttggtgtcattggtggaggaaatacagcggtggaagaagccctttacttagccaatattgcaagtacagtgcatttaatccaccgtcgcgatagcttccgtgcggaaaaaatccttatcgaccgtttgtacaaaaaagtggaagaaggaaaaatcgttcttcatactgaccgcactttagatgaagtgttgggtgacaacatgggcgtaaccggattacgtttagccaacacaaaaactggggagaaagaagaactcaaattagatggcttattcgtagcgattggtcactcgccaaatacgaaaattttccaagggcaactagaattaaataatggctatatcgttgtaaaatctggtcttgaaggaaatgcaaccgccacttctgtggaaggcgtgttcgcagcaggcgatgtcatggatcacaattatcgccaagccatcacctccgcgggaactggttgtatggcagccttggatgcagaacgctatttagatgctcaagaagcatanatcttc

SEQ ID NO: 3434 - protein, 321 aa, Haemophilus influenzae
  Xaa 319: Xaa is any amino acid
  Name: NTH1913
MSDIKHAKLLILGSGPAGYTAAIYAARANLKPVLVTGLQQGGQLTTTDEIENWPGDFEMTTGSGLMQRMLQHAEKFETEIVFDHINRVDLSSRPFKLFGDVQNFTCDALIIATGASARYIGLPSEENYKGRGVSACATCDGFFYRNKPVGVIGGGNTAVEEALYLANIASTVHLIHRRDSFRAEKILIDRLYKKVEEGKIVLHTDRTLDEVLGDNMGVTGLRLANTKTGEKEELKLDGLFVAIGHSPNTKIFQGQLELNNGYIVVKSGLEGNATATSVEGVFAAGDVMDHNYRQAITSAGTGCMAALDAERYLDAQEAXIF

SEQ ID NO: 3435 - DNA, 153 bp, Haemophilus influenzae
  n 17, 84, 85, 96, 136: n is any nucleotide
  Name: NTH1914
atgctcaagaagcatanatcttctaaccaattcccctcttttaactcttttaaagaggggaactttttctattatcacgaccannaacatgaatanacttcgccaaaatatttacaaaaatggcttcgcgcacaancagaacctatcaaaaat

SEQ ID NO: 3436 - protein, 51 aa, Haemophilus influenzae
  Xaa 6, 28, 29, 32, 46: Xaa is any amino acid
  Name: NTH1914
MLKKHXSSNQFPSFNSFKEGNFFYYHDXXHEXTSPKYLQKWLRAQXEPIKN

SEQ ID NO: 3437 - DNA, 381 bp, Haemophilus influenzae
  Name: NTH1915
atgacagttacattagcaggaaaccctattgaagttggcggacatttccctcaagtgggcgaaatagtagaaaactttattttagtcggtaatgatttagccgatgttgcattaaacgattttgcaggtaaacgcaaagtcctaaatatttttccaagcatcgacacaggtgtgtgtgcgacttcagtacgtaaatttaaccaacaagcggtaaaattaagtaatactgttgtgctttgtatttcagcagacttgccctttgctcaagctcgtttttgtggagctgaagggattgaaaatgccaaaacagtttcgactttccgtaaccacgcattacactcacaattaggcgtagatattcaaactggcccgtggcaggtt

SEQ ID NO: 3438 - protein, 127 aa, Haemophilus influenzae
  Name: NTH1915
MTVTLAGNPIEVGGHFPQVGEIVENFILVGNDLADVALNDFAGKRKVLNIFPSIDTGVCATSVRKFNQQAVKLSNTVVLCISADLPFAQARFCGAEGIENAKTVSTFRNHALHSQLGVDIQTGPWQV

SEQ ID NO: 3439 - DNA, 111 bp, Haemophilus influenzae
  Name: NTH1916
atggcgttgcaattttttgcaggttttatctctgctttcgttaaatggggagcggagcatccttttccaccgagcagccctattgatttcacggatttaactggattgggg

SEQ ID NO: 3440 - protein, 37 aa, Haemophilus influenzae
  Name: NTH1916
MALQFFAGFISAFVKWGAEHPFPPSSPIDFTDLTGLG

SEQ ID NO: 3441 - DNA, 858 bp, Haemophilus influenzae
  Name: NTH1917
atgcaaacgtttgctttgttcgttataatacgtctgtttttttatttttcttttatacggaactgcaatatgactgtcaaaacctttcgtggctcgcctgctctttctgaatttcgtttaactcaacttcaacaaaaatgccagcaatatcaattgcctattacgtcagtttatgcagagtatttgcattttgttgaacaaaaaacatcgcttgtagaagatgaaatcgttaaattacaagcattattgcattatgggtcaatgttttctgaactcaagcctgcaggatattgtttaattgtgactccacgagtggggacaatttcctcttggtcttcaaaagcgacagacatcgctcacaattgtggtttgtcgaaggtaaatcgtattgaacgtggtatagcctattacttcaatattgagcgtgatttaaccgaagcagaattggctacgctgaaagatttattacacgaccgtatgttagaaaccgtgttaaatcacgaaacagaagcagccttgctttttactcaacaagaacccaaagcattaactaccattgatattttaaatggtggccgtcaagcattagaacgggcgaatattgccttgggtttagcgttggcagatgatgagatggattatttagtggaaagttttactgccttaaagcgtaatccacaggatgtggagctttatatgtttgcacaagcgaattcagagcattgtcgccataaaatttttaatgccgattggattattgatggcaaaaaacaggataaatcgctgtttaaaatgatcaaaaatacctttgagcaacgcctgattttgggctttctgcttataaagataatgctgcag

SEQ ID NO: 3442 - protein, 286 aa, Haemophilus influenzae
  Name: NTH1917
MQTFALFVIIRLFFYFSFIRNCNMTVKTFRGSPALSEFRLTQLQQKCQQYQLPITSVYAEYLHFVEQKTSLVEDEIVKLQALLHYGSMFSELKPAGYCLIVTPRVGTISSWSSKATDIAHNCGLSKVNRIERGIAYYFNIERDLTEAELATLKDLLHDRMLETVLNHETEAALLFTQQEPKALTTIDILNGGRQALERANIALGLALADDEMDYLVESFTALKRNPQDVELYMFAQANSEHCRHKIFNADWIIDGKKQDKSLFKMIKNTFEQRLILGFLLIKIMLQ

SEQ ID NO: 3443 - DNA, 2880 bp, Haemophilus influenzae
  Name: NTH1919
gtgtctaacctcgttattccaaactttgaacaaccttgggaaaatccattgtctaaaccaaatcgcattgcttctgccttagatattatgatagatgcgcctttaggtagtgcggcatttaataatgaatttggtcgcccagcattattaggttatttccgtacttatgaagaaaaagtaaatagttttgcaggaaaagaagtacgcggttatcacaagccgattatgttagcgggaggaatcggtaatattcgtggcgaacaggttcaaaaaggcgaaattccaatcggtgctaaattgatcgtgttgggtggggcagcaatgaacatcggtttaggtggtggtgctgcttcttcgatggacagtggtaaatcaaaagaagatttagattttgcttctgttcaacgtgaaaatccggaaatggaacgccgctgccaagaagttattgaccgctgttggcaattaggcgaagaaaatccaatcctgtttattcacgatgtgggggcgggtggtttatctaatgcaatgcctgaattggtacatgatggcaggcgtggaggaaaattcgatctgcgttctattctttgtgatgaaaaaggtatgtcgccattggaaatttggtgtaatgaatcgcaagaacgttatgtattagccgttgcgccagaaaacctcgaattatttaccgcactttgtgagcgtgaacgtgccccttttgcagtgattggcgaagcaacacaagcagaacatttaatcttgcacgatagtcatttcgataataatccgattgatttaccaatgaatgtgttattaggcaaaacgccgaaaatgacgcgtgaggttttatcaaaaacagtggaaaatcaatcacttaaaacagaaggtattcaattaaaagaagcattccatcgtgtattacgtttacccgttgttgcagaaaaaactttcttaattactattggtgatcgctcggtaacaggaatggtagcccgtgatcaaatggtgggaccttggcaaattcctgtatctgatgtggctgttactactgcttcactggatagctaccacggcgaagcaatggcaatgggcgaacgctctccagttgccttgctaaatttctcggcttcggcacgcttagctgtggcggaggcgattactaacattgctggcacccacattggcgagatgaaacgtattaaactttctgccaactggatgagtgcagcaggtcacacaggcgaagatgcgggactttatgaagcagtaaaagctgtgggcgaagaactttgtcctgcgttaggtttaactattcctgtgggtaaagactcaatgtcgatgaaaaccacttggatcgataatggcgaacaaaaatcagtgactgccccactttcattagtaatttccgcttttgctcgtgtagaagatgtacgtaaaacgcttacgccacaacttcgtaccgacaaaggtttatcgagtttattgctaattgatttaggcgaagggcataatcgattaggtgcgactgcacttgctcaagtgtacaaacagttaggagacaagcctgccgatgtggtaaaggttcaacgcttaaaagatttttacaatgcaatgcaaactttagtggcagaagataaattgttggcttatcacgaccgttcggacggcggtttaatcacaactcttgcagaaatggcgtttgcagggcattgtggggtagaagttgatatttcagctttaggcgacaacgatttagcggtattatttaacgaagaactgggagcggttatccaagttgccgatagccaattagaaagtgtacgtgaggtgttgaaagctcacaatttgcttggtattacccaccaattaggtacggtaactgctgatgatcgctttgagatcagccgcggcagccataaattattcagcgaaaaacgctctgaattacgtagtatttgggcagaattaacttaccaaatgcaacgcttacgcgataatccagagtgtgctgagcaagagtttgaagctaagaaaaaccctgacgacaaaggcttatccgcatttttgacttacgatgtgaatgaagatattactgcgccatttatcaataaaggtgtaaaaccaaccattgcaattttacgtgaacaaggtgtaaatagtcattatgaaatggcagcagcgtttgatcgagcaggctttaatgcaattgacgtgcatatgtctgatttaatgattggtcgtcgtaatttagccgaattcaatgcaatggttgcttgtggcggtttctcttacggcgatgtgcttggcgcagggggcggttgggcaaaatccatcttatttaacccgaaattacacgagcaattcagccagttttttatcaatccaaacacactgaccttaggcgtatgtaacggttgtcaaatgatctctaacttggcggaaattatcccaggtacagaaaactggccgcattttgtacgcaacaaatctgaacgctttgaagcgcgtgtgagtttagtgaaaattaatgaagtggattcagtttggtttgcaggaatggctggctcacatatgcccattgcggtttctcacggggaaggacaagttaagtttaaatcagttgaacagtttgcaggcttaaaagcacaaggcatcattgctgcacaatatattgacaacaacggtagccccaccgaactatatcctgccaatccgaatggttctgcggagggcattactgcaattacaaatcttgatgggcgagttgctattatgatgccacaccctgaacgtgtgttccgtgctgtgagtaactcttggcacccagaaaactggacagaagacggtgcgtggatgagattattcagaaatgcaagaatggtattt

SEQ ID NO: 3444 - protein, 960 aa, Haemophilus influenzae
  Name: NTH1919
VSNLVIPNFEQPWENPLSKPNRIASALDIMIDAPLGSAAFNNEFGRPALLGYFRTYEEKVNSFAGKEVRGYHKPIMLAGGIGNIRGEQVQKGEIPIGAKLIVLGGAAMNIGLGGGAASSMDSGKSKEDLDFASVQRENPEMERRCQEVIDRCWQLGEENPILFIHDVGAGGLSNAMPELVHDGRRGGKFDLRSILCDEKGMSPLEIWCNESQERYVLAVAPENLELFTALCERERAPFAVIGEATQAEHLILHDSHFDNNPIDLPMNVLLGKTPKMTREVLSKTVENQSLKTEGIQLKEAFHRVLRLPVVAEKTFLITIGDRSVTGMVARDQMVGPWQIPVSDVAVTTASLDSYHGEAMAMGERSPVALLNFSASARLAVAEAITNIAGTHIGEMKRIKLSANWMSAAGHTGEDAGLYEAVKAVGEELCPALGLTIPVGKDSMSMKTTWIDNGEQKSVTAPLSLVISAFARVEDVRKTLTPQLRTDKGLSSLLLIDLGEGHNRLGATALAQVYKQLGDKPADVVKVQRLKDFYNAMQTLVAEDKLLAYHDRSDGGLITTLAEMAFAGHCGVEVDISALGDNDLAVLFNEELGAVIQVADSQLESVREVLKAHNLLGITHQLGTVTADDRFEISRGSHKLFSEKRSELRSIWAELTYQMQRLRDNPECAEQEFEAKKNPDDKGLSAFLTYDVNEDITAPFINKGVKPTIAILREQGVNSHYEMAAAFDRAGFNAIDVHMSDLMIGRRNLAEFNAMVACGGFSYGDVLGAGGGWAKSILFNPKLHEQFSQFFINPNTLTLGVCNGCQMISNLAEIIPGTENWPHFVRNKSERFEARVSLVKINEVDSVWFAGMAGSHMPIAVSHGEGQVKFKSVEQFAGLKAQGIIAAQYIDNNGSPTELYPANPNGSAEGITAITNLDGRVAIMMPHPERVFRAVSNSWHPENWTEDGAWMRLFRNARMVF

SEQ ID NO: 3445 - DNA, 120 bp, Haemophilus influenzae
  Name: NTH1920
gtgatttgtttagttatggtagataattatacccctacctattcattttacaaatacgtaaattccgttttaaaagtaacgcacacagtgaaaatctgccagatttccaccgcacttttt

SEQ ID NO: 3446 - protein, 40 aa, Haemophilus influenzae
  Name: NTH1920
VICLVMVDNYTPTYSFYKYVNSVLKVTHTVKICQISTALF

SEQ ID NO: 3447 - DNA, 144 bp, Haemophilus influenzae
  Name: NTH1921
atgttaatcacattaacacatattaataataacttgataataagaaatgaaattttagatagtcttggcaagcaagcaagcaagcaagcaagcaagcaagcaagcaagcaagcaagcaagcaagtaagcaagcaaagagtgact

SEQ ID NO: 3448 - protein, 48 aa, Haemophilus influenzae
  Name: NTH1921
MLITLTHINNNLIIRNEILDSLGKQASKQASKQASKQASKQVSKQRVT

SEQ ID NO: 3449 - DNA, 141 bp, Haemophilus influenzae
  Name: NTH1922
ttgctttgtgatgtactatttaagtcactctttgcttgcttacttgcttgcttgcttgcttgcttgcttgcttgcttgcttgcttgcttgcttgcttgccaagactatctaaaatttcatttcttattatcaagttattat

SEQ ID NO: 3450 - protein, 47 aa, Haemophilus influenzae
  Name: NTH1922
LLCDVLFKSLFACLLACLLACLLACLLACLLACQDYLKFHFLLSSYY

SEQ ID NO: 3451 - DNA, 741 bp, Haemophilus influenzae
  n 38: n is any nucleotide
  Name: NTH1923
atgtttattacacctatcttcattattaatctagaaanatctacagatcgaaaagcttatatgcaagcacagtttgaacagttattttcgaataatttaatacaagaaattcacttttttgatgctatttatggaaaatcaaatccgaatcacccattgtttcaacgttacaatgaaaataagcggttgaatgcaaaggggtatcctttaaccttgggtcaattaggctgttatgcgagccattattctatgtgggagaaatgtgtagaattagattaccctattattgtattagaagatgatgctaaatttaaaaataatttcttagaagtacttgattttattaatagcgataaaaatacgtttgaatttttctggttacaacctgatcgtttgaaaaataaaagaaaattgatctctaatttcggtaatctttcgatatatcaatttagtaaaggatttgctggtgctacaggttattatttaactccccaagcagcaaggaaatttttaacacaaagcaaggagtggtatttaaccgtggatgtgacaatggatcgtttttttgagaataaagtgccaccttatgcaatagtaccattttgcttagaagatgatggcgagatagaatcaactatttatgagaaacaaaagaaacagagatcattaaaaatagtgattatgagagagttgtttaatctaaaaactaatattaaaagacgtatttataacttattccat

SEQ ID NO: 3452 - protein, 247 aa, Haemophilus influenzae
  Xaa 13: Xaa is any amino acid
  Name: NTH1923
MFITPIFIINLEXSTDRKAYMQAQFEQLFSNNLIQEIHFFDAIYGKSNPNHPLFQRYNENKRLNAKGYPLTLGQLGCYASHYSMWEKCVELDYPIIVLEDDAKFKNNFLEVLDFINSDKNTFEFFWLQPDRLKNKRKLISNFGNLSIYQFSKGFAGATGYYLTPQAARKFLTQSKEWYLTVDVTMDRFFENKVPPYAIVPFCLEDDGEIESTIYEKQKKQRSLKIVIMRELFNLKTNIKRRIYNLFH

SEQ ID NO: 3453 - DNA, 294 bp, Haemophilus influenzae
  Name: NTH1924
atgatagtaacgaattcgcagacgttcaacgtcaatttaaagcagcaattcactatgctagaaaacacggctcccgccattgcaataggtcatcctcgccaaaatacgattgcagttttacaagcaggacttcgtaatttacccgaagatattcaattagtcggaatgggaaatttatggcgaaatgaaaaagttattccgcacaagccatttattttattattcagcgaagtgcccgcgccaacttctatagaaccttttgagcctgtaggattattgcgtggaattccaaaa

SEQ ID NO: 3454 - protein, 98 aa, Haemophilus influenzae
  Name: NTH1924
MIVTNSQTFNVNLKQQFTMLENTAPAIAIGHPRQNTIAVLQAGLRNLPEDIQLVGMGNLWRNEKVIPHKPFILLFSEVPAPTSIEPFEPVGLLRGIPK

SEQ ID NO: 3455 - DNA, 516 bp, Haemophilus influenzae
  Name: NTH1925
atgaaaaactttttagctcaacaaggaaaaatcacgctaattctcaccgcactttgtgcgcttatttatattgctcaacagctgggttttgaagacgatattatgtatttgatgcactaccccgcttacgaagagcaagatagcgaagcgtggcgttatatttcacatacattggtacatttatctaatttgcatattttgtttaatctgtcttggttttttatttttggtggaatgattgagcgcacttttggttcagtcaaattattgatgttgtatgttgtagcatctgtaataacaggatatgtgcaaaattatgtgtctggccccgctttctttgggctttctggtgttgtatatgcggttctaggttatgtatttatacgtgataaattgaatcatcatttatttgatctgccagaaggttttttcacaatgttattggtggggatcgcattaggttttattagccccttatttggtgttgaaatgggaaatgctgcacattttcaggct

SEQ ID NO: 3456 - protein, 172 aa, Haemophilus influenzae
  Name: NTH1925
MKNFLAQQGKITLILTALCALIYIAQQLGFEDDIMYLMHYPAYEEQDSEAWRYISHTLVHLSNLHILFNLSWFFIFGGMIERTFGSVKLLMLYVVASVITGYVQNYVSGPAFFGLSGVVYAVLGYVFIRDKLNHHLFDLPEGFFTMLLVGIALGFISPLFGVEMGNAAHFQA

SEQ ID NO: 3457 - DNA, 705 bp, Haemophilus influenzae
  Name: NTH1926
ttggcgtttagattgtttgcgtgtcattgtgacgaacaaggaataaaaatggcattgattgaatacaatccgccccttgaaccttatttagatattatttatcaagataatcatttgtgcgtagtgaataaacctagtggtttgctttctgtgccgggtaatcaaccacaatattacgatagtgcaatgagccgagtgaaagaaaaattcggcttttgcgagccagctcatcgtttggatatggcaacgagcggtattattgtgtttgctttaagtaaggctgctgatcgtgaattaaaacgtcaatttcgcgaacgtgaaccgaaaaaacattatcaagcgattgtttgggggcatttggagaaagattatggcgaggtaaatttgccaatgatttgtgattgggaaaatcgtcctcgccaacgtttggatttcgttttagggaaaagagcggtcacaaaattcgaagttttagcacgtttgcccaataacagtactcgcgtgaaactgacgcccgtgacaggcagatctcatcaattacgattacatatgttggctttagggcatccaattttaggcgataaattttattcacatcctcaggctaaagctatgtcgccaagattatgcttgcacgcagaagaattgacgattacccaccccattacaggggaaacaatgacttttaatgcgaagtcagatttt

SEQ ID NO: 3458 - protein, 235 aa, Haemophilus influenzae
  Name: NTH1926
LAFRLFACHCDEQGIKMALIEYNPPLEPYLDIIYQDNHLCVVNKPSGLLSVPGNQPQYYDSAMSRVKEKFGFCEPAHRLDMATSGIIVFALSKAADRELKRQFREREPKKHYQAIVWGHLEKDYGEVNLPMICDWENRPRQRLDFVLGKRAVTKFEVLARLPNNSTRVKLTPVTGRSHQLRLHMLALGHPILGDKFYSHPQAKAMSPRLCLHAEELTITHPITGETMTFNAKSDF

SEQ ID NO: 3459 - DNA, 2769 bp, Haemophilus influenzae
  Name: NTH1927
atgccctttgctattggtcagcgttggttgagtgaaagtgaaaacgctttaggattaggtgttattaccgcattagatcaacgaaccgtcacgatttatttccccgcagcagatgaaacgaggatatatgctgctgcacaagcacctttaagtcgaattgtgtttagcaaaggcgaaacattatcccatcaagctggctggcaaggcgagattttagacgttcaaaatatgaacggtttgttgttttatttagttaaaaccccacaagatgaagatgtcattgtgcaagaacgtgatatttcgccgattatttcttttagccaagcgaaagatcgtttgttttcagcgcaaattgatcgcagcagtcattttgcattgcgttatcgcacgctttgtcatcagcaagcacaatttaaatcgccattgcgtggtttacgcggaacgcgtgcgggtttaattcctcatcagcttcatattgcagctgaagtcggtaatcgagttaatcctcgcgtgttattggctgatgaggttggtttagggaaaaccattgaagcaggaatgattttgcagaatcaactttttgctgagaaagtgcaacgtgttcttattattgtgccagaaacgttgcaacatcaatggctggtggaaatgcttcgtcgttttaatttgcatttttcactttttgatgaagaacgttgcaatgattttgatcttgatgctgttaatccattcatgactgaaagcttaattatttgttctctaaattggttagaaacgcatccaaaccgagtagaacaggcacttgatgctcaatttgactgtttaattgtggatgaggcacatcatctggtatggtcggaaagcgcgccaagtgcagcttatttattagttgaacagcttgctcgcatcattccctctgtcttgttactcactgcaactccagagcaacttgggcaagaaagtcattttgctcgtttgcgtttactggatccagaacgtttctttgattatcaaacttttgtgaaagagcagaaacgctaccaacctgtggttaatgctattgaatctttgctggcaaataaggcattaagtgcggtagaaaaaaatcatatttctgatttgttgcttgaacaagatgttgagccactttttaaagcgattgcatcaaataatgatgaagaacagcatcgtgcccgtcaggaattgattcaagccttaattgatcgtcacggcacggggcgaatgttattccgcaatacacgtcaaggcgtgaaaggtttcccccaccgtgtttaccaccaaattacactctcggaagagaatgataaaattgattggctgattaatttcctcaaactacatcgcgatgaaaaaatttttgtgatttgccagacagcggcaacagcgattcagttagaacaaattttgcgtgaacgtgaggcgattcgtgccgcagtgttccacgaaaaaatgtcgattatcgaacgggatagagccgccgcttattttgcggatttagaaaacggcgcacaggttttactgagctcgagtattggctcggaagggcgaaatttccaattcgcagcaaatttagtgttatttgatttaccgacaaatcctgatttattggaacaatgtattgggagattagatcgtattggacaaaaacgtgatgtgcaaatttatgtgccttgtgcgaaagattcgcctcaaattcgtttagcgcgttggtacaatgaggggctgaatgcttttgaacaaacctgcccaatgggaatggcattattttcgcagtttgaggacgagttggaaaaagtgcggtcaaattctaccgcactttcagagaatgaattttctgaattattaaaacaaactaaaactgtgcgagaaaaactcaagattgagttagaaaaagggcgagatcgcttgttagaactaaattctaatggtggaaagcaagcacaagcgttagcggatcaaattgctgatgaagataattcgcctgagcttgtgaattttgccttaaaattatttgatattattggcgtagagcaagaagatcttggcgcaaatagtattgtaattagcccaacagggacaatgcttgtgccagatttccctggtttaaaagaagaaggtgtgacggttacctttgatcgagaacttgcccttgctcgcgaagaaatggaatttttgacttgggatcatcctatgattcgtcaaggtattgatcttgttgcttcgggagatattggcaaagccgcaatggcattgcttgtaaataaacaactgcccgctggaaccttattaattgaattgatttatatagtggaaagtcaatcgccaaaagggttacagctcaatcgtttcttgccgccaacgcctattcgtctgctgcttgataacaaaggaaataacattggtgagcaggttgcctttgaaacattgcatagcaaattaaaaccacttggtaaaaatattgctaatcaaatggtaaaaatggcgcggggtaatattgaagccttgattacacgaggcgatcaactcgtaaaatctttagctgaaccgattattaccgaagctaaaaatcaggcagatcaacaattaagcgcagaaattaatcgtttgcaggctttgcgagcggtaaatcaaaatattcgccaaagcgaaattgatattttggaacaacaacgaacacaatcactggatgagctttctaaagcaaattggcgtttagattgtttgcgtgtcattgtgacgaacaaggaa

SEQ ID NO: 3460 - protein, 923 aa, Haemophilus influenzae
  Name: NTH1927
MPFAIGQRWLSESENALGLGVITALDQRTVTIYFPAADETRIYAAAQAPLSRIVFSKGETLSHQAGWQGEILDVQNMNGLLFYLVKTPQDEDVIVQERDISPIISFSQAKDRLFSAQIDRSSHFALRYRTLCHQQAQFKSPLRGLRGTRAGLIPHQLHIAAEVGNRVNPRVLLADEVGLGKTIEAGMILQNQLFAEKVQRVLIIVPETLQHQWLVEMLRRFNLHFSLFDEERCNDFDLDAVNPFMTESLIICSLNWLETHPNRVEQALDAQFDCLIVDEAHHLVWSESAPSAAYLLVEQLARIIPSVLLLTATPEQLGQESHFARLRLLDPERFFDYQTFVKEQKRYQPVVNAIESLLANKALSAVEKNHISDLLLEQDVEPLFKAIASNNDEEQHRARQELIQALIDRHGTGRMLFRNTRQGVKGFPHRVYHQITLSEENDKIDWLINFLKLHRDEKIFVICQTAATAIQLEQILREREAIRAAVFHEKMSIIERDRAAAYFADLENGAQVLLSSSIGSEGRNFQFAANLVLFDLPTNPDLLEQCIGRLDRIGQKRDVQIYVPCAKDSPQIRLARWYNEGLNAFEQTCPMGMALFSQFEDELEKVRSNSTALSENEFSELLKQTKTVREKLKIELEKGRDRLLELNSNGGKQAQALADQIADEDNSPELVNFALKLFDIIGVEQEDLGANSIVISPTGTMLVPDFPGLKEEGVTVTFDRELALAREEMEFLTWDHPMIRQGIDLVASGDIGKAAMALLVNKQLPAGTLLIELIYIVESQSPKGLQLNRFLPPTPIRLLLDNKGNNIGEQVAFETLHSKLKPLGKNIANQMVKMARGNIEALITRGDQLVKSLAEPIITEAKNQADQQLSAEINRLQALRAVNQNIRQSEIDILEQQRTQSLDELSKANWRLDCLRVIVTNKE

SEQ ID NO: 3461 - DNA, 747 bp, Haemophilus influenzae
  Name: NTH1928
atgaattatcgtgatgaattaattttacaatgggtaaatcaacaaggaaaagccagcgtaatagaacttgcacagcattgtgatatttcggtggaaaccattcgtcgcgatttgaacaaattagcgaacaaaggcttattgcaccgaacacacggaggagcagtgagtaataaaaccaaagatttaggttcatttttccaaactcgaaaacatattaatgcaacagctaaacgacatattgcccaaaaagccttggatttgctatatgaaaatgccgttataggtttagatgcaagctcaacaagttggtattttgcttatttaatgcccgatattccttgtacagtagtaaccaactcaatgtttaacattaatgccctagttaataaatccaatgttaaaactattgtcactggcggagtttattcagcaaaatatgaagcattttacggtcccttatctgagtatttattacaacgattacatattaatttttccgtgttttcttgttcaggaattgatcaaaacggtaatatctgggaatcaaatgagctgaatgcctctttgaaacgaaaaatgatagaggcttcagaacgtgcttatttgttaattgattcttctaagtttgaaaagaaaagtttgattcaacttaccgatttaagcaaaattaatacgattttttctgatcaaccacttccagataacttacaaaaatattgtgagctacacgatataatgaccgtttta

SEQ ID NO: 3462 - protein, 249 aa, Haemophilus influenzae
  Name: NTH1928
MNYRDELILQWVNQQGKASVIELAQHCDISVETIRRDLNKLANKGLLHRTHGGAVSNKTKDLGSFFQTRKHINATAKRHIAQKALDLLYENAVIGLDASSTSWYFAYLMPDIPCTVVTNSMFNINALVNKSNVKTIVTGGVYSAKYEAFYGPLSEYLLQRLHINFSVFSCSGIDQNGNIWESNELNASLKRKMIEASERAYLLIDSSKFEKKSLIQLTDLSKINTIFSDQPLPDNLQKYCELHDIMTVL

SEQ ID NO: 3463 - DNA, 1704 bp, Haemophilus influenzae
  n 1695, 1696, 1697, 1698, 1699: n is any nucleotide
  Name: NTH1929
atgattgtatttagtaatctgtccttaaaacgagggcaaacggagcttctcgaaaatgcttctgctaccattaatcctaagcaaaaagtcggcttggtggggaaaaatggttgtggaaaatcttcgctttttgccttattaaaaaaagaattaacgccagagggcggcgaggtaaattatccagcaaattggcgggtatcttgggtgaatcaagaaacgcctgcattggatatttctgcaattgattatgtaattcaaggggatcgtgaatattgccgtttgcaacaagagcttgaacaagcaaatgaatgcaatgacggtaacgccattgcacgtattcacgggcaattagaaaccttggatgcgtggacaattcaatctcgtgccgcttcgttattgaatggtttaggatttagtcaagaagaaacaacccagccagtgaaagccttttcgggcggttggcggatccgtttgaatttggcacaagctctgctttgtccatcagatttattattactggatgagccaaccaaccatttggatttggatgcggttatttggttagagcgttggctagtacaatatcaaggcaccttggtattaatttctcacgatcgtgattttctcgatccgattgtgacaaaaatcctccatatcgaaaatcagaagctcaacgaatacacgggcgattattcttcctttgaagtgcaacgagccactaaattggcacaacaaacagcgatgtatcgtcagcaacaacaaaagatttcccatttacaaaaatatattgatcgctttaaagccaaagccactaaagccaaacaggcacaaagccgtatgaaagcactagaaagaatggagctgattgcaccagcttatgtggataatccttttacttttaaatttcgtccaccgcaatccttgccgaatcccttagtgatgattgaacaggcaagtgcaggttatggcagcggagaaagtgcggtagaaattttaagtaaaattaaactgaatttagtgccaggttcgcgcattggtttactcgggaaaaatggtgcaggaaaatcaaccttgattaaacttttagcgggagaactgaccgcactttcaggcacagtgcagttggcaaaaggcgtgcagcttggctattttgctcagcatcaattagatactttacgcgcagacgaatctgctctgtggcatatgcaaaaactcgcaccagaacaaacggagcaacaagttcgagattatttaggcagttttgcgtttcacggcgataaagtaaatcaagcagtgaaatctttttctggaggagaaaaagctcgtttggtgttggctttgattgtttggcaacgcccgaatttattactacttgatgaaccgactaaccatttggatttggatatgcgtcaagcattaacggaagcattggtagattacgaaggttctttggtggtggtgtcgcacgatcgtcatttattacgcaataccgtggaagaattttatttagttcacgataaaaaagtggaagaatttaaaggcgatttagaagactatcaaaaatggctgaatgaacaaaatagcacatctgaaaataaagtttcggaaaaagtgggcgataatgaaaattcggttcaaaatcgtaaggaacaaaaacgccggaagcagagttacgccaacaaactgcagcggggnnnnnttaat

SEQ ID NO: 3464 - protein, 568 aa, Haemophilus influenzae
  Xaa 566, 567: Xaa is any amino acid
  Name: NTH1929
MIVFSNLSLKRGQTELLENASATINPKQKVGLVGKNGCGKSSLFALLKKELTPEGGEVNYPANWRVSWVNQETPALDISAIDYVIQGDREYCRLQQELEQANECNDGNAIARIHGQLETLDAWTIQSRAASLLNGLGFSQEETTQPVKAFSGGWRIRLNLAQALLCPSDLLLLDEPTNHLDLDAVIWLERWLVQYQGTLVLISHDRDFLDPIVTKILHIENQKLNEYTGDYSSFEVQRATKLAQQTAMYRQQQQKISHLQKYIDRFKAKATKAKQAQSRMKALERMELIAPAYVDNPFTFKFRPPQSLPNPLVMIEQASAGYGSGESAVEILSKIKLNLVPGSRIGLLGKNGAGKSTLIKLLAGELTALSGTVQLAKGVQLGYFAQHQLDTLRADESALWHMQKLAPEQTEQQVRDYLGSFAFHGDKVNQAVKSFSGGEKARLVLALIVWQRPNLLLLDEPTNHLDLDMRQALTEALVDYEGSLVVVSHDRHLLRNTVEEFYLVHDKKVEEFKGDLEDYQKWLNEQNSTSENKVSEKVGDNENSVQNRKEQKRRKQSYANKLQRGXXN

SEQ ID NO: 3465 - DNA, 294 bp, Haemophilus influenzae
  Name: NTH1930
atgaataaaatcagcccattaggttcaaattggaatgagtttgaacagcaaattttcaatgaagaagaaatccgcgaaagtaatttacgtgtagccttaattaaagaattgattacttctcgccagcaacttgggatttcccaaaaacaacttgaaaccttaagcggtgtgaagcaacctatgattgcacgcattgaaaaaggacaaacgaatcctcaacttgaaacgttgttaaaattgctcgctcctttagggaaaaccctgtcgattgtgcctctaagggtaaaaaatgcc

SEQ ID NO: 3466 - protein, 98 aa, Haemophilus influenzae
  Name: NTH1930
MNKISPLGSNWNEFEQQIFNEEEIRESNLRVALIKELITSRQQLGISQKQLETLSGVKQPMIARIEKGQTNPQLETLLKLLAPLGKTLSIVPLRVKNA

SEQ ID NO: 3467 - DNA, 180 bp, Haemophilus influenzae
  Name: NTH1931
atgtacgagattctcttttacagagaccaaaatgacattgagccagtgaaagaatatctgctatcgctggctcaaaatgaaagcaaagatagtcgaattaaactgaataaaattcgagattatgtaatccaaacaacccaacaacgcttaagtgaattaaaagagagattgaaaaatgaa

SEQ ID NO: 3468 - protein, 60 aa, Haemophilus influenzae
  Name: NTH1931
MYEILFYRDQNDIEPVKEYLLSLAQNESKDSRIKLNKIRDYVIQTTQQRLSELKERLKNE

SEQ ID NO: 3469 - DNA, 1320 bp, Haemophilus influenzae
  Name: NTH1932
atgaagcgaatggttaatcgtgctggtaatgatgcttctgatgtgcaatggtgggcagagcctacacttggttacagtttgttgtatgataaacctcacacttgtaaaaccgcttatggggggtggaaagctaacctttgccctcgagttgatcctaaattttcattcttattacccattaaaacaaaagaaaaatcagtctatctctttgataatgttgttataactgattatttatcttttgatttgggttatcgttatgacaatatccattatcaaccaaaatataaacacggcgttacaccgaaattacctgatgatattgtgaaaggattgtttattccattaccaagtggtaaaaataataatgatgatcctgaagttaagaaaaacgtacaacaaaatattgactatatcgctaaacaaaacaaaaaatataaagcacattcttacagttttgtttcaacgattgatccaacgagttttcttcgtttacaactaaaatattcaaaaggttttagagcaccaacttcagatgaaatgtatttcacctttaaacaccctgatttcactattttgccaaatactaatctaaaaccagagatagcaaaaacaaaagaaattgcttttacattacataatgatgattggggttttatctccacaagtctatttaaaaccaactataaaaactttatcgacctaatatttaaaggagaaaaagattttaaattagttagcggaggtagcacattaccattttctctttatcaaaatattaatagagatagtgcggtagtaaaaggaatagaaattaattcaaaagtattccttggtaaaatggcaaaatttatggatggatttaacctaagctataaatatacctatcaaaaaggaagaatggatggcaatattcctatgaatgcaattcagcctaaaacgatggtgtatggcttaggctatgaccacccaagccaaaaatttggatttaatttctacactacccacgtagcaagtaaaaatccagaagatacttatgatatttatgcgaaagataaaaaccaaaccaacactagcataaaatggcgcagtaaatcttatactattctagatttaattggatatgtgcaaccaattaaaaatttaaccataagagccggcgtatataatcttacaaaccgtaaatacatcacttgggattctgcgcgttcaattcgttcatttggtacaagtaatgttatagatcaaaagacaggtcaaggcattaaccgcttctacgcaccaggtagaaattataagatgtcagttcaatttgagttt

SEQ ID NO: 3470 - protein, 440 aa, Haemophilus influenzae
  Name: NTH1932
MKRMVNRAGNDASDVQWWAEPTLGYSLLYDKPHTCKTAYGGWKANLCPRVDPKFSFLLPIKTKEKSVYLFDNVVITDYLSFDLGYRYDNIHYQPKYKHGVTPKLPDDIVKGLFIPLPSGKNNNDDPEVKKNVQQNIDYIAKQNKKYKAHSYSFVSTIDPTSFLRLQLKYSKGFRAPTSDEMYFTFKHPDFTILPNTNLKPEIAKTKEIAFTLHNDDWGFISTSLFKTNYKNFIDLIFKGEKDFKLVSGGSTLPFSLYQNINRDSAVVKGIEINSKVFLGKMAKFMDGFNLSYKYTYQKGRMDGNIPMNAIQPKTMVYGLGYDHPSQKFGFNFYTTHVASKNPEDTYDIYAKDKNQTNTSIKWRSKSYTILDLIGYVQPIKNLTIRAGVYNLTNRKYITWDSARSIRSFGTSNVIDQKTGQGINRFYAPGRNYKMSVQFEF

SEQ ID NO: 3471 - DNA, 474 bp, Haemophilus influenzae
  Name: NTH1933
gtggttacaacaagcagaaatggacacgaacttgaaaactatgattacaaaaatgcaaatagccttactcaaggtaaaaaaagagaaaaagcagacccatacaaaattgaacaagatagtacattattaaaattatcttttaaccctacagaaaatcatcgttttacccttgcagcagatttatatgaacatcgttctcgtgggcaagatttatcctatacactaaaatatcaaaaaacagatcctaatttactcgaggttgattctagacacaccaatgataaaacaaagagacgtaatatttcctttagctatgaaaatttctctcaaacgccattttgggatacattaaaaatcacttattcagatcaacgtattaaaactcgcgcacgtacagatgactattgtgatgcaggtgtaagatattgtgagggaactgcaaatcctgcgggactaaaaataacagatgggaaa

SEQ ID NO: 3472 - protein, 158 aa, Haemophilus influenzae
  Name: NTH1933
VVTTSRNGHELENYDYKNANSLTQGKKREKADPYKIEQDSTLLKLSFNPTENHRFTLAADLYEHRSRGQDLSYTLKYQKTDPNLLEVDSRHTNDKTKRRNISFSYENFSQTPFWDTLKITYSDQRIKTRARTDDYCDAGVRYCEGTANPAGLKITDGK

SEQ ID NO: 3473 - DNA, 420 bp, Haemophilus influenzae
  Name: NTH1934
ttgccaacaactcgattaccgccaatggtagaacacaataatagcgtaaacaaaacggcttttactgtaacgattgaagccgcaaaaggtgtttctacaggcgtatctgctgcagaccgagtaaccactattcaaacggctattgctgataatgcagttccaacagatttacatcgtccaggccatgtcttcccacttcgtgccgcaaatggtggcgtacttactcgccgcggacacacagaagcttccgttgatttagcgcgtctggcaggatttaaagaagcaggcgttatttgtgaaatcacgaatgacgacggcacaatggcgcgcacccccgagattgtagaatttgcgaaaaaatttggttattcggtgctaaccattgaagatttagttgaatatcgtttagcacataatatt

SEQ ID NO: 3474 - protein, 140 aa, Haemophilus influenzae
  Name: NTH1934
LPTTRLPPMVEHNNSVNKTAFTVTIEAAKGVSTGVSAADRVTTIQTAIADNAVPTDLHRPGHVFPLRAANGGVLTRRGHTEASVDLARLAGFKEAGVICEITNDDGTMARTPEIVEFAKKFGYSVLTIEDLVEYRLAHNI

SEQ ID NO: 3475 - DNA, 846 bp, Haemophilus influenzae
  Name: NTH1935
gtgaaaatttctatgatttttttaccgcactttttatattatactgttccaactttttatttatttgggttacttattatgcataatgcagctcagcacaattatgttatcagtttaactactgaacaaaaacgccgaaaacatattacagacgaattcggtaagcagaatattcctttcgaattttttgatgctattacgcccgacattattgaagaaaccgctaaaaaatttaatattgcattagatcgctctcctaaagccaagttgtcggatggggaaattggttgtgcattaagccatattgttttatgggatttagcattagaaaataatttaaactatatcaatatctttgaagatgatattcatttgggggaaaatgccaaagaattattagaaattgattatatttctgatgatattcatgtcttaaaattagaagcaaatggcaagatgttctttaaacaaccaaaatctgtaaaatgcgatagaaatgtttatcccatgacggtaaagcaatcaggatgtgctggatatactgttacagcaaaaggggctaaatatttgcttgaattagtaaaaaataaaccacttgacgtggcggttgattcacttgtttttgaggattttttacattttaaagattataaaatagtacaactttctcctggtatttgcgttcaagattttgtgttacatccagataatccttttgaaagcagtttacaagaaggacgagatagagtacacggaaatcaacgcaagttttctattttagaaaaaataaaaaatgaatttggacgagtaaaaataaaaatgtttggaaaacaagttccatttaaa

SEQ ID NO: 3476 - protein, 282 aa, Haemophilus influenzae
  Name: NTH1935
VKISMIFLPHFLYYTVPTFYLFGLLIMHNAAQHNYVISLTTEQKRRKHITDEFGKQNIPFEFFDAITPDIIEETAKKFNIALDRSPKAKLSDGEIGCALSHIVLWDLALENNLNYINIFEDDIHLGENAKELLEIDYISDDIHVLKLEANGKMFFKQPKSVKCDRNVYPMTVKQSGCAGYTVTAKGAKYLLELVKNKPLDVAVDSLVFEDFLHFKDYKIVQLSPGICVQDFVLHPDNPFESSLQEGRDRVHGNQRKFSILEKIKNEFGRVKIKMFGKQVPFK

SEQ ID NO: 3477 - DNA, 480 bp, Haemophilus influenzae
  Name: NTH1936
atgttagatattgttttatatgaaccagaaatcccacaaaatacggggaacattattcgcctttgtgccaatacaggatttcgcttgcacttaattgaacccctaggtttcacttgggatgataaacgcttacgccgctcaggtttggattatcacgaatttgcggaaatcaaacgccacaaaacctttgaagcctttttagaaagcgaaaaacccaaacgcctttttgcacttacaacaaaaggcagtccagcccatagccaagtgaaatttgaacttggggattatttaatgtttggcccagaaactcgtggcattccgatgtcaattttaaatgaaatgccgatggaacaaaaaatccgcattccaatgacagccaatagccgcagtatgaacttgtccaattctgtcgcagtaacggtttatgaagcgtggcgacaattaggctataaaggtgcggtaaatttaccagaagtagaa

SEQ ID NO: 3478 - protein, 160 aa, Haemophilus influenzae
  Name: NTH1936
MLDIVLYEPEIPQNTGNIIRLCANTGFRLHLIEPLGFTWDDKRLRRSGLDYHEFAEIKRHKTFEAFLESEKPKRLFALTTKGSPAHSQVKFELGDYLMFGPETRGIPMSILNEMPMEQKIRIPMTANSRSMNLSNSVAVTVYEAWRQLGYKGAVNLPEVE

SEQ ID NO: 3479 - DNA, 579 bp, Haemophilus influenzae
  Name: NTH1937
atgaaaaaaatacaaacgccaaatgcaaagggcgaagttcgcattattgctggactatggcgagggcgaaaacttcctgtattaaattctgaaggcttacgcccaactggcgatagagtgaaagaaacgctttttaattggttaatgccttatatctatcaatctgaatgtttagatggctttgcggggagtgggtcgttaggttttgaagcactttctcgccaagcgaaaaaggtgacttttttagaattggataaaaccgttgccaatcaattaaaaaagaatttacaaacactcaaatgctcatcagaacaggctgaagtaattaatcaaagtagtttggattttctaaaacagccacaaaatcaaccgcactttgatgtggtgtttttagatccaccctttcattttaatttggcagaacaagcaattagtttgctttgtgaaaataactggctaaaacccaatgcgttaatttacgtagaaacagagaaagataaaccgcttattactcctgaaaactggacgttattgaaagaaaaaacgacgggaatggtgagctatcgtttatatcagaat

SEQ ID NO: 3480 - protein, 193 aa, Haemophilus influenzae
  Name: NTH1937
MKKIQTPNAKGEVRIIAGLWRGRKLPVLNSEGLRPTGDRVKETLFNWLMPYIYQSECLDGFAGSGSLGFEALSRQAKKVTFLELDKTVANQLKKNLQTLKCSSEQAEVINQSSLDFLKQPQNQPHFDVVFLDPPFHFNLAEQAISLLCENNWLKPNALIYVETEKDKPLITPENWTLLKEKTTGMVSYRLYQN

SEQ ID NO: 3481 - DNA, 1065 bp, Haemophilus influenzae
  Name: NTH1938
atgaacgacatttttatcggattacagttaagagagcattttatggctgaagaaaataaaaaaggcggattttgggcatcattatttgggcgtaataaaaagcaagatgaacctaaaattgagccaataattgaagaagaaaagataaaagatatcgagccgtctattgaaaaatttgaaactcatgatttagtcgaagaagaaaaaatacaggaaatttcaaccgcacttgagccgattgaagaaatcatcgaagcgaaaaagttagaagatgagcttcagcctgttgctgaaattgaaactcgcgaaaagccaagtgaagggggcttttttagtcgtttggttaagggattactgaaaactaaacaaaatattggcgcgggttttcgtagttttttcttaggaaagaaaattgatgatgagttgtttgaagaattagaagaacaactgttgattgcggatattggcgtgccgacaacaagtaaaatcgtcaaaaatttgactgaacatgcaagtcgtaaagaattacaagatgccgagcttttatatcaacaattaaaagtagaaatggcggatattcttgagccagtagcacgaccgttagagattgatagcacgaaaaaaccttatgtgattttaatggtgggcgtaaatggcgtgggtaaaacgacgacaattggtaaacttgcacgtaaatttcaggctgaaggaaaatcggtgatgctcgcagcaggtgatactttccgcgcagcggctgttgagcagcttcaagtttggggagaacgcaatcatattccagttgttgcgcaaagcacgggttctgattctgcgtctgtgatttttgatgcgatgcaatcagcggctgcacgcaatattgatattcttattgcggatacggcgggtcgtttacaaaataaaaataacttaatggacgaactgaaaaaaattgttcgtgttatgaaaaaatatgacgaaactgcaccacatgaaattatgcttacgctggatgctggcacggagttagccggtgcttcttctgtatttaacgtcaatttgatgtgctat

SEQ ID NO: 3482 - protein, 355 aa, Haemophilus influenzae
  Name: NTH1938
MNDIFIGLQLREHFMAEENKKGGFWASLFGRNKKQDEPKIEPIIEEEKIKDIEPSIEKFETHDLVEEEKIQEISTALEPIEEIIEAKKLEDELQPVAEIETREKPSEGGFFSRLVKGLLKTKQNIGAGFRSFFLGKKIDDELFEELEEQLLIADIGVPTTSKIVKNLTEHASRKELQDAELLYQQLKVEMADILEPVARPLEIDSTKKPYVILMVGVNGVGKTTTIGKLARKFQAEGKSVMLAAGDTFRAAAVEQLQVWGERNHIPVVAQSTGSDSASVIFDAMQSAAARNIDILIADTAGRLQNKNNLMDELKKIVRVMKKYDETAPHEIMLTLDAGTELAGASSVFNVNLMCY

SEQ ID NO: 3483 - DNA, 1866 bp, Haemophilus influenzae
  Name: NTH1939
atgtcatctattaaatatcgtccagaaattgatggactacgcgcaattgctgttatttcagtcattatttatcatcttaatgaaaactggttatcaggcggttttcttggggtggatattttctttgttatttctggttttctgattacgggtattattatcacagaaattcaacagaattctttttcgcttaaacaattttatactcgacgtattaaacgaatttatcctgcttttattacagtgatggcattagtgtctttcattgcgtctgttatttttatttataatgatttcaataaattaagaaaaaccattgaattagctattgcattcctatctaatttctatctaggattaacacaaggttattttgatttaagtgcaaatgaaaaccctgtattacatatttggtcattagccgtagaagaacaatactatcttatttttccactaatcctcattttagcttataaaaagtttagagaaattaaagtattatttattataacgctaattttattttttattttacttgccacctcttttattccagctaatttttacaaagaagtattgcatcagcctaatatttattatctctccaacctaagatttcctgaattacttgtaggatctttgttggcaatttatcataatctttcagcaagcaagcaagcaagcaagcaagcaagcaatgttattgcaatattaagtacattactattattttcctgcttatttttaatgaataatgatattgcatatattccaggtattactttaattctcccttgtatttttacagcattaattattcataccacatcacaaaataacattattaaattatgtttatccaataaagtgatagtatttattggaaaaatctcttattccctttatttataccattggatttttattgcgtttgcttattatataacgggcgaaaaacaaattaataatcaatctatcgctatagtaataatattaacaataattttttcagttctaagttattatttaatcgaacaaccaattagaaaatcgaaactaaactttaaacaaagttttctttatatttattttattccttctcttttactcttaggatttaatctttataaaagacaaacaatacgagctgaaaaagaacacattgaacaatcaattcctgtttctaatgaaaatcattatcctgctaaggtcattattttaggcgattctcattcttcacatttagaagcttttctaaactatgcgggaaataaagaaggctggaaagcagatattttcaaagataaatttgaatgtagctttattgtgaatgaacaatatcaattagatcctaattgccaatctgtatggcagaaagattctcaatataaagcgatatttatttcagcattttatgacttgagaatgggcggacagccagtacctcgctttagacccgaaactttcatagagccagattttaaagcacgttttaaaaacacagtgaaacaactagcgatgcaaaagcccgtatatgtttttgctaataatagctcagtaagccgttctccactgcgtggttacttattagaaaattatggacttgaaaaatatttaacgccaattcatcgtatgggcgatattgatgcgagtaacaaaattattcatgatttagtcaaagatattcctaatgtttattgggtagatgctcaacagtatttaccaaaagatagtgttatggcagaaggaaaatacttgtatggggatcaagatcacttaacaaattttggtgcttactatatggcaaaagaatttagtaaatatcaacgagtgatgacacctgaacaagtgaaaaaactctacgag

SEQ ID NO: 3484 - protein, 622 aa, Haemophilus influenzae
  Name: NTH1939
MSSIKYRPEIDGLRAIAVISVIIYHLNENWLSGGFLGVDIFFVISGFLITGIIITEIQQNSFSLKQFYTRRIKRIYPAFITVMALVSFIASVIFIYNDFNKLRKTIELAIAFLSNFYLGLTQGYFDLSANENPVLHIWSLAVEEQYYLIFPLILILAYKKFREIKVLFIITLILFFILLATSFIPANFYKEVLHQPNIYYLSNLRFPELLVGSLLAIYHNLSASKQASKQASNVIAILSTLLLFSCLFLMNNDIAYIPGITLILPCIFTALIIHTTSQNNIIKLCLSNKVIVFIGKISYSLYLYHWIFIAFAYYITGEKQINNQSIAIVIILTIIFSVLSYYLIEQPIRKSKLNFKQSFLYIYFIPSLLLLGFNLYKRQTIRAEKEHIEQSIPVSNENHYPAKVIILGDSHSSHLEAFLNYAGNKEGWKADIFKDKFECSFIVNEQYQLDPNCQSVWQKDSQYKAIFISAFYDLRMGGQPVPRFRPETFIEPDFKARFKNTVKQLAMQKPVYVFANNSSVSRSPLRGYLLENYGLEKYLTPIHRMGDIDASNKIIHDLVKDIPNVYWVDAQQYLPKDSVMAEGKYLYGDQDHLTNFGAYYMAKEFSKYQRVMTPEQVKKLYE

SEQ ID NO: 3485 - DNA, 1140 bp, Haemophilus influenzae
  Name: NTH1940
atgataaaagaatgtcaaaatccaccgcactttagagtcatttcagataatgctgcactattggaaatttgtaatttggctcagatgaaaagtgcggttgccctagatacagaatttatgcgtgtttccacttattttcctaagttgggattaatccagctttatgatgacgagcgcgtctctttaattgatcctttagcgattacggatttttctccttttgtcgcattgttatccaaccctaaggtattaaaaatcttacattcttgtagtgaagatttattggttttcttacaagaatttgatcagcttccacgcccaatgattgatacacaaattatggcgcgctttcttgggcttggcacatcagcaggattggcaaaattagcacaacaatatttaaatatagaaatcgataaaggcgcaactcgcaccaattggatcaaacgccccctttctgatattcaacttcaatatgccgcaggcgatgtttggtatttgttaccgctttatcatattcttgaaaaagagttagcgaaaacaccttgggaacaagcagtaagagatgattgcgaactggctcttgctaaaacacataaattacaagagcgagattcagaaaaagcttatttagatattccaaatgcttggaaattaaatccatttgaattgtctcgtttaagaattttggctcagtggcgacaaaacgtcgcaatagagcgtgatttagcactttcttatattgtgaaatccgataatctttggaaagtggcaaaaaataatccacgtaatacatctgaaatgttagaaatgggattaactgaaaatgaagtacgcgtgcgtggtaaaaagattttacaattgcttgctcaagcaagacgcgtttcgcctaatgattacccaaaacctattgaacgtatttctgaagatcctcgttataaaaaaacaattcgattgttacaagaaaaagtgaatagcttaacaccagcaggtttaacccctgaaatccttgcgagtaaacgcactttggatgaattaattaaatgggtttggaaatatgattgttctcaagacaaactccccgagctgctgattggatggcgtaaacctattgctgaaaagttagtggatatacttaaa

SEQ ID NO: 3486 - protein, 380 aa, Haemophilus influenzae
  Name: NTH1940
MIKECQNPPHFRVISDNAALLEICNLAQMKSAVALDTEFMRVSTYFPKLGLIQLYDDERVSLIDPLAITDFSPFVALLSNPKVLKILHSCSEDLLVFLQEFDQLPRPMIDTQIMARFLGLGTSAGLAKLAQQYLNIEIDKGATRTNWIKRPLSDIQLQYAAGDVWYLLPLYHILEKELAKTPWEQAVRDDCELALAKTHKLQERDSEKAYLDIPNAWKLNPFELSRLRILAQWRQNVAIERDLALSYIVKSDNLWKVAKNNPRNTSEMLEMGLTENEVRVRGKKILQLLAQARRVSPNDYPKPIERISEDPRYKKTIRLLQEKVNSLTPAGLTPEILASKRTLDELIKWVWKYDCSQDKLPELLIGWRKPIAEKLVDILK

SEQ ID NO: 3487 - DNA, 1686 bp, Haemophilus influenzae
  n 158: n is any nucleotide
  Name: NTH1941
atggaaaaaatttggtttcaaaattatccagaaggttctgaaaaatttctagatacctcaaaatatgaatctattttggatatgttcgacaaagcagtgcgcgaacatccagatcgccccgcttacattaatatggggcaagtacttactttccgtanattagaagagcgcagtcgtgcatttgccgcatatttgcaaaatgaatttaaacttcaacgtggagatcgcgtggcattgatgatgccaaatttattgcaatatcctatcgcactttttggtattttacgggctggcttaattgcagtaaatgtcaatcctctttatactccgagagaattagagctccagttgcaagatagtggtgcggtagcgattgtcgtggtatcaaattttgcttctaccttggaaaaagtcgttttcaataccaatgttaaacacgttattcttacccgaatgggcgatcaactttcttttggtaaacgtactttagtcaatttcgtcgtaaaatatgtgaaaaaactcgtgccgaaatataaattaccgcacgcagtaacattccgtgaagtattgagtattggtaaatatcgccaatatgttcgtccagaaatatcgcgtgaggatttagcctttttacaatatactggcggtacaactggcgtggcgaaaggtgcaatgctgacacacggaaatattataaccaatgtcttccaagctaaatggattgcagagccatttattggcgatcattctcgcactcgttcagctattttagccttgcctctttatcacgtatttgccttaacggtaaactgcttattatttttagagttaggtatcacggcgattttaattactaatccgagagatattgaaggatttgtgaaagagttgaaaaaataccgttttgaagcaatcactggtgtaaataccttatttaatgccttgttaaataatgaaaatttcaaagaagttgatttttctgcgttgaaactttctgtgggtggcggtatggctattcaacaatcagtggcaacacgttggcacgaattgacgggctgtaacatcattgaaggttatggaatgacggagtgttcgccattaatcgccgcttgtccaattaatgttgtgaaacataatggcactattggtgtgccagtgccaaatacggatataaaaatcattaaagatgatggctctgatgcaaaaattggcgaagctggcgaattatgggtgaaaggcgatcaagtaatgcgaggttattggcaacgacctgaagcaacgagtgaagtgttaaaagacggttggatggcaactggcgatattgtcattatggatgaatcatatagcttacgcattgtggatcgtaaaaaagatataattttggtttctggctttaatgtctatccaaatgaaattgaagatgtcgttatgctgaattacaaagtgtctgaggctgtggcaattggtattcctcacgcagtttctggcgaaacgataaaaatctttgtggtgaaaaaggacgatagtttaactcgtgatgaacttcgcaaccattgtcgtcaatatctcacaggctataaagtgccaaaagaaattgagttccgagacgaactgccaaaaaccaatgttggcaagattttacgtcgggttttacgcgatgaagagatcgcaaaacgtccaaaacat

SEQ ID NO: 3488 - protein, 562 aa, Haemophilus influenzae
  Xaa 53: Xaa is any amino acid
  Name: NTH1941
MEKIWFQNYPEGSEKFLDTSKYESILDMFDKAVREHPDRPAYINMGQVLTFRXLEERSRAFAAYLQNEFKLQRGDRVALMMPNLLQYPIALFGILRAGLIAVNVNPLYTPRELELQLQDSGAVAIVVVSNFASTLEKVVFNTNVKHVILTRMGDQLSFGKRTLVNFVVKYVKKLVPKYKLPHAVTFREVLSIGKYRQYVRPEISREDLAFLQYTGGTTGVAKGAMLTHGNIITNVFQAKWIAEPFIGDHSRTRSAILALPLYHVFALTVNCLLFLELGITAILITNPRDIEGFVKELKKYRFEAITGVNTLFNALLNNENFKEVDFSALKLSVGGGMAIQQSVATRWHELTGCNIIEGYGMTECSPLIAACPINVVKHNGTIGVPVPNTDIKIIKDDGSDAKIGEAGELWVKGDQVMRGYWQRPEATSEVLKDGWMATGDIVIMDESYSLRIVDRKKDIILVSGFNVYPNEIEDVVMLNYKVSEAVAIGIPHAVSGETIKIFVVKKDDSLTRDELRNHCRQYLTGYKVPKEIEFRDELPKTNVGKILRRVLRDEEIAKRPKH

SEQ ID NO: 3489 - DNA, 549 bp, Haemophilus influenzae
  Name: NTH1942
atgaaaggaaaaatcaccttattttttaccgcactttgcttgggattaacgggctgtattgcaccaccaaaagggttagaaaaagagcgattctcaattaattcctatcgcgagatttctcctcaggatttgacctgtcattgtaaaacagttcgacttggaggaaaaattatcaatactaccgttttagcaaatcaaacaaaaattgaagtgttaagtttacccgtatcatcaatttcaggtaaaccatttgttgaattgcaatccgatggtcgctttatcgtgtatttcaacggttttgttgagcctgaaaatttaaaagaacgttatattactgtaggtggtcaattagctggaacagagaaaggcaaaatagaacaagctgattatacttatcctgttgttcaagcggataaataccgtatttggacactcagtaccatctatgagtatccaacagatgattgggatgaagatgatgattggggattttttagatggagatatcgcccttggtatgttcagcctgaaattcgctattatttgaat

SEQ ID NO: 3490 - protein, 183 aa, Haemophilus influenzae
  Name: NTH1942
MKGKITLFFTALCLGLTGCIAPPKGLEKERFSINSYREISPQDLTCHCKTVRLGGKIINTTVLANQTKIEVLSLPVSSISGKPFVELQSDGRFIVYFNGFVEPENLKERYITVGGQLAGTEKGKIEQADYTYPVVQADKYRIWTLSTIYEYPTDDWDEDDDWGFFRWRYRPWYVQPEIRYYLN

SEQ ID NO: 3491 - DNA, 708 bp, Haemophilus influenzae
  Name: NTH1943
atgcaaaatttaactttattggcgttggacacctctactgaagcctgttctgtcgctttattgtatcgtggtgagaaaacacatattaatgaacttgcccaacgtacacacactaaacgaattttacctatgatcgatgaaattttggtaaattcgggtttaggtttaaatcaagttaatgctttagcttttgggcgtgggcctggtagttttactggtgttcgtgttggtgctgggattgcacaaggtttagcgtttggtgcggatttgcctgtcattccaatttcaaatttaaccgcaatggctcaggcagcatttgaattacatcaagcagaaaatgttgttgccgcaattgatgcgagaatgaatgaagtctatttttctcaagtagtgagagaaaaagtgcggtcagattttggagaagtttttcaatggcgagaaatcattagagaacaagtttgttctccagaacaagcgattaaccagcttcaaaatgataacgcatttagagtcgggacaggttgggctgcttattctcaatttactaaaaaaaatctaactggctcagatatagcattacctaatgccttatatatgttagaacttgcgcgagtagaatttttgcaaaaacacacaattccagctttagaaattgaaccgatttatttgcgaaacgaggttacttggaaaaaattaccagggcgtgaa

SEQ ID NO: 3492 - protein, 236 aa, Haemophilus influenzae
  Name: NTH1943
MQNLTLLALDTSTEACSVALLYRGEKTHINELAQRTHTKRILPMIDEILVNSGLGLNQVNALAFGRGPGSFTGVRVGAGIAQGLAFGADLPVIPISNLTAMAQAAFELHQAENVVAAIDARMNEVYFSQVVREKVRSDFGEVFQWREIIREQVCSPEQAINQLQNDNAFRVGTGWAAYSQFTKKNLTGSDIALPNALYMLELARVEFLQKHTIPALEIEPIYLRNEVTWKKLPGRE

SEQ ID NO: 3493 - DNA, 474 bp, Haemophilus influenzae
  Name: NTH1944
atgatgcgtggtttagctgaatatttccgtgaaaaaagtcatctttcgattttattacaaggcgaaacctcaaaaggcaaattactcgaacaatttataaaagaaacgcatagcgttttggtggcaacttctagcttttgggaaggtgtagatgtacgcggagatgcactttctttagtgattattgataaacttccctttaccgcaccagatgaacctttgttgaaagctcgcattgaggattgtcgtttacaaggtggcgatccattcaatgatattcaaattcctgaagcggtaattaccttgaaacaaggcgttggacgtttaattcgtgatgttacagatcgtggcgttgtgattatttgtgataatcgattagtgatgcgcaattatggcgaaacttttttgaaaagtttacctaactcaagtcgtacccgtgatctcaacaaagtgatacaattcttacaaaataag

SEQ ID NO: 3494 - protein, 158 aa, Haemophilus influenzae
  Name: NTH1944
MMRGLAEYFREKSHLSILLQGETSKGKLLEQFIKETHSVLVATSSFWEGVDVRGDALSLVIIDKLPFTAPDEPLLKARIEDCRLQGGDPFNDIQIPEAVITLKQGVGRLIRDVTDRGVVIICDNRLVMRNYGETFLKSLPNSSRTRDLNKVIQFLQNK

SEQ ID NO: 3495 - DNA, 150 bp, Haemophilus influenzae
  Name: NTH1945
gtggtattgcggtttatttgtgggctcatgcaattgaaagcggggttaaatgcggcaggctttccaacggtaacgggagggggatttaaaagtgattttcccgctggtagctgtgaagtcggcacccctcttccgcttttttgccaatgt

SEQ ID NO: 3496 - protein, 50 aa, Haemophilus influenzae
  Name: NTH1945
VVLRFICGLMQLKAGLNAAGFPTVTGGGFKSDFPAGSCEVGTPLPLFCQC

SEQ ID NO: 3497 - DNA, 186 bp, Haemophilus influenzae
  Name: NTH1946
atgattgtacgtaatattgaagcgcgtttaattcgtgttggcggcgagtttatcgcccctaatcaagaggtggaaattgccgatgatgcggtagggcttgatcgtttaattgaacgtggcgtattaattgacgtaacgccgaaagcggaagatgcgaaaaaagacggcaaaagtaaaaagcaggag

SEQ ID NO: 3498 - protein, 62 aa, Haemophilus influenzae
  Name: NTH1946
MIVRNIEARLIRVGGEFIAPNQEVEIADDAVGLDRLIERGVLIDVTPKAEDAKKDGKSKKQE

SEQ ID NO: 3499 - DNA, 999 bp, Haemophilus influenzae
  Name: NTH1947
atgtttaacgatgccctaagtgaaaacttggggcttttttattggagaaaaataatgacagatattcgtcaagatgcatttgagttgaatgcgattaagacttgtttaaatgcggtgggtgtatttaaccaagatgcgggcttgtttacgcaacgccaattagagtttgtgcgcaacaaaatctatgaagaaaaattaccgggtatgaatggcttatcgctcgtcccagtctcttctgaatcccctgaatgggcagaaaccgtgactgaacgcatttacgatatggtcggcatggctaaagtcgttgccaactatgccgatgatttaccgcgtgcggatgtggcgatgacagaacgtgcagtaaaagtgaaaaacatcggtgctgcttatggctacaatctacaagagttgaaagcggcgtcagctaatcaaacggatttaccgtcttctaaagctcgtgcagcgcgtcgtgcggtggaagtaaagatgaacgaaattgccttgttaggagataaagaatttggtttaaacggctttattaaccacccgaatttaggagaaacctcggtaactggtggctggaaaactgcaacggcggatgcggtgctagcggatttggacaatctacacgataccgtcgtgttgcaatcaaaaggcgtgcatcagccaacacacttattgttgtcgctaacagattatcagacgttatccagtaagtatatgaacacggctgacaaagtggacgtattgacgttcttcaagcgtaaacatcctaacttaactattcagggcttatgggaattagagaaagcgggtacagggaataaaaacttagcgatttgctatgaaaaatcccttgataacttaactcttgaaactccgcaagattttacccagttaccggcacaagaacgcaatttagagcttgttgtgaactgtgtggctcgtgtgggcggcgtgttcttacgttatccgttatcggcaaccaaagcggagatt

SEQ ID NO: 3500 - protein, 333 aa, Haemophilus influenzae
  Name: NTH1947
MFNDALSENLGLFYWRKIMTDIRQDAFELNAIKTCLNAVGVFNQDAGLFTQRQLEFVRNKIYEEKLPGMNGLSLVPVSSESPEWAETVTERIYDMVGMAKVVANYADDLPRADVAMTERAVKVKNIGAAYGYNLQELKAASANQTDLPSSKARAARRAVEVKMNEIALLGDKEFGLNGFINHPNLGETSVTGGWKTATADAVLADLDNLHDTVVLQSKGVHQPTHLLLSLTDYQTLSSKYMNTADKVDVLTFFKRKHPNLTIQGLWELEKAGTGNKNLAICYEKSLDNLTLETPQDFTQLPAQERNLELVVNCVARVGGVFLRYPLSATKAEI

SEQ ID NO: 3501 - DNA, 417 bp, Haemophilus influenzae
  Name: NTH1948
atgtctatgtacgatcaattacaacaaaaagcctttgctggtatgaaaggcgacagccgttacgatttagtcgaaacctttgcagcagaaaatgaaatcccattcggcgtagtgattacgcaagggacgagtgccacacaagctaaattaggtggcactaagcccattggcattgcgttacattcccatgctgtagtaggcggttatgcgaaatttgatgcggtttccgtattgcgtaaaggggttgcgtggtgtgtagtgaaagacagtgaagcgattacggcaggaagtgcggtaagttttgaccccgcttcaggcaaggtggcaaaaactggtacggcattaccgaatgcaacctttaaaaccgccgtagtggattgcggtaaatatggcaagctcgcattagtcgagttagct

SEQ ID NO: 3502 - protein, 139 aa, Haemophilus influenzae
  Name: NTH1948
MSMYDQLQQKAFAGMKGDSRYDLVETFAAENEIPFGVVITQGTSATQAKLGGTKPIGIALHSHAVVGGYAKFDAVSVLRKGVAWCVVKDSEAITAGSAVSFDPASGKVAKTGTALPNATFKTAVVDCGKYGKLALVELA

SEQ ID NO: 3503 - DNA, 1071 bp, Haemophilus influenzae
  Name: NTH1949
atggtaatgcgatacgaccgccgtggcattcaggcacggcgagatgataacggttttatttatgacacccctattctgacaagaagtggggtgtttgtttatgagcttcctaatggcaaaactcggcgtgaatatcgtccgcctgatgaagtatttaaggcggatagtttacgcgcttacaagggattgccgattacagaagatcatcacggacttgtgacgaaaaataatgcgcatttggtggtgggctctatcttaacggaaggtaaacaagatgggcaaaatttaacggcagatattgtgatccacaatacgaaagccgttgattttggaaaaaaagaattgtcggttggctataaggtagatattgacgagacgagcggtataacagaagacggcgagccgtatgatgtgatccagcgtaatattcgtcctaaccatttagccattgtgacagttgggcgtgcaggcaatgccgcacttaatttagatgcggcagatgccgtggaatttaacgaagatggagaaaatccgatgagtaacactcaaacaacgctttctgacattcgcttagatagcggcattacgtatcaagccgcgcccgaagtgattgtggaattaaataaactcaaacaagacgccaaagatgctgtgacggcgaaagacaaagaagcggcgcgcgcagatgcggcagaagcgaaagtgaaagatcttgaagcacaggttgaacaaattaaacaagatgcggtaagtcaagccaaggtgcgtgttgaattagaaaacgtagcgaaagcgcataaggtggaagtgaaagctgatagtaccgaccgtgcgttgcgtgaagcggtaattaaggcaattcgtcaagacaatgcggatttatcgcaaaaatccgatggttatattgaagcagcgtttgatattgcggtaagcgatgccaaacaacgagcggatgcggcaggtgtgcagcgtcagcaattaacaccatcagccacaaatcaacccacattcacgcaggatagccaaacgaaattaactggtcgagctgcgatgattgcaagtcgtaaccaa

SEQ ID NO: 3504 - protein, 357 aa, Haemophilus influenzae
  Name: NTH1949
MVMRYDRRGIQARRDDNGFIYDTPILTRSGVFVYELPNGKTRREYRPPDEVFKADSLRAYKGLPITEDHHGLVTKNNAHLVVGSILTEGKQDGQNLTADIVIHNTKAVDFGKKELSVGYKVDIDETSGITEDGEPYDVIQRNIRPNHLAIVTVGRAGNAALNLDAADAVEFNEDGENPMSNTQTTLSDIRLDSGITYQAAPEVIVELNKLKQDAKDAVTAKDKEAARADAAEAKVKDLEAQVEQIKQDAVSQAKVRVELENVAKAHKVEVKADSTDRALREAVIKAIRQDNADLSQKSDGYIEAAFDIAVSDAKQRADAAGVQRQQLTPSATNQPTFTQDSQTKLTGRAAMIASRNQ

SEQ ID NO: 3505 - DNA, 810 bp, Haemophilus influenzae
  Name: NTH1950
atgacgatgatgttgaaaagtatcaagaagaacagaaagccaaaggtgtggttgtttcctcacgcaattgagcgtgaatatgtgggttatttacgtggtgtggcgagaaacattaatacgatggttaatcaaaaactcgttgaaattcgaccgcactttcaggcaaatattcgacaagatagtttttctgatacgcttgaacgttggcttattgaattattgcaagcagtattgatttttgttgatgaaaaagaaattacgcagtttgtgcgtggctatattcatcagacggcgaattttaacggcaagcagtttcataaagtgctgaaatcagtttatagcgtcgatgttttcacgactgaaccttggcttgatgatgcgttaaaaattgcggaatgggaaaatatccgcctaataaaaagccttcctacgcagacgttagaaaaattgcgtagtcgctttactcaagcggtgcgcggtggttggcgttgggaaagcgtggtagatgatgtgaagtctatccttaacaccaacgagaaacgtgcaacattaattgctcgtgaccaaattggcaagttaaacggtcatttgacgaagttgcgccagcaaaatatcggcgtgaagtcgtatatttggcgcggtatgcttgatgagcgtgagcgggcgccccacgttgatcgtgagggtaaacaatttgattgggataatccacctgatgacggacatccgggggagcctattttatgtcgttgctatgcggaggcggtattccctgaatttgaagatctaaacggtgtgatttatgcggag

SEQ ID NO: 3506 - protein, 270 aa, Haemophilus influenzae
  Name: NTH1950
MTMMLKSIKKNRKPKVWLFPHAIEREYVGYLRGVARNINTMVNQKLVEIRPHFQANIRQDSFSDTLERWLIELLQAVLIFVDEKEITQFVRGYIHQTANFNGKQFHKVLKSVYSVDVFTTEPWLDDALKIAEWENIRLIKSLPTQTLEKLRSRFTQAVRGGWRWESVVDDVKSILNTNEKRATLIARDQIGKLNGHLTKLRQQNIGVKSYIWRGMLDERERAPHVDREGKQFDWDNPPDDGHPGEPILCRCYAEAVFPEFEDLNGVIYAE

SEQ ID NO: 3507 - DNA, 1314 bp, Haemophilus influenzae
  Name: NTH1951
atggcatttaatcaagacggctacgccgaagccttggggattaatcattttgcaagaaattctgcaaattcaaccgcactttttgatttaacgttatatgagttaggtggtttagccgcacgggtggtcgatatgccagcagatgcggcgatttcacgttcgattgaaattcaaggcgatcaagatgatgcgattagcaatgagattgaacggttgaagattttgcctgcattggcagatatggtgcgttggtcgcggttttttggtggtgcggttatggttttattgaccgatgacggtgcgcgattaagtgagccgttagagccaagtcgcattacacgtatcgatgaagtgcgagtgtttgatttaagtcaaatttcgcctacggctaatcgctattccgatccaaccaagccaaattatggtcgctattccagttatcggttaaatatcggtacgattgctggttcgcttgatagtcaggtagaaatccatgaaagccgtttgttatttatgggcggcgattcattgccagaacgtctaaaaaatggcttacattggattgggcgtagtgcggttagatcggtttatccaaaaattcgtgattatcaaaaatcattgatgtgggcttcgttaattcttgaacgcaaacagcaagcggttcataaaatgaaagggcttgcgttggcaattgataatggattagagcctgttattcgagagcgtatcaatcttgttgaacgtgggcgtagtctgttaaatggcgtagctgttgatagcgaagacgattacaacattctcaatgcggatttaggcgggattgttgatgtgcttgatgaatttaaagtagcgatttcggctgatgtgaatattccagtggcgattttattcgggcagtcagctaaaggtatgaacgccacaggacagagcgattttgaaagctattacgatttggtcgaaagtattcagcaacataaaatcaagccagtgcttgaaaagctgattgagctattgatgtttcaaaagcatattaagccgtttgagaactggaaaatcaaattcccgtcgcttaatacaccaactgacaaagaaatagccgatgtgcgtaaaacgaatgcggatgcagcgaaaatcgagcttgatcgcttaattaatttggttgattcgggtgcgttatccacagaagaattgcgagtacagattgctggagagtttggcattcaagcggacaaattgccacaggtagatgacgatgatgttgaaaagtatcaagaagaacagaaagccaaaggtgtggttgtttcctcacgcaat

SEQ ID NO: 3508 - protein, 438 aa, Haemophilus influenzae
  Name: NTH1951
MAFNQDGYAEALGINHFARNSANSTALFDLTLYELGGLAARVVDMPADAAISRSIEIQGDQDDAISNEIERLKILPALADMVRWSRFFGGAVMVLLTDDGARLSEPLEPSRITRIDEVRVFDLSQISPTANRYSDPTKPNYGRYSSYRLNIGTIAGSLDSQVEIHESRLLFMGGDSLPERLKNGLHWIGRSAVRSVYPKIRDYQKSLMWASLILERKQQAVHKMKGLALAIDNGLEPVIRERINLVERGRSLLNGVAVDSEDDYNILNADLGGIVDVLDEFKVAISADVNIPVAILFGQSAKGMNATGQSDFESYYDLVESIQQHKIKPVLEKLIELLMFQKHIKPFENWKIKFPSLNTPTDKEIADVRKTNADAAKIELDRLINLVDSGALSTEELRVQIAGEFGIQADKLPQVDDDDVEKYQEEQKAKGVVVSSRN

SEQ ID NO: 3509 - DNA, 1212 bp, Haemophilus influenzae
  Name: NTH1952
gtgcgggtgttttgcgggcgagaattgcagaactcgatgagcgatagtgtgattaaacttattgcggatacgatagaagatcttggctatctagaagagtttgaagtacagcgcaatgcgatttactgcttgaaaaccggctcggagtttatgttttatggcataaagaacaatccgaacaaaattaaatcgcttgaggggattgatttggtatggattgaagaagccgaaaacgtctctaatgagagttgggatattttaattccgactattcgtaaagagcgatctgaaatttgggtgacatttaacccgaaaaatattcttgatccgacctatcagcggtttgttattgcgccgcctaaaaattcgttcgttcgcaaaatcaactacgatgaaaacccttatttccctgaaacgttacgccttgaaatggaagaatgcaaagagcgtgactatgaactgtatcggcatatttggctaggtgagccagttgctgatagtgacaaggttatcattaagccggtatggattgaatgtgcagttgatgcgcataagaaattgggctttttgcctgccggtcgcaagattgtgggctttgatgttgcagatgacggcgtggatagtaacgccaatgcgtttgttcacggatccgtggtgttgcgtgttgatgaatggcgcggggaagatgtgattggtagtgcagacagaactcggcttaatgcattggaatttggcgcaaatgaaattgtttacgatagcatcggcgtgggtgccggtgtaaaagcacactatcatcgcctagacgataaatccattcgtattaatggctttaatgctgggggcgcggtatttgaacctgatgcagaatatgtttatggtaaaaccaatcgcgatatgttcgccaatattaaggctcaggcgtggtggcgtttacgcgatcgtttctataaaacctatcgggcgataacgtatgaagagcaatatcccgttgatgagatgattagtctttcttccgatataagggatttggaatatttaaaagcagaattggctcgcccttatgtggattatgacggtaatgggcgtgtaaaagtagaaagtaagaaagatatgaaaaagcgtggcattccgtcaccgaataaggcggatgcgttggtaatgtgtttcgcaccgaaagaagatgtattgtcgcgtttcattgggttaggaagt

SEQ ID NO: 3510 - protein, 404 aa, Haemophilus influenzae
  Name: NTH1952
VRVFCGRELQNSMSDSVIKLIADTIEDLGYLEEFEVQRNAIYCLKTGSEFMFYGIKNNPNKIKSLEGIDLVWIEEAENVSNESWDILIPTIRKERSEIWVTFNPKNILDPTYQRFVIAPPKNSFVRKINYDENPYFPETLRLEMEECKERDYELYRHIWLGEPVADSDKVIIKPVWIECAVDAHKKLGFLPAGRKIVGFDVADDGVDSNANAFVHGSVVLRVDEWRGEDVIGSADRTRLNALEFGANEIVYDSIGVGAGVKAHYHRLDDKSIRINGFNAGGAVFEPDAEYVYGKTNRDMFANIKAQAWWRLRDRFYKTYRAITYEEQYPVDEMISLSSDIRDLEYLKAELARPYVDYDGNGRVKVESKKDMKKRGIPSPNKADALVMCFAPKEDVLSRFIGLGS

SEQ ID NO: 3511 - DNA, 696 bp, Haemophilus influenzae
  n 661: n is any nucleotide
  Name: NTH1953
atgaaaaaaacacttgcagcattaatcgttggtgcattcgcagcttcagcagcaaacgcagctgttgtttataacaacgaagggactaacgtagaattaggtggtcgtttaagcattatcgcagaacaaagtaatagcactataaaggatcaaaaacagcaacacggtgcattacgcaatcaaagttcacgtttccacattaaagcaactcataacttcggtgatggtttctatgcacaaggttatttagaaactcgtttagtttcagctcaatctggaaccgagtcagataacttcggtcatattataaccaaatatgcttatgtcactttaggaaataaagcattgggtgaagtaaaacttggtcgtgcgaaaactattgctgatggcataacaagcgcagaagataaagaatatggtgttctcaacaatagcaaatatattcctactaatggtaataccgttggctacacttttaaaggtatcgatggtttagtattaggtgctaattatttattagcacaagagcgtcataagtatactactgctgctggtactcgtgctgttactggtgcaggagaatgttatccacaaaaatcagcatggcgttcaggttggtgcaaatatgatgcaaacacattattgcagtattgcttatggncgtacaattatagagaagatattgttgacccagat

SEQ ID NO: 3512 - protein, 232 aa, Haemophilus influenzae
  Xaa 221: Xaa is any amino acid
  Name: NTH1953
MKKTLAALIVGAFAASAANAAVVYNNEGTNVELGGRLSIIAEQSNSTIKDQKQQHGALRNQSSRFHIKATHNFGDGFYAQGYLETRLVSAQSGTESDNFGHIITKYAYVTLGNKALGEVKLGRAKTIADGITSAEDKEYGVLNNSKYIPTNGNTVGYTFKGIDGLVLGANYLLAQERHKYTTAAGTRAVTGAGECYPQKSAWRSGWCKYDANTLLQYCLWXYNYREDIVDPD

SEQ ID NO: 3513 - DNA, 1098 bp, Haemophilus influenzae
  n 1089, 1090, 1091, 1092, 1093: n is any nucleotide
  Name: NTH1954
atgcgtgtttcagactttaactttgatttacccgatgaattaattgctcgttatcctaaaactgatcgtgtttcttgtcgtttattacagttaaatggtgaaaacggagaaatttttcaccgcactttttctgatgtattagatttaattgatcaaggcgatttattgatttttaataatacgcacgttattcctgcaagaatgtttgggcgtaaagccagtggtggaaaaattgaagttttagttgagagaatgttagatgaacatcgtttcttagcgcatattcgttcatcgaaatcccctaaagaaggggctgaattatttttaggggaagataaattaggcgaaaataatggcattaaagcagtaatgaaagctcgtcatagctcgttgtttgaagtggaattaagtgataaatcaaccgctcttttagatgtgttgcaaaccattgggcatatgccattaccgccttatatcgatcgtccagatgaagaagccgataaagaatgttatcaaacggtttatagtaaagtaccaggtgcggtagcagcaccaacggctggtttgcattttgataaaaatttacttgaaaaactcaaagcaaagggtgtgaattttgaatttgttacattacatgtaggcgcaggaacattccagcctgttcgtgtggaaaatattgaagatcatgtgatgcatgcagaatacgtagaagtttctcaagaagtttgcaatgcgattatcgcaacaaagaaagcgggcaaacgtgtaattgcagtgggaactacttctgttcgttctattgaaagtgcggcactttctgcggaagaatttggcaatccagatttaattgagccttatttttctgatacctctatttttatttatccagggaaaaaattccgagtggtggattgcttaattactaatttccacttacctgaaagcactttgattatgttagtttcagcttttgctggttataaaaataccatgaatgcgtataagcatgcagtgcaagaaaaatatcgttctttagttatggcgggggattctataagagtcgacctggcaggccagccaagtctggcnnnnnttaat

SEQ ID NO: 3514 - protein, 366 aa, Haemophilus influenzae
  Xaa 364, 365: Xaa is any amino acid
  Name: NTH1954
MRVSDFNFDLPDELIARYPKTDRVSCRLLQLNGENGEIFHRTFSDVLDLIDQGDLLIFNNTHVIPARMFGRKASGGKIEVLVERMLDEHRFLAHIRSSKSPKEGAELFLGEDKLGENNGIKAVMKARHSSLFEVELSDKSTALLDVLQTIGHMPLPPYIDRPDEEADKECYQTVYSKVPGAVAAPTAGLHFDKNLLEKLKAKGVNFEFVTLHVGAGTFQPVRVENIEDHVMHAEYVEVSQEVCNAIIATKKAGKRVIAVGTTSVRSIESAALSAEEFGNPDLIEPYFSDTSIFIYPGKKFRVVDCLITNFHLPESTLIMLVSAFAGYKNTMNAYKHAVQEKYRSLVMAGDSIRVDLAGQPSLAXXN

SEQ ID NO: 3515 - DNA, 279 bp, Haemophilus influenzae
  Name: NTH1955
gtgactgctgtgtatcaatttgaaaaccaagaaccagttgccgcaatggtaagtgtgggcgatggcattattgcgaaagattttactcgtgataaatcacaaaatgactttacaagtttcgtttctggggattatgtttggaatgtagatagtggcttaacgttagataaatttgattctgttgtgcctgtaaatttaattcaaaaaggtaaatctagcgataacatcatcgttaaaaattgtgatgtaaacgtaaaagcaactaaaaaagcaaattta

SEQ ID NO: 3516 - protein, 93 aa, Haemophilus influenzae
  Name: NTH1955
VTAVYQFENQEPVAAMVSVGDGIIAKDFTRDKSQNDFTSFVSGDYVWNVDSGLTLDKFDSVVPVNLIQKGKSSDNIIVKNCDVNVKATKKANL

SEQ ID NO: 3517 - DNA, 168 bp, Haemophilus influenzae
  Name: NTH1956
ttgcaggaatatacaactgttttatcagttattgttggaagtgtttgcatttcagctatttgcgcagatgattttgtcatttcaggtgcatcctttgcacaagcagataatacgactacagcagcaaatgtgggtaaaattttagttaaattcattattaaatcctct

SEQ ID NO: 3518 - protein, 56 aa, Haemophilus influenzae
  Name: NTH1956
LQEYTTVLSVIVGSVCISAICADDFVISGASFAQADNTTTAANVGKILVKFIIKSS

SEQ ID NO: 3519 - DNA, 4176 bp, Haemophilus influenzae
  Name: NTH1958
atgaaaaaaactgtatttcgtctgaattttttaaccgcttgcatttcattagggatagtatcgcaagcgtgggcaggtcacacttattttgggattgactaccaatattatcgtgattttgctgagaataaagggaagtttgcagtcggtgcgaaagatattgaggtttacaacaaaaaaggggagttggtcggcaaatcaatgacaaaagctccgatgattgattttgcatctgttgctcgtagtggttatgctgcattagtaggcgatcaatatattgtaagtgttgctcacaatgggggatacactaatgctgattttggtgcggaaggacaaaatcccgatcaacatcgttttacttatcaaatagttaaacgtaataattataaacctgatcagaagcatcattataatggggattaccatatgcctcgtttacataaatttgtaactgaaagttctccttttgatatgacaggaagtatgaagggacagacctatgcagacaaagaaaaatacccgatgcgtgtgcggattggttctggtgatcaatattggagaaatgaacaagataaaggaactcaagtagctgaagcttatggatatcttattgcggggaatacccatatgcaaactggtgcaggaaatggagatgttagtttaagtggcgatgtacgtaaaggaaatgattatggacctatgccgacagcaggatcatttggagacagtgggtcacctatgtttatttatgatgctaccgagaaaaaatggcttataaatggtgtattgcgtactggaaacccatccttaggtagagagaatacttttcagctagtccgtaaaaattattttgatgaaattttctctgctaatcttaaaacgaccatatttgatttcagaactcctaaaaatcaacaaaatcagcactacacatttcattcaaaaaatgatgggtcaggcactattacatctggagctggtaaaatttataaagtcaaacttgctaattacaatttatctatgaaaggcacggagcctgtctatactaatggtggtgtaaacaattattctcccgcattaagtcacggcgaaaacctttattttattgattacggaaaaggggtgctaacttttagtaataatatcgatcaaggtgcaggcggtttgtattttgagggagattttatagtttcgcctacccataatgaaacgtggaaaggggcggggatatctatcagtgatgaaagcaccgtaatttggaaagtcaatggcgtagaaaatgatcgcctttctaaaattggtaaaggaacgttacatattcaagcaaaaggtaaaaacttaggctcaattagcgttggcgatggtaaagtaatcttagaacaacaagaggacgatcaacataaaaaacaagcctttagtgaaatcggattggttagcggcagagggactgtccaattaaacgatgataaacaatttgataccgataaattttatttcggctttcgtggtggtcgcttagatcttaatgggcattcattaacctttaaacgtatccaaaatacggacgagggggcgatgattgtgaaccataatacaactgaagtcgctaatgtcactattactgggaacgaaagcattgttctacctaatggaaataatattaataaacttaattacagcaaagaaattgcctacaacggttggtttggcgaaacagatgaaaataaacacaatggacgattaaaccttatttataaaccaaccacagaagatcgtactttactactttcaggtggcacaaacttaaaaggcgatattactcaagaaggcggcactttagtgtttagtggtcgcccaacgccacacgcttacaatcatttaaatcgcccaaacgagcttgggcgacctcaaggcgaagtggttattgatgacgattggatcaaccgcacatttaaagctgaaaacttccaaattaaaggcggaagtgcggtggtttctcgcaatgtttcttcaattgagggaaattggacaatcagcaataacgccaacgccacatttggtgttgtgccaaatcaacaaaataccatttgcacgcgttcagattggacaggcttaacgacttgtaaaacagagaatttaaccgacacaaaagttattaattctataccaacaacacaaatcaatggctctattaatttaactgataatgcaacggcgaatgttaaaggtttagcaaaacttaatggcaatgtcactttaacaaatcacagccaatttacattaagcaacaatgctacccaaataggcaatatccgactttccgacaattcaactgcaacggtggataatgcaaacttgaacggtaatgtgcatttaacgaattctgctcaattttatttaaaaaacagccatctttcgcaccaaattcagggcgacaaaggcacaacagtgacgttggaaaatgcgacttggacaatgcctagcgataccacattgcagaatttaacactaaataacagtactgttacgttaaattcagcttattcagctagtccaaacaatacgccacgccgtcgtcgccgttcattagagacggaaacgacgccaacatcggcagaacatcgtttcaacacattgacagtaaatggtaaattgagcgggcaaggcacattccaatttacttcatctttatttggctataaaagcgataaattaaaattatccaatgacgctgagggcgattacatattatctgttcgcaacacaggcaaagaacccgaaacccttgagcaattaactttggttgaaagcaaagataatcaaccgttatcagacaaactcacattcacgttagaaaatgaccacgttgatgcgggtgcattacgttatgtattagtgaagaataatggcgaattccgcttgcataatccaataaaagagcaggaattgcacaatgatttagtaagagcagagcaagcagaacaaacattagaagccaaacaagttgaaccgactgctgaaacacaaacaagtaaggcaaaagtgcggttaagaagagcggtgttgcctgataccctgcctgctcaaagcctgttaaacgcattagaagccaaacaagctgaaccgaatgctaaaacacaaaaaagtaaggcaaaaacaaaaaaagcgcggtcaaaaagagcattgagagcggtgttttctgatcccccgcctgatcaaagccagttagacgtattaaaagccgcacttgaggttattaatgcccaaccgcaagtgggaaaagaacgtcaagctcaagagaaacaaggcaaacaaaaagacttgatcagccgttactcaaatagtgcgttatcggagttgtctgcaacagtaaatagtatgctttccgttcaagatgaattggatcgtctttttgtagatcaagcacaatctgctgtgtggacaaatatcgcacaggataaaagacgctatgattctgatgcgttccgtgcttatcagcagaaaacgaacttgcgtcaaattggggtgcaaaaagccttagataatggacgaattggggcggttttctcgcatagccgttcagataatacctttgacgaacaggttaaaaatcacgcgacattaacgatgatgtcgggtttcgcccaatatcaatggggcgatttacaatttggtgtaaacgtgggcgcgggaattagtgcgagtaaaatggctgaagaacaaagccgaaaaattcatcgaaaagcgataaattatggtgtgaatgcaagttatcagttccgtttagggcaattgggtattcagccttatttgggtgttaatcgatattttattgaacgtgaaaattatcaatctgaagacgtgaaagtgcaaacaccgagccttgcatttaatcgctataatgctggcattcgagttgattatacgtttaccccgacagataatatcagcgttaagccttatttcttcgttaattatgttgatgtttcaaacgctaacgtacaaaccactgtaaatagcacgatgttgcaacaatcatttgggcgttattggcaaaaagaagtgggattaaaggcagaaattttacatttccaactttccgcttttatctcaaaatctcaaggttcacaactcggcaaacagcaaaatgtgggcgtgaaattggggtatcgttgg

SEQ ID NO: 3520 - protein, 1392 aa, Haemophilus influenzae
  Name: NTH1958
MKKTVFRLNFLTACISLGIVSQAWAGHTYFGIDYQYYRDFAENKGKFAVGAKDIEVYNKKGELVGKSMTKAPMIDFASVARSGYAALVGDQYIVSVAHNGGYTNADFGAEGQNPDQHRFTYQIVKRNNYKPDQKHHYNGDYHMPRLHKFVTESSPFDMTGSMKGQTYADKEKYPMRVRIGSGDQYWRNEQDKGTQVAEAYGYLIAGNTHMQTGAGNGDVSLSGDVRKGNDYGPMPTAGSFGDSGSPMFIYDATEKKWLINGVLRTGNPSLGRENTFQLVRKNYFDEIFSANLKTTIFDFRTPKNQQNQHYTFHSKNDGSGTITSGAGKIYKVKLANYNLSMKGTEPVYTNGGVNNYSPALSHGENLYFIDYGKGVLTFSNNIDQGAGGLYFEGDFIVSPTHNETWKGAGISISDESTVIWKVNGVENDRLSKIGKGTLHIQAKGKNLGSISVGDGKVILEQQEDDQHKKQAFSEIGLVSGRGTVQLNDDKQFDTDKFYFGFRGGRLDLNGHSLTFKRIQNTDEGAMIVNHNTTEVANVTITGNESIVLPNGNNINKLNYSKEIAYNGWFGETDENKHNGRLNLIYKPTTEDRTLLLSGGTNLKGDITQEGGTLVFSGRPTPHAYNHLNRPNELGRPQGEVVIDDDWINRTFKAENFQIKGGSAVVSRNVSSIEGNWTISNNANATFGVVPNQQNTICTRSDWTGLTTCKTENLTDTKVINSIPTTQINGSINLTDNATANVKGLAKLNGNVTLTNHSQFTLSNNATQIGNIRLSDNSTATVDNANLNGNVHLTNSAQFYLKNSHLSHQIQGDKGTTVTLENATWTMPSDTTLQNLTLNNSTVTLNSAYSASPNNTPRRRRRSLETETTPTSAEHRFNTLTVNGKLSGQGTFQFTSSLFGYKSDKLKLSNDAEGDYILSVRNTGKEPETLEQLTLVESKDNQPLSDKLTFTLENDHVDAGALRYVLVKNNGEFRLHNPIKEQELHNDLVRAEQAEQTLEAKQVEPTAETQTSKAKVRLRRAVLPDTLPAQSLLNALEAKQAEPNAKTQKSKAKTKKARSKRALRAVFSDPPPDQSQLDVLKAALEVINAQPQVGKERQAQEKQGKQKDLISRYSNSALSELSATVNSMLSVQDELDRLFVDQAQSAVWTNIAQDKRRYDSDAFRAYQQKTNLRQIGVQKALDNGRIGAVFSHSRSDNTFDEQVKNHATLTMMSGFAQYQWGDLQFGVNVGAGISASKMAEEQSRKIHRKAINYGVNASYQFRLGQLGIQPYLGVNRYFIERENYQSEDVKVQTPSLAFNRYNAGIRVDYTFTPTDNISVKPYFFVNYVDVSNANVQTTVNSTMLQQSFGRYWQKEVGLKAEILHFQLSAFISKSQGSQLGKQQNVGVKLGYRW

SEQ ID NO: 3521 - DNA, 1512 bp, Haemophilus influenzae
  Name: NTH1959
ttgaattttttaccgcactttctctcactggtcaaaaagcacaaattgcggaaaaaatttcttaaagaaatccgcgagcgtttgcagtttttagtcaatgttggtttgaattatctttctctttctcgttctgctgaaactctttcaggtggggaggcgcaacgtattcgccttgcgagtcaaattggtgcgggacttgttggcgtaatgtatgtattagatgaaccctctattggcttgcaccaacgtgataatgaacgcttacttaatacgttaattcatttgcgtaatcttggtaatacggtaattgtcgtggagcacgatgaagacgcgattcgtgcagctgaccatattattgatattgggcctggtgctggcgtgcatggcggacaagttattgcacaaggaaatgccgatgaaattatgctcaatccaaattccatcacgggaaaatttttatcgggcgcagataaaatcgaaatcccgaaaaaacgcaccgcacttgataagaaaaaatggctcaaacttaaaggtgcatcaggtaataacttaagaaatgtgaatttagatattcccgttggtttgtttacttgcgtaactggtgtatctggttcgggaaaatccacacttattaatgacaccttatttccacttgcgcaaaatgcgttaaatagagcggaaaagacggattacgcaccttatcaatctatcgagggattagagcatttcgataaagttattgatattaaccaaagcccaattggacgtacgccacgttcaaatccagccacttatacaggtttatttactccgattcgtgaactttttgcaggggtgccagaggcacgtgctcgtggttataatccaggacgttttagttttaacgtacgaggtggacgctgtgaagcctgtcagggcgacggtgtactcaaagttgaaatgcattttttacccgatgtttatgttccttgcgaccaatgtaaaggcaaacgctataatcgcgaaaccttagaaattcgttacaaaggcaaaacgattcatcaagttttagatatgacggtggaagaagctcgcgagttttttgatgcgattccaatgattgcaagaaaattacaaaccttgatggatgtgggattatcctatattcgattaggtcaatcttccacaacactttcaggcggcgaagcacaacgcgtgaaactagcaacggaactttctaaacgtgatacgggtaaaactttgtatattctagatgaaccgacgactggtttgcatttcgctgacattaagcaattacttgaagtattgcatcgattacgcgatcaaggaaatactatcgtcgtcattgaacacaatcttgatgtgattaaaaccgcagactggattgtcgatcttggcccaaagggaggcagtggcggcggacaaattattgcgacgggtacaccagagcaagttgccaaagtagaaagttcccacaccgctcgcttccttaaaccgattttagaaaaacct

SEQ ID NO: 3522 - protein, 504 aa, Haemophilus influenzae
  Name: NTH1959
LNFLPHFLSLVKKHKLRKKFLKEIRERLQFLVNVGLNYLSLSRSAETLSGGEAQRIRLASQIGAGLVGVMYVLDEPSIGLHQRDNERLLNTLIHLRNLGNTVIVVEHDEDAIRAADHIIDIGPGAGVHGGQVIAQGNADEIMLNPNSITGKFLSGADKIEIPKKRTALDKKKWLKLKGASGNNLRNVNLDIPVGLFTCVTGVSGSGKSTLINDTLFPLAQNALNRAEKTDYAPYQSIEGLEHFDKVIDINQSPIGRTPRSNPATYTGLFTPIRELFAGVPEARARGYNPGRFSFNVRGGRCEACQGDGVLKVEMHFLPDVYVPCDQCKGKRYNRETLEIRYKGKTIHQVLDMTVEEAREFFDAIPMIARKLQTLMDVGLSYIRLGQSSTTLSGGEAQRVKLATELSKRDTGKTLYILDEPTTGLHFADIKQLLEVLHRLRDQGNTIVVIEHNLDVIKTADWIVDLGPKGGSGGGQIIATGTPEQVAKVESSHTARFLKPILEKP

SEQ ID NO: 3523 - DNA, 660 bp, Haemophilus influenzae
  n 101: n is any nucleotide
  Name: NTH1960
atgcgttgtgcaatatgttatcgaagcgaagatttattttcagcaatttgctgtccgcatgtgttatctgtgcagattagagctcgtttatttcctttacnatcctgcagtgcttgcccacttgtgatggctgggtgtgcagcatattttgatgagattcgtgtgtgcaaaatccgactattctcttgctggtggtgcggtaaaaggtgggatcgtcgtaatttctattattatcaaatgctcacctcattggcgaaacattatcattttgatgttgaagcgccctatgaatctttgccaaagaagattcaacatatcattatgcatggctcaggcaaagaggaaattgaattccaatatatgaatgatcgtggcgatgtggttattcgcaagcatccttttgaaggtattttgaataatatggctcgccgatataaagaaacggaatcaatgtcggtgcgtgaagaattagcgaaaaatattagtaatcgaccttgtatagactgtggcggatctcgtttgcgacccgaagcacgtaatgtgtatattggaaaaaccaatttgccgataattgcggaaaaaagcattggcgaaacccttgaattttttaccgcactttctctcactggtcaaaaagcacaaattgcggaaaaaatttct

SEQ ID NO: 3524 - protein, 220 aa, Haemophilus influenzae
  Xaa 34: Xaa is any amino acid
  Name: NTH1960
MRCAICYRSEDLFSAICCPHVLSVQIRARLFPLXSCSACPLVMAGCAAYFDEIRVCKIRLFSCWWCGKRWDRRNFYYYQMLTSLAKHYHFDVEAPYESLPKKIQHIIMHGSGKEEIEFQYMNDRGDVVIRKHPFEGILNNMARRYKETESMSVREELAKNISNRPCIDCGGSRLRPEARNVYIGKTNLPIIAEKSIGETLEFFTALSLTGQKAQIAEKIS

SEQ ID NO: 3525 - DNA, 1152 bp, Haemophilus influenzae
  Name: NTH1962
ttgatagcgtatgcgaccttatttctgcttactttaggattgaaaatgtcggtgtgtaaaccattttggttcaaaactttttctatctcaattattaccgcacttttggtgtcttgtacctctaacataaaaaacattcagattcccaccaccttaaatggtagtgatcctcaacaattcggtgcaaaatataccaatcgaacttatcagcaagcagcgcttgtgcctgtatccaacatagaaaaccaaagtgcggtaataaatcaaggcgattttttaacacagctttccaatataaaaaattattcgagtaaactttccaccaatttttacgacaattatgaaaagattacaaattgggttctttctggggcaaatattaatgaactcactcaatttaatatccatccgcaaattatgcgtggatttgatgggtatcaaaatgtactgatgacaggctattattcgcctatactttatgctcgtcataccccacaaggtcaatttaaaaatccaatttatcgtatgcctgtaaaaaaacgtctaagtcgagcacaaatttatgcgggcgcattaacgggaaaaagattagagttagcatatagcgattcaatgttagaaaactttttacttggtgtacaaggcagtggctatgtagattttggcgatggtaatcttaactattttgcttacgcaggacaaaatggttacccttacacggctatcgggcgtttattagtagaagatggcgaaattccaaaagaaaaaatgtctattcaagcaattcgagaatggggtaatcgtaatccctctcgtgtacaaagcttgttagaacgcaatgaagcttatgtattctttaaaaatgatccaagtggcaaagtgaaaggctctgcgggcgttcctcttgtagcaatggcttcagtggcatcagatcgcaatattatcccgtctggttctgtgcttttagtcgaagtacccgacattgataataacggaaactggattggcacacacaaattacacttaatggttgcacttgatgtaggcggtgcagtgaaaggtcatcactttgacttatatcgtggtatcggtgctagagcaggacatattgcagggctttcaaaacactacggtagagtatgggtattacgg

SEQ ID NO: 3526 - protein, 384 aa, Haemophilus influenzae
  Name: NTH1962
LIAYATLFLLTLGLKMSVCKPFWFKTFSISIITALLVSCTSNIKNIQIPTTLNGSDPQQFGAKYTNRTYQQAALVPVSNIENQSAVINQGDFLTQLSNIKNYSSKLSTNFYDNYEKITNWVLSGANINELTQFNIHPQIMRGFDGYQNVLMTGYYSPILYARHTPQGQFKNPIYRMPVKKRLSRAQIYAGALTGKRLELAYSDSMLENFLLGVQGSGYVDFGDGNLNYFAYAGQNGYPYTAIGRLLVEDGEIPKEKMSIQAIREWGNRNPSRVQSLLERNEAYVFFKNDPSGKVKGSAGVPLVAMASVASDRNIIPSGSVLLVEVPDIDNNGNWIGTHKLHLMVALDVGGAVKGHHFDLYRGIGARAGHIAGLSKHYGRVWVLR

SEQ ID NO: 3527 - DNA, 783 bp, Haemophilus influenzae
  Name: NTH1963
atgggtattacggtaatggctagaatagataattacgaacaacgctttggtggcattgggcgactttatacgcctgatggcttagcgcgcttacgccaagcgcatatttgcgtaataggcattggtggcgtgggttcttgggtcgtggaggccttagcacgttcaggtatttgcgaactcacattaattgatatggatgatatttgcgtcacaaatatcaatcgccaacttcctgcgatgagcggcacaatcggcaaattaaaaactgaagtcatgtcagagcgagtaaaattaattaacccagaatgtaccgtcaatattattgatgattttatctcgccagagaatcaatcggattatctcaaccgaggctatgactacgtcattgatgccattgacaatgtgaaaactaaagcgtcgctgattgcttattgtaaacgtaacaaaattaatgtgattactattggcggtgctggcggtcaaactgatccaacccaaattcaaattgccgatctcagtaaaactattcaggatccgctgctcgccaaagtgcggtcagttttacgcaaggattacaattttagccaaaatccaaagcgcaaatttagtatcgatgcggtattttcaacacaacctttaatattcccacaaatgactgaaggctgttctacttctgccacaatgaattgcgcaaacggatttggtgcagccacgatgattacggcaacctttggtttttttgccgtttctcgtgtaatagataaattactaaagaaaaaatct

SEQ ID NO: 3528 - protein, 261 aa, Haemophilus influenzae
  Name: NTH1963
MGITVMARIDNYEQRFGGIGRLYTPDGLARLRQAHICVIGIGGVGSWVVEALARSGICELTLIDMDDICVTNINRQLPAMSGTIGKLKTEVMSERVKLINPECTVNIIDDFISPENQSDYLNRGYDYVIDAIDNVKTKASLIAYCKRNKINVITIGGAGGQTDPTQIQIADLSKTIQDPLLAKVRSVLRKDYNFSQNPKRKFSIDAVFSTQPLIFPQMTEGCSTSATMNCANGFGAATMITATFGFFAVSRVIDKLLKKKS

SEQ ID NO: 3529 - DNA, 195 bp, Haemophilus influenzae
  Name: NTH1964
ttgttgttaaaccctcgtgatgatcgtgatcatgatgttcgtgatcgtgtttatgctcgtgtttatgatcatggtcgtggtcgtgtttatgatcatgtttgtgtttgtgcttatggtcatgatcgccatcttcatggaaatgctcgtggtgagctttacttaataaaggttttacatccgcaagatcggcaatgg

SEQ ID NO: 3530 - protein, 65 aa, Haemophilus influenzae
  Name: NTH1964
LLLNPRDDRDHDVRDRVYARVYDHGRGRVYDHVCVCAYGHDRHLHGNARGELYLIKVLHPQDRQW

SEQ ID NO: 3531 - DNA, 999 bp, Haemophilus influenzae
  Name: NTH1965
atgaaaaaacttttaaaaattagtgccgtttctgccgcacttttaagtgcgccaatgatggcgaatgccgatgtattagcatcagtaaaacctttaggctttattgtttcatctattgcagatggcgtaactggtacacaagtccttgttcctgcaggcgcctctccgcatgattacaatttgaaattatctgatattcaaaaagtaaaatctgcagatttagttgtatggattggtgaagacattgattcattcttagacaaaccaattagccaaattgaacgtaaaaaagtgattaccattgccgatcttgcggatgtaaaacctttattaagtaaagctcaccacgagcatttccatgaagatggcgatcatgaccataagcacaaacacaaacatgatcataaacacgaccacgaccatgatcataaacacgagcataaacacgatcacgaacatcatgatcacgatcatcacgagggtttaacaacaaactggcacgtttggtattctccagctatcagcaaaattgttgcacaaaaagtagcggataaattaactgcacaattcccagataaaaaagcgttaattgcacaaaatctttcagattttaaccgcactttggcagaacaaagtgaaaaaattacggcacaacttgcaaatgttaaagataaaggtttctacgttttccacgatgcttatggttatttcaacgatgcttatggtttaaaacaaacgggttactttaccatcaatccattagtggcaccgggtgcaaaaactttagcgcacattaaagaagaaattgatgaacataaagtaaattgcttattcgcagagcctcaatttacgccaaaagtgattgagtctttagcgaaaaatactaaagtcaatgtaggacaactcgacccaattggcgataaagttactttaggtaaaaattcttatgcaacattcttgcaatctactgcagatagctacatggaatgtttagctaaa

SEQ ID NO: 3532 - protein, 333 aa, Haemophilus influenzae
  Name: NTH1965
MKKLLKISAVSAALLSAPMMANADVLASVKPLGFIVSSIADGVTGTQVLVPAGASPHDYNLKLSDIQKVKSADLVVWIGEDIDSFLDKPISQIERKKVITIADLADVKPLLSKAHHEHFHEDGDHDHKHKHKHDHKHDHDHDHKHEHKHDHEHHDHDHHEGLTTNWHVWYSPAISKIVAQKVADKLTAQFPDKKALIAQNLSDFNRTLAEQSEKITAQLANVKDKGFYVFHDAYGYFNDAYGLKQTGYFTINPLVAPGAKTLAHIKEEIDEHKVNCLFAEPQFTPKVIESLAKNTKVNVGQLDPIGDKVTLGKNSYATFLQSTADSYMECLAK

SEQ ID NO: 3533 - DNA, 504 bp, Haemophilus influenzae
  Name: NTH1966
atggctgatccacatattaaatcaccgatggattttttagattatctgactgttattatttaccgaactggttttgtgatagcggcgttggctgttcttacagtgagttggtatccagatttatcactcacatttatattaattgcggcaacctgttgtgcctcttcgttacacatttacttaaaatcttttcgattgctttttcaatttgctacttggataggattacttttttatattaatcattatcctgcgttggctcttggcggtgcgttacttactttaggtggcttgtgttttaaagaatatttttgtttccgcgtgcctttgctaaatttacagccgatatttgtggcttgcttgtggttttcgtgggtgttaaataatcttattgcactacgcattttttctattatttctggcgtattacttttagttttagcgatacaaaaatggcgaatgcctttgcattttgatattggagataaaactaaatatcaaatt

SEQ ID NO: 3534 - protein, 168 aa, Haemophilus influenzae
  Name: NTH1966
MADPHIKSPMDFLDYLTVIIYRTGFVIAALAVLTVSWYPDLSLTFILIAATCCASSLHIYLKSFRLLFQFATWIGLLFYINHYPALALGGALLTLGGLCFKEYFCFRVPLLNLQPIFVACLWFSWVLNNLIALRIFSIISGVLLLVLAIQKWRMPLHFDIGDKTKYQI

SEQ ID NO: 3535 - DNA, 1401 bp, Haemophilus influenzae
  Name: NTH1967
ttgttttatcatattttcgttttccttaatcaacagagaaatacaatgaaacatattcatatcttaggtatttgtggcacatttatgggcggtgtggcgatgattgctaaacaaatgggctatcacgtaacgggttccgatactaatgtttaccctccaatgaacacttttttagaagagcaaggtatcgagattattccaaattatgatgttgcacaattacaacctgcgcctgatatggtaattgttggtaatgcgatgaaacgtggtaatccttgcgtagaatatgtgttggaaaataatttgaaatatacatctggccctcaatggttacatgatcatttattgcgagatcgttgggtattggcgatttcaggtacgcatggaaaaacaaccacaacaggtatgctaacgtggatcttagaacaaaatggcttaaaaccaggttttttaatcggaggaattgcgggtaattttggcatttcagctcgtttaggagatagcccttattttgttattgaagctgatgaatatgatacagctttctttgataaacgttcgaaatttgtccattacaatcctcgtacacttatcgtaaataacattagttttgaccatgcagatatttttgatgatctcaaagcgatccaacgccaatttcatcatatgattcgaactatcccagccagtggcttggtattaagttcggcgagtgaacaaagtgcaaaagaaactttggcattgggatgttggtctcaacagcaatttttaggcaaagataacgagtggtttgctgaacgtattacaaatgatgcttcacattttgctgtcttccatcatggagaaaaagtggcagaagtaaaatggaatgtagtgggacaacataatatgcataatgcgttaatggcgatcgctgcggctcatcatactggcgttgctattgaagatgcgtgcaaagcgttgggatcttttgtgaatgctaaacgtcgtttagaagtgaaaggtgaagttaatggcattacggtttatgatgattttgctcatcatccagaagctattcttgctacgctaaccgctttacgagataaagttggtggtgttcgtattcttgcagtgcttgaacctcgttctaacacaatgaaaatgggtgttcacaaagatgacatcgcgcctgcacttggtcgagctgatgccgtgtttatgcttcaacctgaacaactttcttgggaagtggcagatattgcaaaccaatgtgtacaacctgcttattggaatgcaaatttagatcgattagtggatatgattgttgcagaggctcaacctacggatcatattttagtgatgtctaacggcagttttggtggcattcatcaaaaaattcttgataagctaaaactgaaa

SEQ ID NO: 3536 - protein, 467 aa, Haemophilus influenzae
  Name: NTH1967
LFYHIFVFLNQQRNTMKHIHILGICGTFMGGVAMIAKQMGYHVTGSDTNVYPPMNTFLEEQGIEIIPNYDVAQLQPAPDMVIVGNAMKRGNPCVEYVLENNLKYTSGPQWLHDHLLRDRWVLAISGTHGKTTTTGMLTWILEQNGLKPGFLIGGIAGNFGISARLGDSPYFVIEADEYDTAFFDKRSKFVHYNPRTLIVNNISFDHADIFDDLKAIQRQFHHMIRTIPASGLVLSSASEQSAKETLALGCWSQQQFLGKDNEWFAERITNDASHFAVFHHGEKVAEVKWNVVGQHNMHNALMAIAAAHHTGVAIEDACKALGSFVNAKRRLEVKGEVNGITVYDDFAHHPEAILATLTALRDKVGGVRILAVLEPRSNTMKMGVHKDDIAPALGRADAVFMLQPEQLSWEVADIANQCVQPAYWNANLDRLVDMIVAEAQPTDHILVMSNGSFGGIHQKILDKLKLK

SEQ ID NO: 3537 - DNA, 132 bp, Haemophilus influenzae
  n 33: n is any nucleotide
  Name: NTH1968
ttgaaacttggtttgagcgaattgctaaaagtncgaataaaaaaaagcgtgttttacacaggcatttttataggattattttgttctgaactaaaccaatttgggtccgtcagcaaaatgaatgaagtccca

SEQ ID NO: 3538 - protein, 44 aa, Haemophilus influenzae
  Name: NTH1968
LKLGLSELLKVRIKKSVFYTGIFIGLFCSELNQFGSVSKMNEVP

SEQ ID NO: 3539 - DNA, 468 bp, Haemophilus influenzae
  Name: NTH1969
gtgtcggaagctgcgttatatcgttactttccaagcaaaacaaaaatgtttgaagcactaattgaacatattgaaagtactttgctgagccgaattacagcgtcaatgcgtaacgaaactcaaacaatgaatcgcattcacgacattttacaaacaattttggattttgctcgaaaaaatcccggcttaacacgtgttctaacaggtcacgcgttaatgtttgaagaagcgcaattacaagcacgtgtggcacaatttttcgatcgtcttgagatgcagtttgtcaatattttgcaaatgcgtaaattacgtgaagggcgtgctttcaacgtggatgaacgtataattgcctcacatttagtgacactctgcgaaggacaatttatgcgctatgttcgtacaaatttccgtctgaattcaagtcagtcttttgaacaacaatggcgttttatcgagccactttttgcc

SEQ ID NO: 3540 - protein, 156 aa, Haemophilus influenzae
  Name: NTH1969
VSEAALYRYFPSKTKMFEALIEHIESTLLSRITASMRNETQTMNRIHDILQTILDFARKNPGLTRVLTGHALMFEEAQLQARVAQFFDRLEMQFVNILQMRKLREGRAFNVDERIIASHLVTLCEGQFMRYVRTNFRLNSSQSFEQQWRFIEPLFA

SEQ ID NO: 3541 - DNA, 270 bp, Haemophilus influenzae
  Name: NTH1970
ttgactttaccgagtaaatatatgattattccttggcaagaactggaagcagaaacattagataatatcgtagaaagcgtgattttacgcgaaggaaccgattacggtatagaagaactttcactcaaccagaaaaaacaacttttactgactcaaattcgcaatggaattgcgttgattgtatggtctgaattacatgaatccattgacatcaaaaataaaacggaatttttgaaacaggaatgtaaggagcaagaatgtcaaatgaat

SEQ ID NO: 3542 - protein, 90 aa, Haemophilus influenzae
  Name: NTH1970
LTLPSKYMIIPWQELEAETLDNIVESVILREGTDYGIEELSLNQKKQLLLTQIRNGIALIVWSELHESIDIKNKTEFLKQECKEQECQMN

SEQ ID NO: 3543 - DNA, 672 bp, Haemophilus influenzae
  Name: NTH1971
atgtcaaatgaattaaccgaaattgatgaagttgtaacctcctctcaagaagaagcaactcaacgagatcccgttttagattggtttcttactcactgccatttgcataagtatcctgcaaaatcaactttaattcatgctggggaagatgcgaccacgctgtattatgtaattaaaggttctgtaatggtatcttcaaaagatgatgaaggcaaagagatgatcctcacttacttaggtgcaggacaattttttggcgaagcgggattatttgatgaaggttcaaaacgatcagcttgggtaaaaacaaaaacaacatgtgaaattgctgaaatttcctataagaaatatcgccagttgattcaggcaaaccctgaaatcttaatgtttcttactgcacaattggcaagacgtttgcaaaatacatcacgtcaagtcacgaatttggcatttttagacgtcgcaggtcgcatcgctcaaactttaatgaacttagctaaacagcctgaagcaatgacgcatcctgatggtatgcaaatcaaaattacacgccaagaaatagggcaaatggtgggttgttcacgagaaactgtggggcgcattattaagatgttggaggatcagaatcttatccacgctcatggaaaaacaatcgttgtatatggcgcaaga

SEQ ID NO: 3544 - protein, 224 aa, Haemophilus influenzae
  Name: NTH1971
MSNELTEIDEVVTSSQEEATQRDPVLDWFLTHCHLHKYPAKSTLIHAGEDATTLYYVIKGSVMVSSKDDEGKEMILTYLGAGQFFGEAGLFDEGSKRSAWVKTKTTCEIAEISYKKYRQLIQANPEILMFLTAQLARRLQNTSRQVTNLAFLDVAGRIAQTLMNLAKQPEAMTHPDGMQIKITRQEIGQMVGCSRETVGRIIKMLEDQNLIHAHGKTIVVYGAR

SEQ ID NO: 3545 - DNA, 1176 bp, Haemophilus influenzae
  Name: NTH1972
atgattgattgtcgatactatcaacaaaatgaatgtcgttcttgtcaatggcttgaaataccttatagtcagcagcttgctgaaaaacaacatcatttaaaacagcaactgatttctattaattgcgataaagctcaatggttagctccttttcaatctaatgaacaatgctttcgtaataaagctaaaatgcttgttagtggtagtgtggaacgcccaatacttggtattttaaaaaatcctaatgatccacaaagtgcgattgatttgtgtgattgtcctctttatcctgcacgtttctcaataattttttcaatcctcaaagattttattggtcgcgcaggtttagtaccttataacattgctaaacaaaaaggcgagcttaaatatattttactgacagaaagtatcgcaacaggaaaattaatgttgcgttttgtgttacgtacagaaaataaattgccgttaatccgtcgagaattaccaaaattattagaaaaactaccgcacttagaagtggttagcgttaatttgcaaccactgcacgctgctattttggagggagaacaagaaatttttctgacagaacaacaatttttgccagaaaatttcaatagtattccgctttttattcgtccacaaggcttctttcaaactaatcctaaagtggcggagggattatatgcaacagctcaacaatgggtatctgaattacctatttataacctatgggatctattttgtggtgtaggtggatttggcttacattgtgccaaagcgttgcaggaaaaatggggaaaacccattaaattaacaggaattgaaatttcttcctctgctattttggcagccagtcattctgcgaaaatattaggtttagaacatgtaaatttccaatctctagatgcagcaagcgtgattgaaaataaaaatgaaaataagccagatcttgtgattgtaaatccgccgcgtcgtggaattggaaaggaattaagtgaatttctcaaccaaattcaaccgcactttatcttgtattccagctgtaatgccatgacaatgggtaaagatttacaacatctaacttgttataaaccattgaaaattcaactttttgatatgtttccgcaaacatctcactatgaagtattagttttactagaaagaaaaaagattaat

SEQ ID NO: 3546 - protein, 392 aa, Haemophilus influenzae
  Name: NTH1972
MIDCRYYQQNECRSCQWLEIPYSQQLAEKQHHLKQQLISINCDKAQWLAPFQSNEQCFRNKAKMLVSGSVERPILGILKNPNDPQSAIDLCDCPLYPARFSIIFSILKDFIGRAGLVPYNIAKQKGELKYILLTESIATGKLMLRFVLRTENKLPLIRRELPKLLEKLPHLEVVSVNLQPLHAAILEGEQEIFLTEQQFLPENFNSIPLFIRPQGFFQTNPKVAEGLYATAQQWVSELPIYNLWDLFCGVGGFGLHCAKALQEKWGKPIKLTGIEISSSAILAASHSAKILGLEHVNFQSLDAASVIENKNENKPDLVIVNPPRRGIGKELSEFLNQIQPHFILYSSCNAMTMGKDLQHLTCYKPLKIQLFDMFPQTSHYEVLVLLERKKIN

SEQ ID NO: 3547 - DNA, 1053 bp, Haemophilus influenzae
  Name: NTH1973
atgagcaccttgttaattgatttaaaaggaaaagagttggaacaagaggaagttgagttactttcgcaccctcttgttgcaggattgattttatttactcgaaattttgaagacagagaacaaattcaagaattaattcgttctgttcgccaacgagtaaaaaagcctttattaattacagtggatcaagaaggtggacgagttcaacgttttcgtgatggatttacaatgttgccttcaatgcaggcttttcaagaaacactatcagcaactgaacaagtaagttttgctaaagaagcaggttggcaaatggcagcagaaatgattgctttggatattgacttgagttttgcaccagtgctggatttggggcatgaatgtcgagcgattggtgatcgcagtttttcatctgatgtaaaaagtgcggtaaatttagccatcaattttattgatggtatgcatcaagcaggtatggcatctacgggtaaacattttcccggtcatggtcatgtattagccgattcccatttagaaacaccttatgatgatcgcgcaaaagacgaaatttttggttacgatctccaacctttccaacagttgatttcacaaaataaactcgatgcgattatgcctgctcacgtgatttatggacaatgtgatagtcagcctgcaagtggttcagaatattggttgaaagaaattttacgcaagaaattaaatttccaaggtacaattttttccgatgatctaggaatgaaaggcgcgggagtaatggggaattttgtagagcgtagcaaaaaagcactgaatgcaggttgtgatcttttgttactgtgcaatgaacgtgaaggtgtcattcaagtattagataatctaaaacttactgaaaatgaaccgcactttatggctcgtcaagctcgcttaaaaaatttatttaagcgtagcgtaatcgaatggaatgacttggttttagatcaacgttggaaactgaatcatcgaaatctcgcagatattcaaagccgttggctagatattcaggccgcaaaaaatgat

SEQ ID NO: 3548 - protein, 351 aa, Haemophilus influenzae
  Name: NTH1973
MSTLLIDLKGKELEQEEVELLSHPLVAGLILFTRNFEDREQIQELIRSVRQRVKKPLLITVDQEGGRVQRFRDGFTMLPSMQAFQETLSATEQVSFAKEAGWQMAAEMIALDIDLSFAPVLDLGHECRAIGDRSFSSDVKSAVNLAINFIDGMHQAGMASTGKHFPGHGHVLADSHLETPYDDRAKDEIFGYDLQPFQQLISQNKLDAIMPAHVIYGQCDSQPASGSEYWLKEILRKKLNFQGTIFSDDLGMKGAGVMGNFVERSKKALNAGCDLLLLCNEREGVIQVLDNLKLTENEPHFMARQARLKNLFKRSVIEWNDLVLDQRWKLNHRNLADIQSRWLDIQAAKND

SEQ ID NO: 3549 - DNA, 348 bp, Haemophilus influenzae
  Name: NTH1974
atgaaaaaatattttctaattttggcgagctttatgctcgcagcttgttcaatttcagagcaaaacttaacttattcaacaaagccgattttgaatattacgtcgtctctttcgcctttaattcaagttgaaacgactcaaaaatcagcggttataaaaaataaaagtcagcaacttttgaatgtaagttaccatttgtattggtatgatcatttaggagttacccaaatttgggaaaatcagcaagaaagctattccgctcaattttcgctaaaaccacaagaagagaaatcaatcgatttaattaaacctactgtagaaagtaaaaattaccgcctttatttaaaa

SEQ ID NO: 3550 - protein, 116 aa, Haemophilus influenzae
  Name: NTH1974
MKKYFLILASFMLAACSISEQNLTYSTKPILNITSSLSPLIQVETTQKSAVIKNKSQQLLNVSYHLYWYDHLGVTQIWENQQESYSAQFSLKPQEEKSIDLIKPTVESKNYRLYLK

SEQ ID NO: 3551 - DNA, 897 bp, Haemophilus influenzae
  Name: NTH1975
ttgagtgctatcaacttaaatttaagtggtgcttatcgagtaacagaaggcttgagcctaggtttaggggtaaatgcggtttatgctaacgcccaagttgaacggaatgctggtattattgtggagactattgataaccaagtaaacacagcactctcagcactgcaagaaccattcagagatcttaagaagcatttgccctctaaagacaaatctgttgtgtcattacaagatagagcagcttggggctttggctggaatgcaggtgtaatgtatcaatttaatgaagctaacagaattggtttagcctatcattctaaagtggacattgattttactgaccgcactgccactagtttagaagcaaatgttatcaaggcaggtaaaaaaggtgatttaacctttacattgccagattacttagaactttctggtttccatcaattaactgacaaacttgcagtgcattatagttataaatatacccattggagtcgtttaacaaaattacatgccagcttcgaagatggtaagaaagcttttgagaaagaattgcaatacagtaataactctcgtgttgcattaggggcaagttataatctttatgaaaaattaaccttacgtgcaggtattgcttacgatcaagccgcatctcgtcatcagcgtagtgctgcaattccagataccgatcgcacttggtatagtttaggggcaacctataaattcacgccgaatttatctgttgatcttggctatgcttacttaaaaggcaaaaaagttcactttaaagaagtaaaaacaataggtgaaccacgtgcattgacatttaatacaactgcaaattacacttctcaagcacacgcaaatctttacggcttaaacttaaattatagtttc

SEQ ID NO: 3552 - protein, 299 aa, Haemophilus influenzae
  Name: NTH1975
LSAINLNLSGAYRVTEGLSLGLGVNAVYANAQVERNAGIIVETIDNQVNTALSALQEPFRDLKKHLPSKDKSVVSLQDRAAWGFGWNAGVMYQFNEANRIGLAYHSKVDIDFTDRTATSLEANVIKAGKKGDLTFTLPDYLELSGFHQLTDKLAVHYSYKYTHWSRLTKLHASFEDGKKAFEKELQYSNNSRVALGASYNLYEKLTLRAGIAYDQAASRHQRSAAIPDTDRTWYSLGATYKFTPNLSVDLGYAYLKGKKVHFKEVKTIGEPRALTFNTTANYTSQAHANLYGLNLNYSF

SEQ ID NO: 3553 - DNA, 567 bp, Haemophilus influenzae
  Name: NTH1976
gtgcttttcttttataaaacaaggcgaaaaatgaccgcactttattacacttattacccctcgccagtgggacggcttttgattttatctgacggcgaaagcattacacatattgattttgaaaaagagcaatatgcgcctaatccaaaatggctcaagcaagatgaattgcctgtttttcaaaaagtgcggttagcttttgaacgatattttaatggggaagttgagcgatttgcagacattcccttaaaaccagaaggcaccgcatttcaacaagccatttggcaagccttgcgagaaattgcttatggcgagctttcaacttatggcgagctggcgttacggattaataatcctaaagctgttcgtgccgtgggcggtgcggtaggcagtaatcccattagtattattattccttgtcatcgcattttaggtaaagatcgtactttaactggttttggcggtggcttagaggcaaaacgttttttattgcagttagagaaaattccctatattgataaaggcactgaaaacactaagcctcgcttttttaagaaatatcacgaa

SEQ ID NO: 3554 - protein, 189 aa, Haemophilus influenzae
  Name: NTH1976
VLFFYKTRRKMTALYYTYYPSPVGRLLILSDGESITHIDFEKEQYAPNPKWLKQDELPVFQKVRLAFERYFNGEVERFADIPLKPEGTAFQQAIWQALREIAYGELSTYGELALRINNPKAVRAVGGAVGSNPISIIIPCHRILGKDRTLTGFGGGLEAKRFLLQLEKIPYIDKGTENTKPRFFKKYHE

SEQ ID NO: 3555 - DNA, 261 bp, Haemophilus influenzae
  Name: NTH1977
atgattccacaaactcttgaacaattactttcccaagcgcaatcaattgctggcttaacttttggggagttagctgatgaactgcatattcctgttccgattgatttaaaacgtgataaaggctgggtgggcatgttattagagcgtgctttaggcgcaacggcagggagtaaagctgaacaggatttctctcatttaggtgttgaaactttaaaacattgccgattaatgcgggagggtaccctcttgaaaccacctttg

SEQ ID NO: 3556 - protein, 87 aa, Haemophilus influenzae
  Name: NTH1977
MIPQTLEQLLSQAQSIAGLTFGELADELHIPVPIDLKRDKGWVGMLLERALGATAGSKAEQDFSHLGVETLKHCRLMREGTLLKPPL

SEQ ID NO: 3557 - DNA, 159 bp, Haemophilus influenzae
  Name: NTH1978
ttgccgattaatgcgggagggtaccctcttgaaaccacctttgtgagccttgccccgttggtacaaaattcagggattaaatgggaaaattcccacgttcgccataaactttctgtgtactttggatacccattgaagcagccgtcatattccattacg

SEQ ID NO: 3558 - protein, 53 aa, Haemophilus influenzae
  Name: NTH1978
LPINAGGYPLETTFVSLAPLVQNSGIKWENSHVRHKLSVYFGYPLKQPSYSIT

SEQ ID NO: 3559 - DNA, 213 bp, Haemophilus influenzae
  Name: NTH1980
ttgatggatttaattgtacttggcaaattggagcaaattaccgctcgaattggtgaagtgatgcaacttcgcccgaagggcgcaaatagtcgtgctgtgacaaaaggcattggcaaaaatggcgaaattatagataccttgcctttaggtttttatctaagaaaagaattcaccgctcaaattttgaaagcgtttttagatgtaaagccgctt

SEQ ID NO: 3560 - protein, 71 aa, Haemophilus influenzae
  Name: NTH1980
LMDLIVLGKLEQITARIGEVMQLRPKGANSRAVTKGIGKNGEIIDTLPLGFYLRKEFTAQILKAFLDVKPL

SEQ ID NO: 3561 - DNA, 1290 bp, Haemophilus influenzae
  Name: NTH1981
atggatttactttcagacattgaaaaacaactccaaaaagccaccgctcaagggtttcttatcgccttgagtggtggtttagattccactgtacttctttctttatttgcaaaactttgtcaaaaacaaccgcacttaccgcctttatcggtacgagcaatccacattcatcacggcttaagccccaatgcagatagttgggctaaacactgccaaaacttgtgcgatcaatttcaaattccattgattatcgagcgagtacaagtagataaaaccaatggcattgaagcaggggcgcgtgaagcacgctatcaagccataaaaaaacatcttcaaatacaagaaatgttagttacagcgcatcatctaaacgatcaaacagaaacatttttcttagccctaaaacgtggcagtgggctacaaggcttaagcgcaatgcaacaacaaagtgtattattcggaatgccaatttttcgccctttgttaggttttactcgcccacagttagaagattatgcgcaacaagaaaagctcaactgggttacagatgaaagtaatgaggataatcgatacgatcgtaatttcttacgcaatgaaattttgccaaaattacgtgaacgctgggcgcattttgatttagccgtacaacgttccgcacaacattgttttgagcaacaacagttaattaatgatttattgagcgaaatttttacagaacattgtcaaattaaaaaccaatttaaactgctccaatttcgccaatattctctcgcaaaacagaccgcacttttgcgtatgtggcttgccaaaaaccaacttgaaatgccaagtaaacgccagcttacacagcttattaatgatgtcatttttgcaaaagaagaggcaaatcctcaatttcagcttgtaaataaagttattcgacgttatcaagatagtttatatttaactaagccgttttctgatctaaccaaatgcaccctaaaattagaacaaaacatgctaaatttacccgatgatttaggcaatctcactgttcacgaaaatgaacataatctgattttctactggcaggattactctgttacgctggaaaaaacgaacttgcctatttctattcgttttggctattcgggcaaagtgaaacatcatccgaaacgcccaagagaagatataaaaaaaatctggcaagaattaagcgtaccaccttgggaacgaaatcggatccctttaattttttatggcaatgagctaaaaagtgcggtcggttttttccgtgtttttgacgaatat

SEQ ID NO: 3562 - protein, 430 aa, Haemophilus influenzae
  Name: NTH1981
MDLLSDIEKQLQKATAQGFLIALSGGLDSTVLLSLFAKLCQKQPHLPPLSVRAIHIHHGLSPNADSWAKHCQNLCDQFQIPLIIERVQVDKTNGIEAGAREARYQAIKKHLQIQEMLVTAHHLNDQTETFFLALKRGSGLQGLSAMQQQSVLFGMPIFRPLLGFTRPQLEDYAQQEKLNWVTDESNEDNRYDRNFLRNEILPKLRERWAHFDLAVQRSAQHCFEQQQLINDLLSEIFTEHCQIKNQFKLLQFRQYSLAKQTALLRMWLAKNQLEMPSKRQLTQLINDVIFAKEEANPQFQLVNKVIRRYQDSLYLTKPFSDLTKCTLKLEQNMLNLPDDLGNLTVHENEHNLIFYWQDYSVTLEKTNLPISIRFGYSGKVKHHPKRPREDIKKIWQELSVPPWERNRIPLIFYGNELKSAVGFFRVFDEY

SEQ ID NO: 3563 - DNA, 102 bp, Haemophilus influenzae
  Name: NTH1982
atgaaaaccacctttgaactgggttcttacgagttacaaaccattgctgcacgttttgaaattcttaatccaagcagtaactataaagctgaaaaagttgcc

SEQ ID NO: 3564 - protein, 34 aa, Haemophilus influenzae
  Name: NTH1982
MKTTFELGSYELQTIAARFEILNPSSNYKAEKVA

SEQ ID NO: 3565 - DNA, 558 bp, Haemophilus influenzae
  Name: NTH1983
atgcccgcacctgaaggctatcgtaaagcgttacgtttaatggaaatggctgaacgttttaaattgccaattatcacatttattgacacaccaggggcttatccaggtattggcgcagaagaacgtggtcaagcggaagctatcgcccgtaacttacgcgaaatggcacagcttaccgttcctgttatttgtaccgttatcggcgaaggtggttcgggcggtgcattagctattggcgtgggcgataaagtgaatatgttacagtattcaacttattctgttatttctccagaaggctgcgcttctattctttggaaaagtgcggaaaaggcatcaacagcagcagaagtaatgggattaactgcaagccgtttaaaagaattaaatcttatcgacagcattatgcaagaacctttgggtggcgcacatcgcaattatgcgaaaatagctgaaaacttaaaacttcgtttaaaagaagatttagctgaactcgatgaactaagcaaagaagaattattaaatagacgctatgaacgtttaatgtcttatggttattgc

SEQ ID NO: 3566 - protein, 186 aa, Haemophilus influenzae
  Name: NTH1983
MPAPEGYRKALRLMEMAERFKLPIITFIDTPGAYPGIGAEERGQAEAIARNLREMAQLTVPVICTVIGEGGSGGALAIGVGDKVNMLQYSTYSVISPEGCASILWKSAEKASTAAEVMGLTASRLKELNLIDSIMQEPLGGAHRNYAKIAENLKLRLKEDLAELDELSKEELLNRRYERLMSYGYC

SEQ ID NO: 3567 - DNA, 423 bp, Haemophilus influenzae
  Name: NTH1984
atgaaccaagaatatttagattttgaattgccgattgctgaattagaagcaaaaattgaagcattacgagcagcatcagatgataaagttgatttaactgatgaaatcaaacgcttacaaaagaaaagtaacgaactcactaaaaaaacctttgctaacctcgatgcttggcaagtttcacgtatggcgcgtcatccaaatcgtccttatacattagattatatcgaacatatttttacggaatttgaagaacttgcaggggatcgcgcttttgctgatgataaagcgattgttggtggcttggcgcgtttagatggtcgtccagtgatggttatcggtcatcaaaaaggtcgttctgtaaaagaaaaagtacaacgcattttggtatgcccgcacctgaaggctatcgtaaagcgttacgtt

SEQ ID NO: 3568 - protein, 141 aa, Haemophilus influenzae
  Name: NTH1984
MNQEYLDFELPIAELEAKIEALRAASDDKVDLTDEIKRLQKKSNELTKKTFANLDAWQVSRMARHPNRPYTLDYIEHIFTEFEELAGDRAFADDKAIVGGLARLDGRPVMVIGHQKGRSVKEKVQRILVCPHLKAIVKRYV

SEQ ID NO: 3569 - DNA, 783 bp, Haemophilus influenzae
  Name: NTH1986
atgtttgaaattttatttcctgcccttttaacaggcattgtgctttcgcttattaccgcgccacttggcgtatttgtggtgtggcgtaaaatggcttattttggcgacaccctttctcattctgccttgctcggtgtagcattaggtattttcttacaagtcaatccttacattgcgattgtggtgcttaccttaattcttgctatcgcaatggtgtggttagaaagcaatacgcaattttctattgataccttgctcggcattatcgcccatagctgtttatctcttggcgttgtgacagtaggattattacggaatgtacgggtagatttaatgaattatttatttggggatttactcgcaattaattatacggatttaatttatatcgggattggcgtaataattgtgctttcaacattaatttacttttggcaatccttactttccaccaccgtatcgccagaactcgcacaagttgaaggcattaatatcaaaaaaatgcgttttattttaatgatattaaccgcattgacgattgccttgagtatgaaatttgtcggtgcattaattatcacatccttattaatcattcctgcggcaaccgctcgtcgctttgcgagaacgccagaatctatggtgggctgggcgattattatgagtatgttatcgattataggtggattaatattatcagccttttatgatactgctgctgggccttctgttgtgatttgttctgcgtttttatttgtcttatcactcttcaaaaaagagcgatta

SEQ ID NO: 3570 - protein, 261 aa, Haemophilus influenzae
  Name: NTH1986
MFEILFPALLTGIVLSLITAPLGVFVVWRKMAYFGDTLSHSALLGVALGIFLQVNPYIAIVVLTLILAIAMVWLESNTQFSIDTLLGIIAHSCLSLGVVTVGLLRNVRVDLMNYLFGDLLAINYTDLIYIGIGVIIVLSTLIYFWQSLLSTTVSPELAQVEGINIKKMRFILMILTALTIALSMKFVGALIITSLLIIPAATARRFARTPESMVGWAIIMSMLSIIGGLILSAFYDTAAGPSVVICSAFLFVLSLFKKERL

SEQ ID NO: 3571 - DNA, 636 bp, Haemophilus influenzae
  Name: NTH1988
ttgttaaaaaccttattaaaactacaaatgcccacttctggcgaagtcatttatagtaaaaatgttcgcattggttatgtaccacaaaaaatccatttggatcatagtttgcctattacggttgagcgatttctttcgctaaaaaaaggcattaaaacccaagaaatatccaccgcacttgagcaactttcgatttcacatttacgcaaaagcaatatgcaaaaactttctggtggcgaaatgcaacgtgtattattgacgcgtgcaattttaaataaaccgaatttacttgtgctagacgaacccactcaaggcgtagacattactggtcaagctgagctttatcagctaattcatcaaacccaacaaaaattaaattgtgccgtattgatggtatcacacgatttacatattgtgatggcggatagtaaagaagtattgtgtattaaccaacatatttgttgtgcaggtacgcccgatgttctctcaaatgatccaacatttatgcgtttatggggaaatcagatcgcacaaaatgtcggcttttatacccatcatcacaatcatcatcacaccttgcacggcgatgtgtgcggttgtaattcatcagcagtgcattgtcaaaataaggataaa

SEQ ID NO: 3572 - protein, 212 aa, Haemophilus influenzae
  Name: NTH1988
LLKTLLKLQMPTSGEVIYSKNVRIGYVPQKIHLDHSLPITVERFLSLKKGIKTQEISTALEQLSISHLRKSNMQKLSGGEMQRVLLTRAILNKPNLLVLDEPTQGVDITGQAELYQLIHQTQQKLNCAVLMVSHDLHIVMADSKEVLCINQHICCAGTPDVLSNDPTFMRLWGNQIAQNVGFYTHHHNHHHTLHGDVCGCNSSAVHCQNKDK

SEQ ID NO: 3573 - DNA, 381 bp, Haemophilus influenzae
  n 376, 377, 378, 379, 380: n is any nucleotide
  Name: NTH1989
gtgcattatgcaatgttaattgtcgctgcccatgaaggggtttgcgacgcaaacaaaagaacattagcgatattaccccaacttcattccacgaaattattgcttttatcccctaagcatatcgtgccaaatccgcgcaaatatattcgtaatcccagaattaacacaatgatgtttttacggggtgggtatctctctcgcttccttcccaaaactggtcatgggattacgacttccgccttctttatctacccccccaactattggaccccacttctcttccatcctccggccggtctcccctgttctgcgtggttctctccttcatcctctcttttcgaccggcgtccccgtggttttttctttttttgtcttnnnnnt

SEQ ID NO: 3574 - protein, 127 aa, Haemophilus influenzae
  Xaa 126, 127: Xaa is any amino acid
  Name: NTH1989
VHYAMLIVAAHEGVCDANKRTLAILPQLHSTKLLLLSPKHIVPNPRKYIRNPRINTMMFLRGGYLSRFLPKTGHGITTSAFFIYPPNYWTPLLFHPPAGLPCSAWFSPSSSLFDRRPRGFFFFCLXX

SEQ ID NO: 3575 - DNA, 165 bp, Haemophilus influenzae
  Name: NTH1991
atgattattgttacttcaggtcacgttgatcacggcaaaacagcattattaaaagcattaactggcacaagtaccgcacatttaccagaagaaaaaaaacgcggaatgaccattgattttggggtatgcctatctgccgttagaaaacaaagtacttggctttat

SEQ ID NO: 3576 - protein, 55 aa, Haemophilus influenzae
  Name: NTH1991
MIIVTSGHVDHGKTALLKALTGTSTAHLPEEKKRGMTIDFGVCLSAVRKQSTWLY

SEQ ID NO: 3577 - DNA, 1383 bp, Haemophilus influenzae
  Name: NTH1992
atgaccgcactttttcaacaacttccttccgttgataaaattctcaaaacatctcaaggtctacaacttattaccgaatttggtcacactgcagtcgtggcaacatgtcgagaattattaacccaagctcgtcaatttataaaaaaaaacaatcaacttcctgaatatttttctaattttgaccgcacttttgtagaaattcattctcgcctacaaaaacaaaaccaagtacaaatcaaagcggtgcataatctgacaggtacggtattgcacacaaatcttgggcgggcactttggtctgaagcagcacaacaagcagcgctttctgtgatgcaaaaaaatgtttcgcttgaatatgatttagataaaggtaagcgtagtcatcgcgataattacatcagtgaattattatgcaaactcacaggtgctgaagctgcctgcatagtgaataacaacgctgctgcggtattgttaatgttagcgacctttgctcaaggtaaagaagtaattatttctcgtggcgaattaattgaaatcggcggtgcatttcgtattccagatattatggaacaagctggatgctatttagtggaagtgggcaccactaatcgtacccatctgaaagattatcgtaatgctatcactgaaaatacggcttttttaatgaaagtgcatagcagcaattatcaaatttgtggttttacctcttcagtttcagaagaagagcttgcggaactaggccgagaaatgaatgtaccagtagtcactgatttaggtagcggcgcattgatagatttaagccaatatggcttaccaaaagaatcaactgtgcaagaaaaagtcgcacaaggtgtgggtttggtctctttctctggcgataaattgcttggtggcgtgcaagcaggcattattgtgggtaaaaaagaatggatcgaacaattacaagcccatcctctcaagcgtgcattacgttgcgataaagtcattttagctggcttagaagccacattacgtttgtatttaaatcctgaaaaattaactgaaaaattaccaactttgtacttactcacgcaaccattaaaacaactcaaaataaatgctatgcgtctcaaagagcggttagaatctcgcttaaattcacaatttgatattcaaattgaagctagccaagcacaaatcggtagtggctcacaaccaatggaaagaatcccttccgtggctgttactattgcagaaaaaacaaacgtaaaactttccgcactttcagctcgttttaaacaactttcccaacctattattgggcgaatggaaaacggaaaaatttggctagatttacgtagccttgcagctattgaaacattattaaatacattggatgaacta

SEQ ID NO: 3578 - protein, 461 aa, Haemophilus influenzae
  Name: NTH1992
MTALFQQLPSVDKILKTSQGLQLITEFGHTAVVATCRELLTQARQFIKKNNQLPEYFSNFDRTFVEIHSRLQKQNQVQIKAVHNLTGTVLHTNLGRALWSEAAQQAALSVMQKNVSLEYDLDKGKRSHRDNYISELLCKLTGAEAACIVNNNAAAVLLMLATFAQGKEVIISRGELIEIGGAFRIPDIMEQAGCYLVEVGTTNRTHLKDYRNAITENTAFLMKVHSSNYQICGFTSSVSEEELAELGREMNVPVVTDLGSGALIDLSQYGLPKESTVQEKVAQGVGLVSFSGDKLLGGVQAGIIVGKKEWIEQLQAHPLKRALRCDKVILAGLEATLRLYLNPEKLTEKLPTLYLLTQPLKQLKINAMRLKERLESRLNSQFDIQIEASQAQIGSGSQPMERIPSVAVTIAEKTNVKLSALSARFKQLSQPIIGRMENGKIWLDLRSLAAIETLLNTLDEL

SEQ ID NO: 3579 - DNA, 2583 bp, Haemophilus influenzae
  Name: NTH1993
atgatttccgaagaaaatttccaacagcacacgccaatgatgcaacaatatctaaaactcaaagcagagaatccagatattttgttgttttatcgcatgggggatttttacgagttgttttatgacgatgcgaaaaaagcggcggcattgttggatatttctttgacgaaacgagggcaatctgcaggacagcccattccaatggcaggaatgccttatcacgcggtggaaggttatttagcaaaattagtgcagttaggcgaatctgtggcgatttgtgaacagattggtgatccatctacaagcaaaggacctgtagaacgtcaaattgtgcgaattgttacgcccggtacggtcagtgatgaagcactgttgcctgaacgccaagacaatctgattgctgcggtatatcaagaaaaagaaaaatttggattagccactttagatatgacttctgggcgttttcagctttgtgaacctgcagataaagaaacattgcgtgcggaattgcaacgtattgtgcctgtagaattgctgtattgtgaagaatttaatgaaatggcagccatagaacattgtaaaggattacgccgtcgcccgatttgggaatttgaacttagcactgccattacgttattaaatcgtcaatttggcacaaaagatttacgcgcctttggtgtagaaaaatcccctctcggcttaagtgcggcaggttgtttattgcaatatgcaaaagaaacccaacgtaccgcattacctcatattcaaagcattagcttaattcaaaaccaagactgcattcagttagatgccgccacgcgcagaaatcttgaattaacacaaaatctttcgggtggcacagaaaatacgttagcctctgtcttggataaatgcgttacgccaatgggcagtcgtttgctgaaacgttggattcatcagcctattcgtgatgtggaaaaattaaaacaacgccaacaagcgattgcggaaattctgaattttgatttagtcgatgaactccaaccttatttgcaattagtcggcgatatggaacgtattttagcgcgtgtggctctgcgttcagcgcgtcctcgcgatctcactcgcttacgcacagccttagaacaaattcctgcattacgcacgattgtgcaacaaaaaacatcgccatttttaaccgcacttttcagccaaattgccgatttcagtgagcaatgggatttattgcaacgtgcattgattgaaacgcctccgcttttaattcggaatggtggtgtaattgctgaaggttaccatgcggagttggacgaatggcgtatgctgtctgatggtgcaacgcaatatttggaaaatctcgaaaaacgtgaacgtgaaagtacaggtattgatacgctaaaaatcggttttaatgcagtgcatggttattacattcaaattagccaaggccaagcgcataaagcacccattcattatgtacgtcgccaaaccttgaaaaatgcagagcgttacattattcctgagctcaaagaatatgaagacaaagtactgaaatcgaaaggtgcagcgttagcattagaaaagcagctttacgatgaattgtttgatttattattaccgcacttaggttcattacaactggctagccttgcactctctgaattggatgtgttagtcaatcttgctgagtgcgcagataccctcaattacgttatgccaacattctgtgatgaagtgagtgtgaaaattgaaaatggtcgccatcctgttgtggaacaagtattgaaagatcctttcattgccaatccagtggagttaaatcacaaccgtcatttgttaattatcactgggccaaatatgggtggtaaaagtacttatatgcgtcaaaccgcattaattacattgcttgcgtatatcggtagctttgtgccagcagacagtgcgcgaattgggccgattgatcgtatttttactcgaattggtgcgtctgatgatttagcctcggggcgttcaacctttatggtggaaatgacggaaatggcaaatattcttcaccaagccactgagcaaagtctcgtgcttattgatgaaatcggtcgtggcacatccacttatgatggcttatccttagcttgggcttgtgcggaatggttagccaaaaaaatccgctcgcttacattatttgccacccattattttgaattaaccgcattgccggaacagctagaaggcattgccaatattcatttagatgcccttgagcataacaacagcatcgcctttatgcacgccgtacaagatggcgcagcaagtaaaagttatggtttggcagttgcggctttggcaggcgtgccacaatccgtcattaaactagcaaaacagaaattgacacaattagaaaaaaactcaagctattcagccgaacagcaaattcaagcgttgcgtgaagccaatcacaatcagggcgaattattgtttgaacaagaaacggatgcactaagagaggctattgaaaagctggatcccgatgatttaagccctaaacaagccttggcgtatttgtatcagttaaagaaaatggtgggg

SEQ ID NO: 3580 - protein, 861 aa, Haemophilus influenzae
  Name: NTH1993
MISEENFQQHTPMMQQYLKLKAENPDILLFYRMGDFYELFYDDAKKAAALLDISLTKRGQSAGQPIPMAGMPYHAVEGYLAKLVQLGESVAICEQIGDPSTSKGPVERQIVRIVTPGTVSDEALLPERQDNLIAAVYQEKEKFGLATLDMTSGRFQLCEPADKETLRAELQRIVPVELLYCEEFNEMAAIEHCKGLRRRPIWEFELSTAITLLNRQFGTKDLRAFGVEKSPLGLSAAGCLLQYAKETQRTALPHIQSISLIQNQDCIQLDAATRRNLELTQNLSGGTENTLASVLDKCVTPMGSRLLKRWIHQPIRDVEKLKQRQQAIAEILNFDLVDELQPYLQLVGDMERILARVALRSARPRDLTRLRTALEQIPALRTIVQQKTSPFLTALFSQIADFSEQWDLLQRALIETPPLLIRNGGVIAEGYHAELDEWRMLSDGATQYLENLEKRERESTGIDTLKIGFNAVHGYYIQISQGQAHKAPIHYVRRQTLKNAERYIIPELKEYEDKVLKSKGAALALEKQLYDELFDLLLPHLGSLQLASLALSELDVLVNLAECADTLNYVMPTFCDEVSVKIENGRHPVVEQVLKDPFIANPVELNHNRHLLIITGPNMGGKSTYMRQTALITLLAYIGSFVPADSARIGPIDRIFTRIGASDDLASGRSTFMVEMTEMANILHQATEQSLVLIDEIGRGTSTYDGLSLAWACAEWLAKKIRSLTLFATHYFELTALPEQLEGIANIHLDALEHNNSIAFMHAVQDGAASKSYGLAVAALAGVPQSVIKLAKQKLTQLEKNSSYSAEQQIQALREANHNQGELLFEQETDALREAIEKLDPDDLSPKQALAYLYQLKKMVG

SEQ ID NO: 3581 - DNA, 162 bp, Haemophilus influenzae
  Name: NTH1994
ttggctgcttacctttctttaagttctaaggggaaaatatcaattttaagtgcggtaaaaaatctcaacaaatttttaccgcacttttttatctggctttttcccctttcggcacctaaaatagccgccataaaacctatctttattcagtttcaaagcagg

SEQ ID NO: 3582 - protein, 54 aa, Haemophilus influenzae
  Name: NTH1994
LAAYLSLSSKGKISILSAVKNLNKFLPHFFIWLFPLSAPKIAAIKPIFIQFQSR

SEQ ID NO: 3583 - DNA, 222 bp, Haemophilus influenzae
  Name: NTH1995
ttgggtttcttaaaagctattgggtatgctggtgcggtagctacgatttggacaagtataattcctgctcttcttgcctataaatcccgcaaaataaatacagctgcaacattccgagtgtgtggtggaaatggtttaataatctttattgcattatttggtgtttttgtagctattttccattttcttgcaatgtttggctgcttacctttctttaagttc

SEQ ID NO: 3584 - protein, 74 aa, Haemophilus influenzae
  Name: NTH1995
LGFLKAIGYAGAVATIWTSIIPALLAYKSRKINTAATFRVCGGNGLIIFIALFGVFVAIFHFLAMFGCLPFFKF

SEQ ID NO: 3585 - DNA, 1017 bp, Haemophilus influenzae
  Name: NTH1996
atgaaaaaacaaccttccatctttggtggtgcgtgtattattgctagtgtttgtgttggggcaggaatgcttggtttgccgacatctggcgcgggtgcttggacaatatggtcagtattagtaatttgcttaacaatgatagtcatgacattgtcaggctggttattacttgaggcctactctacttatgatttaagagcttcatttagtactgtaactaaagatatgctcggttcaactgtcaattctattaataatcttgcggtatattttgtcgggggtattttactttatgcttataccactgcatctggcggtatactagaaaaccttattaaaccgtggattgattttggttcatctacattggcaatttgttccactgtatttgtattagttttttccttctttgtttggcactccactcgcattgtagacagaatatctgttttattgattgtatgcatgggttttacttttatttttagtacttatggattagcaactaatattagtttagacactttattagatattggtggaaaggagacaaattatgcaaaatatgcggtaggaatgtttcccgttgcattaacatcttttggctatcatcattctgtttgtacgatgcgagcttactatggggaagaaaaaaaagcaaaatacgctatcttaggtggaacagcaattgctcttacgctttatttactttggattttctctatttttggcaacttaccgcgagatcaatttgctccagtaattgccagtgatggtaatttagatattttacttaacacattaggtggagtaatcgaatctaacacggttaaacaaatgattaatgccttttctatcgccgcaattttatcatcttttattggcgtaggattaggcgtatttgattatttggctgatttctttaaatttgataattgtaaaattggacgaacaaagtcatgggctgtgactttcctacctccactaattatgtcaatttatttccattgggtttct

SEQ ID NO: 3586 - protein, 339 aa, Haemophilus influenzae
  Name: NTH1996
MKKQPSIFGGACIIASVCVGAGMLGLPTSGAGAWTIWSVLVICLTMIVMTLSGWLLLEAYSTYDLRASFSTVTKDMLGSTVNSINNLAVYFVGGILLYAYTTASGGILENLIKPWIDFGSSTLAICSTVFVLVFSFFVWHSTRIVDRISVLLIVCMGFTFIFSTYGLATNISLDTLLDIGGKETNYAKYAVGMFPVALTSFGYHHSVCTMRAYYGEEKKAKYAILGGTAIALTLYLLWIFSIFGNLPRDQFAPVIASDGNLDILLNTLGGVIESNTVKQMINAFSIAAILSSFIGVGLGVFDYLADFFKFDNCKIGRTKSWAVTFLPPLIMSIYFHWVS

SEQ ID NO: 3587 - DNA, 243 bp, Haemophilus influenzae
  Name: NTH1997
gtgactttattggctaaaccaatttcacttgctttccgtttgttcggtaacatgtatgcaggggagttgatctttattcttatcgctgtaatgtattccgctaatatggccattgcagcattagggattccgttacatcttgcttgggctattttccatattttggttattaccttgcaggctttcatctttatgatgttgacggttgtttatttaagtattgcttataacaaagcagatcat

SEQ ID NO: 3588 - protein, 81 aa, Haemophilus influenzae
  Name: NTH1997
VTLLAKPISLAFRLFGNMYAGELIFILIAVMYSANMAIAALGIPLHLAWAIFHILVITLQAFIFMMLTVVYLSIAYNKADH

SEQ ID NO: 3589 - DNA, 264 bp, Haemophilus influenzae
  Name: NTH1998
ttggagaaaattatggaaactgtaattacagcgacaatcatcggtgcatcaattcttcttgcatttgctgcattaggtactgcaattggctttgctattctaggtggtaaattcttagaatcatcagctcgccaaccagaattagcatctagcttacaaactaaaatgtttatcgtagctggtcttttagatgcgattgcaatgattgctgttggtatttcattacttttcattttcgcaaacccattcatcggtttattaaac

SEQ ID NO: 3590 - protein, 88 aa, Haemophilus influenzae
  Name: NTH1998
LEKIMETVITATIIGASILLAFAALGTAIGFAILGGKFLESSARQPELASSLQTKMFIVAGLLDAIAMIAVGISLLFIFANPFIGLLN

SEQ ID NO: 3591 - DNA, 468 bp, Haemophilus influenzae
  Name: NTH1999
gtgaatttaaatgcaacattgattggtcaacttatagcattcgcactttttgtgtggttttgcatgaagtttgtttggccaccaattattaatgcgattgaaacacgtcaaagccaaattgcgaacgctttagcgtcagctgaagcagctaaaaaagagcaagcagatacgaaaaatcttgttgaacaagaactttcagctgcaaaattacaagctcaagacattttagatgctgcgaataaacgtcgcaatgaagtattagacgaagtgaaggcagaagccgaagaactaaaagcaaaaattattgcacaaggttatgctgaagtagaagcagaacgtaaacgtgttcaagaagaattacgtcttaaagtagcttcattggcagtagctggtgctgagaaaattgtgggtcgttctattgatgaagcggcaaacaatgacattattgataaattagttgcagagtta

SEQ ID NO: 3592 - protein, 156 aa, Haemophilus influenzae
  Name: NTH1999
VNLNATLIGQLIAFALFVWFCMKFVWPPIINAIETRQSQIANALASAEAAKKEQADTKNLVEQELSAAKLQAQDILDAANKRRNEVLDEVKAEAEELKAKIIAQGYAEVEAERKRVQEELRLKVASLAVAGAEKIVGRSIDEAANNDIIDKLVAEL

SEQ ID NO: 3593 - DNA, 432 bp, Haemophilus influenzae
  Name: NTH2000
atgtcagaattaactacaatagctcgcccttatgcaaaagctgcattcgactttgccattgaacaaagtgcggtcgaaaaatggactgaaatgttaggttttgctgctgccgtagctgaagatgaaacggtaaaagcttacttaagtagttctctttctgcacagaaattagctgatacagtaatttctatttgtggcgaacaattggatcaatatgggcaaaatcttattcggttaatggctgaaaataagcgtttgagtgctattcctgcggtgtttgaagaatttaaacatcacgtagaggaacaccaagctattgcagaagttgaagtaacatctgcgcaaccattgaatgcaacacaaatcgaaaaaattgcagctgcaatgggaaaaaagattagctcgcaaagtgaaattaaattgcaacgtgga

SEQ ID NO: 3594 - protein, 144 aa, Haemophilus influenzae
  Name: NTH2000
MSELTTIARPYAKAAFDFAIEQSAVEKWTEMLGFAAAVAEDETVKAYLSSSLSAQKLADTVISICGEQLDQYGQNLIRLMAENKRLSAIPAVFEEFKHHVEEHQAIAEVEVTSAQPLNATQIEKIAAAMGKKISSQSEIKLQRG

SEQ ID NO: 3595 - DNA, 123 bp, Haemophilus influenzae
  Name: NTH2001
gtgaaattaaattgcaacgtggataacgcacttattgctggtgtgattgttcgtactgaagactttgtgattgacggaagtagccgtgggcaacttactcgtctcgcaaacgagttgcaatta

SEQ ID NO: 3596 - protein, 41 aa, Haemophilus influenzae
  Name: NTH2001
VKLNCNVDNALIAGVIVRTEDFVIDGSSRGQLTRLANELQL

SEQ ID NO: 3597 - DNA, 1539 bp, Haemophilus influenzae
  Name: NTH2002
atgcaactaaattcaactgaaattagtgaattgattaaaaaacgcatcgctcaattcgacgtggtcagtgaagcgcgtaatacagggacaattgtttctgtaagcgatggtattattcgcatccacggtttaagcgatgtgatgcaaggtgaaatgatcgccttaccaggtaatcgttatgcgatggcacttaaccttgaacgcgattctgttggtgctgtagttatgggaccttacgcagatttagcggaaggtatggaagttcaatgtacaggtcgtattcttgaagtaccagttggtagtggtttattaggtcgtgtagttaatacgcttggtcagccaatcgatggtaaaggcgaaattgaaaatgatgatttctcaccagtagaagtgattgcgccaggtgttatcgatcgtcgttctgttgatcaacctgttcaaactggttataaagctgtcgattccatggtaccgattggtcgtggtcagcgtgagttaatcatcggtgaccgtcaaacgggtaaaactgcgttagcaattgacgctattattaatcaacgtaattcaggtattaaatgtatctatgttgcgattggtcaaaaagcctctactattgcaaacgtcgtgcgtaaattagaagaacatggtgcgcttgcaaatactatcgtggtagctgcatctgcatctgaatcagcagcgttacaatatttagccccttatgctggttgtgcgatgggggaatatttccgtgatcgcggcgaagatgcgttaattgtttatgatgatttatcaaaacaagccgtagcttatcgtcaaatttcattattattacgtcgtccaccaggtcgtgaagcctatccaggtgatgtgttctatttacattctcgtttactagaacgtgcttctcgtgtaaatgaagattatgtagaaaaattcactaaaggcgaagtaaaagggaaaacaggttctttaaccgcacttccgattattgaaacccaagctggtgacgtatctgcgtttgttccaaccaacgtaatttctattaccgatggtcagattttcttagaatctaacttgtttaactcaggtattcgtcctgcggtaaacccaggtatttcggtatctcgtgttggtggttcagcgcaaactaaagttattaagaaattagcgggtggtattcgtactgcactagctcaatatcgtgaattagcagcgtttgcacagtttgcatcagatctagatgatgcgactcgtaagcaactttctcacggtgaaaaagtaactgaattattaaaacaaaaacaattcgcgccattatctgttgcagaacaagcggttatattgtttgctgttgaatttggttatttggatgacgtggaattatcaaaaattgcaagttttgagaccgcacttttagattattctaaccgtaatcacgctgaatttatgcaagagcttaataaaaccggtaactataatgatgaaatcaaagatacgttaaaaagtattttagatggttttaaagcgaatagtgcttgg

SEQ ID NO: 3598 - protein, 513 aa, Haemophilus influenzae
  Name: NTH2002
MQLNSTEISELIKKRIAQFDVVSEARNTGTIVSVSDGIIRIHGLSDVMQGEMIALPGNRYAMALNLERDSVGAVVMGPYADLAEGMEVQCTGRILEVPVGSGLLGRVVNTLGQPIDGKGEIENDDFSPVEVIAPGVIDRRSVDQPVQTGYKAVDSMVPIGRGQRELIIGDRQTGKTALAIDAIINQRNSGIKCIYVAIGQKASTIANVVRKLEEHGALANTIVVAASASESAALQYLAPYAGCAMGEYFRDRGEDALIVYDDLSKQAVAYRQISLLLRRPPGREAYPGDVFYLHSRLLERASRVNEDYVEKFTKGEVKGKTGSLTALPIIETQAGDVSAFVPTNVISITDGQIFLESNLFNSGIRPAVNPGISVSRVGGSAQTKVIKKLAGGIRTALAQYRELAAFAQFASDLDDATRKQLSHGEKVTELLKQKQFAPLSVAEQAVILFAVEFGYLDDVELSKIASFETALLDYSNRNHAEFMQELNKTGNYNDEIKDTLKSILDGFKANSAW

SEQ ID NO: 3599 - DNA, 867 bp, Haemophilus influenzae
  Name: NTH2003
atggcaggtgcaaaagagataaaaaccaaaattgccagtgtacaaagtacacaaaaaatcactaaggcaatggaaatggtggcaacctcgaaaatgcgtaaaacgcaggatcgtatggctgcatctcgtccgtattctgaaactatccgtaacgttattagtcatgtgtctaaggcaagtatcggttataaacatccgttcttagttgagtgcgaagtgaagaaaatcggtatcttggttatttcaacagatcgtgggatgtgtggtgggttaaatgttaatttattcaaaaccacacttaaccaaataaaaaattggaaagaacaaaatatttctacagatttgggcttaataggttcaaaagggattagttttttccgttcctttggatttaatatcaaaggtcagctttctggtttaggcgatacgcccgctctagaagagttaattggtgtggcaaatacaatgtttgatgcttatcgtaatggtgaaattgatgcagtttatattgcatacaataaatttgttaatacgatgtcgcaaaaacctgttgtgcaacagttagttcctttaccagaatctaaagacgatcatttaaatgaaagacaacagacttgggattatctttatgagccagaaccaaaggcacttttagatagccttttagttcgttatttagagtcccaaatttatcaagcggttgtagataatttagcttcagaacaagcggctcgaatggtagcaatgaaagcagcaacggataatgcaggtaatttaattaatgatctgcggttggtgtacaacaaagctcgtcaagcaagtatcacaaatgaattgaatgaaatcgtagccggtgcggcggcgatt

SEQ ID NO: 3600 - protein, 289 aa, Haemophilus influenzae
  Name: NTH2003
MAGAKEIKTKIASVQSTQKITKAMEMVATSKMRKTQDRMAASRPYSETIRNVISHVSKASIGYKHPFLVECEVKKIGILVISTDRGMCGGLNVNLFKTTLNQIKNWKEQNISTDLGLIGSKGISFFRSFGFNIKGQLSGLGDTPALEELIGVANTMFDAYRNGEIDAVYIAYNKFVNTMSQKPVVQQLVPLPESKDDHLNERQQTWDYLYEPEPKALLDSLLVRYLESQIYQAVVDNLASEQAARMVAMKAATDNAGNLINDLRLVYNKARQASITNELNEIVAGAAAI

SEQ ID NO: 3601 - DNA, 228 bp, Haemophilus influenzae
  Name: NTH2005
gtgcggcggcgatttaagaaaagaggaacggtaatgtcagcaggaaaaattgtacaaatcatcggtgcggtgattgatgttgaatttccacaagatgcggtgccaaaagtttacgatgcattaaaagttgaatcaggtttaacacttgaggtgcaacaacaattaggtggcggagtagttcgttgtattgcattgggtacatctgatggtttaaaacgtggcttaaag

SEQ ID NO: 3602 - protein, 76 aa, Haemophilus influenzae
  Name: NTH2005
VRRRFKKRGTVMSAGKIVQIIGAVIDVEFPQDAVPKVYDALKVESGLTLEVQQQLGGGVVRCIALGTSDGLKRGLK

SEQ ID NO: 3603 - DNA, 1116 bp, Haemophilus influenzae
  Name: NTH2007
atgaatgtgttgggcgaaccaattgacgaacaaggagcaattggtgaagaagagcgttgggctatccaccgttcggcaccgagctatgaagaacaatcaaacagtacggaattattagaaactggtatcaaagtgatcgacttaatttgtccattcgcaaaaggtggtaaagttggtttattcggcggtgcaggtgtaggtaaaaccgtaaatatgatggagttgattcgtaatattgcgattgagcattcaggttactctgtatttgcgggtgtaggcgaacgtactcgtgaaggtaatgacttctatcatgaaatgaaagattctaacgtattagataaagtatctttggtttatggtcaaatgaacgagccaccaggtaaccgtttacgtgttgcattgactggtttaactatggctgaaaaattccgtgatgaaggtcgagatgtattattctttgtggataatatctatcgttatacccttgctggtacggaagtatctgcgttattaggtcgtatgccatccgcggtaggttaccaaccgacattggcagaagaaatgggtgtgttacaagaacgtatcacttcaaccaaaacaggttctatcacttctgtgcaagcggtgtacgtaccagcggatgacttaactgacccatctccagcaacaactttcgcacatttagactcaactgttgtattaagtcgtcaaatcgcatctttaggtatttaccctgcagttgatccattagattcaacttcacgtcagttagacccgcttgttgttggtcaagaacattatgatgttgctcgtggtgtacaaggtattttacaacgttataaagaattgaaagatattatcgcaattcttggtatggatgaattatctgaagaagataaactagtggtagcacgtgcacgtaaaattgaacgtttcttatcacaaccattctttgttgcagaagtcttcacaggttcaccaggtaaatacgtgacattaaaagacaccatccgtggcttcaaaggtatcttagatggcgaatatgaccatattcctgaacaagcgttctatatggttggttcaatcgatgaagtgttagaaaaagccaaaaatatg

SEQ ID NO: 3604 - protein, 372 aa, Haemophilus influenzae
  Name: NTH2007
MNVLGEPIDEQGAIGEEERWAIHRSAPSYEEQSNSTELLETGIKVIDLICPFAKGGKVGLFGGAGVGKTVNMMELIRNIAIEHSGYSVFAGVGERTREGNDFYHEMKDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRQIASLGIYPAVDPLDSTSRQLDPLVVGQEHYDVARGVQGILQRYKELKDIIAILGMDELSEEDKLVVARARKIERFLSQPFFVAEVFTGSPGKYVTLKDTIRGFKGILDGEYDHIPEQAFYMVGSIDEVLEKAKNM

SEQ ID NO: 3605 - DNA, 441 bp, Haemophilus influenzae
  Name: NTH2008
ttgaaggagaacaaaatggcgacatttaatttaacaatagtaagcgcagagcagaaaatctttgaaggtgaagtaaaacaaattcaggtaactggtgtggaaggggagcttggtattttgcccggacatacgccattgctaacagcaattaagcctgggattgttaaatttactcttaaagatgggaatgaagaagttatctatgtttctggtggttttttagaagttcaagcaaatattgtgacagtattagcagatattgctattcgaggtagtgaattagatgcagatcgtattcacgaagcaaaacgtaaagcagaagaaaatatagtatctcgcggatctgatgcagatcacgacttacttgttgcaaaactttctaaagagttagcaaaacttcgagcttatgaactcactgaaaaactattgaaaacaagacga

SEQ ID NO: 3606 - protein, 147 aa, Haemophilus influenzae
  Name: NTH2008
LKENKMATFNLTIVSAEQKIFEGEVKQIQVTGVEGELGILPGHTPLLTAIKPGIVKFTLKDGNEEVIYVSGGFLEVQANIVTVLADIAIRGSELDADRIHEAKRKAEENIVSRGSDADHDLLVAKLSKELAKLRAYELTEKLLKTRR

SEQ ID NO: 3607 - DNA, 162 bp, Haemophilus influenzae
  Name: NTH2009
ttgccagttagccttgtttggaaagctcgtcgtgcccacgctaatttgccatacaaagtgtggggaggaaatctgactttaattatcgtattggtattaggcgtgatcattacatccattccatttgcgattcgtgcgggttatttaccctttgttgtaggt

SEQ ID NO: 3608 - protein, 54 aa, Haemophilus influenzae
  Name: NTH2009
LPVSLVWKARRAHANLPYKVWGGNLTLIIVLVLGVIITSIPFAIRAGYLPFVVG

SEQ ID NO: 3609 - DNA, 351 bp, Haemophilus influenzae
  Name: NTH2010
atggctcgtgtaaaacgtggtgttattgcaagagcacgccataagaaagttcttaaggctgctaaaggttattatggtgcacgttcacgcgtgtatcgcgttgctttccaagcggtgatcaaagctggtcaatacgcatatcgtgaccgtcgtcaacgtaaacgtcaattccgtcaattatggattgcacgtatcaacgctgcagcgcgtcaaaacggtttatcttacagcaaattcatcaacggcttgaaaaaagcatctgttgaaatcgaccgtaagattcttgctgatatcgctgtattcgacaaagtagcgtttgctgcattagttgaaaaagcaaaatctgcactt

SEQ ID NO: 3610 - protein, 117 aa, Haemophilus influenzae
  Name: NTH2010
MARVKRGVIARARHKKVLKAAKGYYGARSRVYRVAFQAVIKAGQYAYRDRRQRKRQFRQLWIARINAAARQNGLSYSKFINGLKKASVEIDRKILADIAVFDKVAFAALVEKAKSAL

SEQ ID NO: 3611 - DNA, 231 bp, Haemophilus influenzae
  Name: NTH2011
atggccgaaacaatcccactgaatcccatcacgctacctttaaatcaaattagcttaatcgaagcatctgctggtacgggaaaaacctacactattggttctttatatctccgacttttattaaaggcgggagaaaataatttttcacgtccattaaatgtggaagaaattctggtggtaacctttacggaaatggcaacagaagaactcaagaaaaaaatcgtgagcgta

SEQ ID NO: 3612 - protein, 77 aa, Haemophilus influenzae
  Name: NTH2011
MAETIPLNPITLPLNQISLIEASAGTGKTYTIGSLYLRLLLKAGENNFSRPLNVEEILVVTFTEMATEELKKKIVSV

SEQ ID NO: 3613 - DNA, 3258 bp, Haemophilus influenzae
  Name: NTH2012
atggatctggcggcgatttataccattcacggtttttgtcgccgtatgttgatgcaatatgctttccattctggcattcatttcaatttagaattaataaaagatcaatctgatttattagttcgttttgctaatgaattttggcgagagcatttttatccgttggattttgaatctgcgaattttatcgcgacagaattagtatcaccagcaaaggtgttgtctttgttgaaagcggatttaggtaaagatttgcaggtggagattgaaaataaacaggcgttatctgtaccaatacaaatctttttaccgcaatatcttggtggttatcaaaaggcgttgaatgaattaaaggcattttggttagaaagtgcggatgaaattttagcgattattaccaatgaactggagaaagattatccaaaagatcagttgaaatcgttaaatcgtaaaaagtaccaagtaaagcgtttaggggattggattaataaaatcaatcaatggtcaaataatcctagagattatcaaattaataccacattgaaagactatttcctacaatcatctattgagaaaaattgcgaagaatcaacggataaaaataaagataaaaaacccgcaacgcctttttattccccgatttttgcagagcttgaaaagcgcgttaatgccttaatgacaccagatttactaagcaaactcactctttatcattatcgacaaggcttacaacaaaaacttttagactataaactaaatcatcaagaaaaatcctttgatgatttattgcgtttgctttgtgaagccctgcaagatgcgcaaggggatgaattagcggaaatgattcgtttccaatatccttttgcgatgattgatgaatttcaggatacggattcacaacaatacgctattttttcaaaaatttatcgtgataatcccgaaaaaaatactggttttattatgattggtgatccgaagcaggcgatttatcgtttccgtggcgcagatatttttacttatctaaaagcctcagacgaagcccaatctcgctttgaactcactaaaaattatcgttcagagaagcatttggttgatggtgtaaatgctttattcgattttcctcaatcgccatttatttatcaaaatattaaatttactgctgttgattctcgtgatgatcatctgcgattttatttaaatggcaaagccgaaccagcttatcgtttttatctaactgaaagtgacaaagtgaataaaactgaaatggcaaaaatatgtgctatttctattcaacattggctaaaaagtgcggctgaaaatcaggcagtttttcaaaatgaagatactcgtaaaacattgcaagcggcaaatattgccgtattagtgcgtgataaaaatgaagcggctttagtaaaaaatgaattgcaaaaattagggatcgcgtcagtttatctttctgatcaaaatagcgtatttgatagcaatgttgcgaaagaattagcttgggtgcttaaagcctgtttgaatgtggcagaacgtccaattttgaacgcgattgcgaccgcactttttggcttaaatgcagcggatattcatcaaattcagcaaaatgaagcagattggcaacgttgggcagatagttttgctcaataccaacaaacttggcaacgccaaggaatattggcaatgttacatcaaattttattggagcaaggcatttcagaacgcttattaagccaagccacgggcgagcgagatttaacggatttcctacatttggcagaaattttacaacaagctgccacgctacacgaaagtgaatcggcattgctcagttggtttgaaaaacaaattcaaggcgaaggtcgtcaagaggctcaaattcgtttagaaagtgaacgccagttggtaaaaatagtgacaatccataaatctaaaggcttagaatatgatttagtttggctaccatttttagctgtgccgagcaaagatccaagtaaaaaagacatcaatatttattattctaaagaacgagatgaaaccttatgggatatagaaaatcgcaatttaaacgctctttgtgaagaaacttttgctgaagaattacgtttactttatgtggctttaacacgtgccaaatatcaaatggcattcgcgttgcctgcacaatttgataaaaaatggaatgccttacattatgtattaagccaaggtgaaataggcaaggaaataaatttgtcgaattctaaagataccgagacgttgttgcaagcctttaaagaaaaaatgcgagataatgtggaaatctgtactaagccaaatctagaggcttttccggctttatctatcaatacaaaaaatgatgagcttaaagccgcagaatttacgggcaatattgagcaagattggcgaataaccagttttacttcaattgaacaaggtcatcgccgacaaaattatttcgctgaaagtgcggagaaaaaacacgctgtttttgatgacgcaaaagattacgatagtcaaaatgctattgaaatatccaccgcacttttaaacgaaaatgaatcaaatattttagatttaccacgaggtaaacaagtcgggactgcattgcatcgccattttgaaaattgctatttttctgatttagcaaatatagaagaaattgacaaattaagacaatccttacagttagatgaaacttttacagagccgctacaaaattggctacaacagatttcacatacgccactttctcatgaaataggaatagcattagctgatttggcaaataaagattgcattaaagaaatgccattttatctggctatttgggaacattttgatgttgaagagtttaatcgcacattgaaagcccatcatcatttaccaagcgagccacttcaatttgagcaaattcaaggaatggtgagaggttcaattgacttagttttccgccataatggaaaatattatcttattgattataaatctaatttcttaggttcaacccttgctgactacaatcaagaggcattgaaaaaagaaatgttacacagtcactatgattggcaatatttaatttatacgctggcattacatcgttatttacaaagcgttgtgcctcattacgattatgcacgagatttcggcggggtattttatcttttcttacgtggaatgaacggtgaaccacaatctggcgtattttacgatcgtccaagcgttgaattaatcacagaattagacggggtgttt

SEQ ID NO: 3614 - protein, 1086 aa, Haemophilus influenzae
  Name: NTH2012
MDLAAIYTIHGFCRRMLMQYAFHSGIHFNLELIKDQSDLLVRFANEFWREHFYPLDFESANFIATELVSPAKVLSLLKADLGKDLQVEIENKQALSVPIQIFLPQYLGGYQKALNELKAFWLESADEILAIITNELEKDYPKDQLKSLNRKKYQVKRLGDWINKINQWSNNPRDYQINTTLKDYFLQSSIEKNCEESTDKNKDKKPATPFYSPIFAELEKRVNALMTPDLLSKLTLYHYRQGLQQKLLDYKLNHQEKSFDDLLRLLCEALQDAQGDELAEMIRFQYPFAMIDEFQDTDSQQYAIFSKIYRDNPEKNTGFIMIGDPKQAIYRFRGADIFTYLKASDEAQSRFELTKNYRSEKHLVDGVNALFDFPQSPFIYQNIKFTAVDSRDDHLRFYLNGKAEPAYRFYLTESDKVNKTEMAKICAISIQHWLKSAAENQAVFQNEDTRKTLQAANIAVLVRDKNEAALVKNELQKLGIASVYLSDQNSVFDSNVAKELAWVLKACLNVAERPILNAIATALFGLNAADIHQIQQNEADWQRWADSFAQYQQTWQRQGILAMLHQILLEQGISERLLSQATGERDLTDFLHLAEILQQAATLHESESALLSWFEKQIQGEGRQEAQIRLESERQLVKIVTIHKSKGLEYDLVWLPFLAVPSKDPSKKDINIYYSKERDETLWDIENRNLNALCEETFAEELRLLYVALTRAKYQMAFALPAQFDKKWNALHYVLSQGEIGKEINLSNSKDTETLLQAFKEKMRDNVEICTKPNLEAFPALSINTKNDELKAAEFTGNIEQDWRITSFTSIEQGHRRQNYFAESAEKKHAVFDDAKDYDSQNAIEISTALLNENESNILDLPRGKQVGTALHRHFENCYFSDLANIEEIDKLRQSLQLDETFTEPLQNWLQQISHTPLSHEIGIALADLANKDCIKEMPFYLAIWEHFDVEEFNRTLKAHHHLPSEPLQFEQIQGMVRGSIDLVFRHNGKYYLIDYKSNFLGSTLADYNQEALKKEMLHSHYDWQYLIYTLALHRYLQSVVPHYDYARDFGGVFYLFLRGMNGEPQSGVFYDRPSVELITELDGVF

SEQ ID NO: 3615 - DNA, 864 bp, Haemophilus influenzae
  Name: NTH2013
atgttatctgtattacacaaacttaaagagcagcgcattctttctcaaggtgattattattttgctaagttgatagctgataaacaatgtcatacggattatgcggaaccaatcaaaaatttagctatattattagccgcactttgtagttggcgttatacgcagggaaatacttgcagccaattagatcgctatttagaacataatttatttggcttggcttatcgcactacagaagaagactatttagctgaaattcgtgaaaagattggttatttagctgtggaagattggcaaaatgcgttgtgcgggcatatggcatttacgcaagatcccgtcaatcaaattgcaccaatggtatttcaatttggcgcgttgtatttctatcgtacttggcaagatgaatatcgtatcgcgcaatatataaaaaacactttaaaaaaacaccgcactttagccttttcttatgatgaaattcatcaaaaattagagaaatatttccctgaaaaacaggaaaaaacagattggcaaaaagtggcagtggcgacagcgattaaaagtccattttcgattattacgggtggcccaggaacaggaaaaaccacgacagttacgcgtttattgctcgttctacaagaattatttgattgtaaattacacatcaaattggttgcaccgactggcaaagccgcctcccgtttggaagagtcgattaaaaatgcgttaggttttatgcaagaaaaaatgaatgtatcccattcacttttcaatgcgattccacaaaaagccagcaccttgcatagtttactgggcgtgaacgcctttaatgattacacgcgctataacagccataaccctttgcat

SEQ ID NO: 3616 - protein, 288 aa, Haemophilus influenzae
  Name: NTH2013
MLSVLHKLKEQRILSQGDYYFAKLIADKQCHTDYAEPIKNLAILLAALCSWRYTQGNTCSQLDRYLEHNLFGLAYRTTEEDYLAEIREKIGYLAVEDWQNALCGHMAFTQDPVNQIAPMVFQFGALYFYRTWQDEYRIAQYIKNTLKKHRTLAFSYDEIHQKLEKYFPEKQEKTDWQKVAVATAIKSPFSIITGGPGTGKTTTVTRLLLVLQELFDCKLHIKLVAPTGKAASRLEESIKNALGFMQEKMNVSHSLFNAIPQKASTLHSLLGVNAFNDYTRYNSHNPLH

SEQ ID NO: 3617 - DNA, 141 bp, Haemophilus influenzae
  Name: NTH2014
gtgttagttgtcgatgaaacatcaatgattgatttgccgatgatggtaaaacttatcaatgcgttaaagcccgaaacccgattaatttataggcgatcaggcacaattagcctctgtgaggcgggggctgtatgggggaat

SEQ ID NO: 3618 - protein, 47 aa, Haemophilus influenzae
  Name: NTH2014
VLVVDETSMIDLPMMVKLINALKPETRLIYRRSGTISLCEAGAVWGN

SEQ ID NO: 3619 - DNA, 582 bp, Haemophilus influenzae
  Name: NTH2016
gtggacgatttacgtaaacaaaaaattgatcctaacgctaaaaatgaacaaggcatttcctatgccgaagccattcaagcgcaatttaattctgtgagatttttaaccgcacttcgtaataacaatttaggtgtcgaaaatctcaataaagaaattgcgttagcgttgcgagagcaaaaattgctttggttccgtaatgaacaagattggtatatcggcaagccaattatgattactgaaaatgatcataacgttcgcctttataacggcgatattggactatgcttggcaaatggcaaagtatggtttggcaatcgagaagtgctgacaaaccgaattccagcgcacgaacccgcttttatgatgacgattcataaatctcaaggttccgaatttgaacacactgtcatggtgcttccaacagaagtaaatccagtactgtcgcgagaattagttttcacgggcgtcactcgtgcgaaaaaagaactcactgtatttgccgatgaaaaaatatggaaaacagcgattcgtcagaccgtcaaacgccagagcggattgggaaaattattggaagatttaaat

SEQ ID NO: 3620 - protein, 194 aa, Haemophilus influenzae
  Name: NTH2016
VDDLRKQKIDPNAKNEQGISYAEAIQAQFNSVRFLTALRNNNLGVENLNKEIALALREQKLLWFRNEQDWYIGKPIMITENDHNVRLYNGDIGLCLANGKVWFGNREVLTNRIPAHEPAFMMTIHKSQGSEFEHTVMVLPTEVNPVLSRELVFTGVTRAKKELTVFADEKIWKTAIRQTVKRQSGLGKLLEDLN

SEQ ID NO: 3621 - DNA, 339 bp, Haemophilus influenzae
  Name: NTH2018
ttgcaagaagctaaagcccaagaattattagaatcccaaaattatccttcacaaattgaagaatggattaaaaatcatctttctccagccttaccaattaagcttgatcaagccattcgtgcccgccgtaaacgcttttttaatggagaaaaacaacataccaagaaaaaatccattgatttggaatatgctgtttggctacgtctttctaaatattctcgaaaaatgaagatgacactttcggaaacaattacctatatgattgacgaaagagaaagcaaggcacaatttgaaaatcaaatggcagcaatgaaaaccagtttgaagaatttattaaaa

SEQ ID NO: 3622 - protein, 113 aa, Haemophilus influenzae
  Name: NTH2018
LQEAKAQELLESQNYPSQIEEWIKNHLSPALPIKLDQAIRARRKRFFNGEKQHTKKKSIDLEYAVWLRLSKYSRKMKMTLSETITYMIDERESKAQFENQMAAMKTSLKNLLK

SEQ ID NO: 3623 - DNA, 90 bp, Haemophilus influenzae
  Name: NTH2019
atgcagttaccacgtcactcaatgataaaaaatgaaataccaaaaactcgaaaatcaagaatcaaattggaaatggatttacctaattcg

SEQ ID NO: 3624 - protein, 30 aa, Haemophilus influenzae
  Name: NTH2019
MQLPRHSMIKNEIPKTRKSRIKLEMDLPNS

SEQ ID NO: 3625 - DNA, 303 bp, Haemophilus influenzae
  Name: NTH2020
atgtttaatttaaagcgtgagcattttagagatgattatctttataggttttatcaatatggtgatactcatagtaagattccttctaatttgtataaagtattggcaagaaaattagatatgataagtgcctcagaaaatatcaacgatttacgttctccaccagctaaccatttggagttgcttgagccaaaagaaaataaaatttattctattcgagtgaataaacaatatcgtttaatttttaaatatgaaaataacgaagtaaataatttatatttagatccacattcttataatttg

SEQ ID NO: 3626 - protein, 101 aa, Haemophilus influenzae
  Name: NTH2020
MFNLKREHFRDDYLYRFYQYGDTHSKIPSNLYKVLARKLDMISASENINDLRSPPANHLELLEPKENKIYSIRVNKQYRLIFKYENNEVNNLYLDPHSYNL

SEQ ID NO: 3627 - DNA, 321 bp, Haemophilus influenzae
  Name: NTH2021
atgatgacgagaaaacccacctctgttggtgaaattctacaagaagagtttttagaacctttaagtcttaaaattagtgatttagctcaaattttagatgtacatcgtaatacggcaagcaatattgttaataatagttcacgaattacgctagaaatggcagttaaacttgctaaagtatttgatactacgcctgagttttggcttaatctgcaaacacgtattgatttatgggaccttgaacacaataaacgttttcaacaaagtcttgcaaatgttaagcccgctctacatcggcatgatacttctacatttgcaatg

SEQ ID NO: 3628 - protein, 107 aa, Haemophilus influenzae
  Name: NTH2021
MMTRKPTSVGEILQEEFLEPLSLKISDLAQILDVHRNTASNIVNNSSRITLEMAVKLAKVFDTTPEFWLNLQTRIDLWDLEHNKRFQQSLANVKPALHRHDTSTFAM

SEQ ID NO: 3629 - DNA, 1668 bp, Haemophilus influenzae
  Name: NTH2022
atgtcatctcaatttgtgtatacgatgcatcgtgtcggcaaagtagtgccgccgaagcgtcatattttgaaagatatttctttaagctttttccctggtgctaagatcggggttttaggtttaaatggtgcgggtaaattgactcttttacgcattatggcaggcgtagataaagagtttgaaggggaagctcgtccacaaccgggtattaaaattgggtatcttccgcaagagccaaaactcgagccacaacaaaccgtgcgtgaagcagtggaagaagcggtttctgaagtgaaaaatgcactgactcgtttagatgaagtgtatgcgctttatgcggatcctgatgcagattttgataaattagcggcagaacaagccaatcttgaagctatcattcaagcgcatgatgggcataatttagataaccaattagagcgtgcggcagatgcgttacgtttacctgattgggatgccaaaattgaacatttatctggtggtgagcgtcgccgagtggcactttgccgcttattactcgaaaaaccagatatgttgttgttagatgaaccaactaaccacttagatgcggaatctgtggcgtggttagagcgattcttacacgactacgagggtacagtggtagcaatcactcacgaccgttatttcttagataatgtggctggttggatcttagagcttgaccgtggcgagggcattccttgggaaggcaactattcttcttggttagagcaaaaagagaaacgtttagaacaagaacaagcaactgaaaacgcacgtcaaaaatccattgcgaaagagttagaatgggttcgtcaaaatccaaaaggtcgccaagcgaaaagcaaagcacgtatggctcgttttgatgaattgaactctggcgaatatcaaaaacgaaacgagacgaacgaactctttattccacctggcccacgcttaggcgataaagtgattgaagtgcaaaacttaaccaagtcttatggcgaccgcactttaattgatgatttatcattcagtattccaaaaggggcaattgttgggattatcggagcgaacggtgcaggtaaatcaaccttattccgtatgttgtcaggtcaagaacaaccagattcaggttctgtgacaatgggcgaaaccgttgtgcttgcttcggtagatcagttccgtgactcaatggatgacaagaaaactgtgtgggaagaagtgtctaatggacaagacattcttactatcggcaactttgaaattccaagccgtgcttatgtggggcgtttcaacttcaaaggtgtagatcaacaaaaacgtgtgggggaattatcgggcggtgaacgtggtcgtttacacttagcgaaacttctacaacgtggtggtaacgtgctattactggacgaaccaaccaatgacttagatgttgaaaccttgcgtgccttagaaaatgcgatcttagaattcccaggctgtgcaatggttatttcgcacgaccgttggttcttagaccgtatcgcaacgcatattttagactacggcgatgaaggtaaagtcacgttctatgaaggtaacttctcagactacgaagagtggaaaaagaaaaccttaggcgatgcagccactcagccacatcgtattaaatataaacgtattgcgaag

SEQ ID NO: 3630 - protein, 556 aa, Haemophilus influenzae
  Name: NTH2022
MSSQFVYTMHRVGKVVPPKRHILKDISLSFFPGAKIGVLGLNGAGKLTLLRIMAGVDKEFEGEARPQPGIKIGYLPQEPKLEPQQTVREAVEEAVSEVKNALTRLDEVYALYADPDADFDKLAAEQANLEAIIQAHDGHNLDNQLERAADALRLPDWDAKIEHLSGGERRRVALCRLLLEKPDMLLLDEPTNHLDAESVAWLERFLHDYEGTVVAITHDRYFLDNVAGWILELDRGEGIPWEGNYSSWLEQKEKRLEQEQATENARQKSIAKELEWVRQNPKGRQAKSKARMARFDELNSGEYQKRNETNELFIPPGPRLGDKVIEVQNLTKSYGDRTLIDDLSFSIPKGAIVGIIGANGAGKSTLFRMLSGQEQPDSGSVTMGETVVLASVDQFRDSMDDKKTVWEEVSNGQDILTIGNFEIPSRAYVGRFNFKGVDQQKRVGELSGGERGRLHLAKLLQRGGNVLLLDEPTNDLDVETLRALENAILEFPGCAMVISHDRWFLDRIATHILDYGDEGKVTFYEGNFSDYEEWKKKTLGDAATQPHRIKYKRIAK

SEQ ID NO: 3631 - DNA, 381 bp, Haemophilus influenzae
  Name: NTH2024
gtggattttgaccgcacttttcttacttttttgggagtgattatgttagttgatttacatatttttttcgcctttttaagtttggcattgttagtaattcgtggtgcaatgcagcttaatggtaaaaattggcgttcgataaaattattaaaaattttaccgcacttatcagataccttgctgattgtgtctggcgtcgtcattttatacctctttgcttttggtattgaatggtggttagtggctaaattcgcattactgattttgtatattgtgtttgctgcaaaatttttcagtaaaaaagtttctcaacccaaaagcattttcttttggcttgcttgcgtaagttttattggtgcgatgttaattgcctatttaaaa

SEQ ID NO: 3632 - protein, 127 aa, Haemophilus influenzae
  Name: NTH2024
VDFDRTFLTFLGVIMLVDLHIFFAFLSLALLVIRGAMQLNGKNWRSIKLLKILPHLSDTLLIVSGVVILYLFAFGIEWWLVAKFALLILYIVFAAKFFSKKVSQPKSIFFWLACVSFIGAMLIAYLK

SEQ ID NO: 3633 - DNA, 1095 bp, Haemophilus influenzae
  Name: NTH2025
atgtcatctcgccagcttcaaattttaatctgcaaaactttgccgcttgtgcctgataacgtattaattatcggcgaaagtggcattgctttttctaaagcaacgaatttgcttggacaagaatttgaacatatcttatttgatgcgcgaaatggcattcatcttgaagcgctggctattgcagctggaacactgaaaatgggcggcacactttgtttagtgttatctgattgggaaaatttatctcagcagcctgatcaagatagtttacgttggaatggaaatcagtcagcaatcgccacgcctaattttattgatcatttcaaacagtgcattgaacgttatcatttccccattttaagagaggaaagtgcggttgaatttcctacggttttttattctaacgaacatcacaaaaatgctacgttagcgcaacaacaaattatcgagactattttacaagccgagcaggatatttattttctaacctccaagcggggaagaggaaaatccgcattattgggtatgcttgctaaccaaattcaagcaccagtttatctcaccgcaccgaataaaagtgcggtgcattccgttattgaattttcagaacgagagatagaatttatcgcgcctgatgaactggctattcggttacaacatgaaccagaattcagtcaatcagcttggttgctggtagatgaagcggcggtaatcccattgccgttattgcaagaatattctcaatattttcaacatattgtcttcagcacaacaattcatagctatgaaggtacggggcgtggtttcgaattaaaatttaaacggaaaattcaccgcacttttcagcattttgagcttaaacagcccctacgttggcaagaaaatgacccgttagaacattttattgatgatcttttgttgctaaatgccgaagatgattttcagcactttgactataacaatattacttataacatagaggaaaacgctaaaaatctttccttcccctgcttgcgaggaaaggtgccccgaagggcggaagggggatttagatatagccagcctccctcaagctttggaagctcccctcacaag

SEQ ID NO: 3634 - protein, 365 aa, Haemophilus influenzae
  Name: NTH2025
MSSRQLQILICKTLPLVPDNVLIIGESGIAFSKATNLLGQEFEHILFDARNGIHLEALAIAAGTLKMGGTLCLVLSDWENLSQQPDQDSLRWNGNQSAIATPNFIDHFKQCIERYHFPILREESAVEFPTVFYSNEHHKNATLAQQQIIETILQAEQDIYFLTSKRGRGKSALLGMLANQIQAPVYLTAPNKSAVHSVIEFSEREIEFIAPDELAIRLQHEPEFSQSAWLLVDEAAVIPLPLLQEYSQYFQHIVFSTTIHSYEGTGRGFELKFKRKIHRTFQHFELKQPLRWQENDPLEHFIDDLLLLNAEDDFQHFDYNNITYNIEENAKNLSFPCLRGKVPRRAEGGFRYSQPPSSFGSSPHK

SEQ ID NO: 3635 - DNA, 894 bp, Haemophilus influenzae
  Name: NTH2026
ttggaagctcccctcacaagtaagggtagtaaaggaaaatataatcgtcaatttttatttcgagatttttatggcttaacgacattggcgcattatcgaacatcgccactcgatcttcgccgtttacttgatggagaaaatcaacgtttttattttgccgaatatcaacagaatttgctcggtgcaatttgggcattagaagaaggaaatatggctgatgatgagttgattattcaaattcaacaaggcaaacgccgcccgaaagggaatcttgttccacaggcgttatgtttctatgaaaacttgcctcaagcctgtaaattacgatctttacgtatttctcgtatagcggttcagccaaattggcagcaaaagggcattgggcaaaatttgatgcaagccatggaaaatgccgatgtggattttctttcagtgagttttggctacaccgacgaactggcaaaattttggcaaaagtgcggttttgttttggtgcatttaggcgagcatcaagaagcgagtagtggttgttattcagcgattgcccttaaaggactttccaaagaaggcttggctttagttgatactgcgtacaaacaatttcagcgtaatctccctttatcttttcatccgtttgccataaattttgagcaaaatcagcttgattggcagcttgatgattttgattggatgagcttaaaaaacttcgctaattttcaccgcactttattttcgagcgttcctgcgatgaggcgtttattaaaattagcgggcaaagaaaatttcccattaatttccgcttatttaacaaaaaaacaacttcctattaacaagaaaaaaggcgtagaatgtttgcgtttagaaattaaacaatatttagagcgaggaacttta

SEQ ID NO: 3636 - protein, 298 aa, Haemophilus influenzae
  Name: NTH2026
LEAPLTSKGSKGKYNRQFLFRDFYGLTTLAHYRTSPLDLRRLLDGENQRFYFAEYQQNLLGAIWALEEGNMADDELIIQIQQGKRRPKGNLVPQALCFYENLPQACKLRSLRISRIAVQPNWQQKGIGQNLMQAMENADVDFLSVSFGYTDELAKFWQKCGFVLVHLGEHQEASSGCYSAIALKGLSKEGLALVDTAYKQFQRNLPLSFHPFAINFEQNQLDWQLDDFDWMSLKNFANFHRTLFSSVPAMRRLLKLAGKENFPLISAYLTKKQLPINKKKGVECLRLEIKQYLERGTL

SEQ ID NO: 3637 - DNA, 171 bp, Haemophilus influenzae
  Name: NTH2027
atgacagaacaaaccgcaaaaccaaaaggctggtttaaacgcgcacttgaaaaatatgacaacttcattaaagaatggggtttagatcaaccgaattgtagctgcgtgcctatgtcagcaacagaagatgaaaatggtaatttgaagacaaaagaatcttctttaaagaaa

SEQ ID NO: 3638 - protein, 57 aa, Haemophilus influenzae
  Name: NTH2027
MTEQTAKPKGWFKRALEKYDNFIKEWGLDQPNCSCVPMSATEDENGNLKTKESSLKK

SEQ ID NO: 3639 - DNA, 1305 bp, Haemophilus influenzae
  n 1303: n is any nucleotide
  Name: NTH2028
atgaaaacggcttttttccaacctgatattccaacccaacccaatgatcacaaaattttaggcaatgtattaccaggcgctgatgcattggcgattagtgaaattgcagagcaaaaccaaaatttaaccgtagtggtgactccagatacacgaagtgcggtgcgtttatcacgtgttttatcggaattaagcagtcaaaatgtatgccttttccctgattgggaaaccttaccttacgatactttttctccccatcaagaaattatttcctctcgtttaagtgcgcttttccatttacaaaatgcgaaaaaaggcattttcttattgccgatttcgacattaatgcaacgcctttgcccgccacaatatttacaacacaatgtgcttctgattaaaaaaggcgatcgtttggtcatcgataaaatgtgcttacaattagaagcagcgggctatcgagctgtggagcaagtattagaactcggcgagtccgcagttcgtggttccttggtggatcttttcccaatgggaagtgcggtgccttttcgccttgatctttttgatgatgaaattgattctattcgcacttttgatgtggatacgcaacgcactcttgatgaaattaactcaatttatcttttgccagctcacgaatttccaacggtcgacaaagggattgaatttttccgtgcgcaatttcgtgaaacttttggggagattcgccgagatcccgaacatatttatcagcaaatcagtaaaggtaccttgatttctggcattgaatattggcagccacttttctttgttgaaatggcaactttatttgattatttgccggagcaaacgctgtttgtagatatggaaaataatcaaacgcaaggcgagcgtttttatcaagatgccaaacagcgttatgaacaacgtaaagtggatccgatgcgtccgcttttatcgcctgaaaaattatggcttaatgtagatgaagtcaatcgccgattgaaatcttatccacgtattacatttaaagcggaaaaagtgcggtcatcggtacgccagaaaaatttacctgttgccgctctaccagaagtgactattcaatcccagcaaaaagaaccattgggacaattacgtcaatttattgagcattttaaaggaaatgtactgttttctgtggagacggaaggtcgccgagagactttgcttgatttgctttcaccgttaaaactcaagccaaaacaaattcaatctttagaacagattgaaaatgaaaaatttagcttgttagtcagctctcttgacaaggttnta

SEQ ID NO: 3640 - protein, 435 aa, Haemophilus influenzae
  Xaa 435: Xaa is any amino acid
  Name: NTH2028
MKTAFFQPDIPTQPNDHKILGNVLPGADALAISEIAEQNQNLTVVVTPDTRSAVRLSRVLSELSSQNVCLFPDWETLPYDTFSPHQEIISSRLSALFHLQNAKKGIFLLPISTLMQRLCPPQYLQHNVLLIKKGDRLVIDKMCLQLEAAGYRAVEQVLELGESAVRGSLVDLFPMGSAVPFRLDLFDDEIDSIRTFDVDTQRTLDEINSIYLLPAHEFPTVDKGIEFFRAQFRETFGEIRRDPEHIYQQISKGTLISGIEYWQPLFFVEMATLFDYLPEQTLFVDMENNQTQGERFYQDAKQRYEQRKVDPMRPLLSPEKLWLNVDEVNRRLKSYPRITFKAEKVRSSVRQKNLPVAALPEVTIQSQQKEPLGQLRQFIEHFKGNVLFSVETEGRRETLLDLLSPLKLKPKQIQSLEQIENEKFSLLVSSLDKVX

SEQ ID NO: 3641 - DNA, 684 bp, Haemophilus influenzae
  Name: NTH2029
gtgcatcttgatcacggtgtgggacgttatggcggtttggtcaccttagatacaggcggcattaaagccgaatatttgctactaaattatgcaaatgaatcgaaactttatgtgccagtgacttcattacatttgattagccgttatgttggtggctctgatgaaagtgcgccattacataaattagggaacgaggcttgggcgaaatcacgccaaaaagctgcggagaaaattcgtgatgtggcggcagagttattagatgtttacgcacaacgtgaagcgaagaaaggctttgcctttaaatatgatcgtgaagaatttcaacaattttccgcaacctttccttttgaagaaacctacgatcaggaaatggcaattaatgcggtaatttcggatatgtgtcagcctaaggcaatggatcgccttgtttgtggtgatgtgggttttggtaaaactgaagtggcaatgcgcgctgcctttttggctgtgatgaatcataagcaagtagcagtgctagtgccaaccacactgttagcccaacagcattatgagaattttaaagatcgttttgcgaatttgcctgtgaatgtcgaagtgttatcgcgtttcaaaactgcgaaagaacaaaaaccaattctggaaaaccttgcagaaggaaaagtcgatatattaatttggtaccca

SEQ ID NO: 3642 - protein, 228 aa, Haemophilus influenzae
  Name: NTH2029
VHLDHGVGRYGGLVTLDTGGIKAEYLLLNYANESKLYVPVTSLHLISRYVGGSDESAPLHKLGNEAWAKSRQKAAEKIRDVAAELLDVYAQREAKKGFAFKYDREEFQQFSATFPFEETYDQEMAINAVISDMCQPKAMDRLVCGDVGFGKTEVAMRAAFLAVMNHKQVAVLVPTTLLAQQHYENFKDRFANLPVNVEVLSRFKTAKEQKPILENLAEGKVDILIWYP

SEQ ID NO: 3643 - DNA, 1176 bp, Haemophilus influenzae
  n 959: n is any nucleotide
  Name: NTH2030
ttgttgattattgatgaagaacatcgttttggtgtagggcaaaaagagaaaatcaaacagcttcgtgcgaatatcgatattcttacgctaacggcaacgccaattcctcgaacgcttaatatggcgatgaatggcattcgtgatctttccattatttccacacctcctgctcgccgattaagtattaaaaccttcgtccgtcagaatggcgatcttgttgtacgagaagcgattttgcgtgaaattctccgaggtgggcaggtttattatctccacaatgatgtcgcaagcattgaaaatacagcagaaaaactgaccacgcttgtgccagaggcgcgagtaattgtggggcacggacaaatgagagaacgtgagttagaacgtgtgatgagtgatttttatcatcagcgttataacgtcttagtttgttcaaccattatcgaaacgggtattgatgtaccaacggcaaataccattattattgaacgagcggatcattttggtttggctcagttgcatcaattacgtggacgagtcgggcgttcacatcatcaggcttatgcttatttgcttacgcccccacctaaaatgatgacaaaagatgctgaacgccgtctagatgcgttggaaaatcttgataatcttggggctggttttatcttggcaacccacgatttagagattcgtggtgctggcgaattacttggaaacgaacaaagtggacaaattgaaagcatcggtttttcgctttatatggaattattggatgcagcggttaaagcgttaaaagaagggcgtgaaccatcattagaagaattgacgcaacaacaagcggatattgaattgcgtgtgcctgctttactgcctgatgattatctaggagacgtgaatatgcgtttatccttttataaacgcattgctgcagcagagagtaaagcagaattagatgaattaaaagntgagttgattgacagatttggattattgcctgatgcaacgaaaaatttattacaaattacagagttgcgtttattggttgagccgttgaacgttgtgcgaattgatgctggaaccaaggcggttttattgaggttttcagcaaagcccaagggaatccagaaaatttattccattaattcaaaaagaacctattggtgtatcgatttgagggcccat

SEQ ID NO: 3644 - protein, 392 aa, Haemophilus influenzae
  Xaa 320: Xaa is any amino acid
  Name: NTH2030
LLIIDEEHRFGVGQKEKIKQLRANIDILTLTATPIPRTLNMAMNGIRDLSIISTPPARRLSIKTFVRQNGDLVVREAILREILRGGQVYYLHNDVASIENTAEKLTTLVPEARVIVGHGQMRERELERVMSDFYHQRYNVLVCSTIIETGIDVPTANTIIIERADHFGLAQLHQLRGRVGRSHHQAYAYLLTPPPKMMTKDAERRLDALENLDNLGAGFILATHDLEIRGAGELLGNEQSGQIESIGFSLYMELLDAAVKALKEGREPSLEELTQQQADIELRVPALLPDDYLGDVNMRLSFYKRIAAAESKAELDELKXELIDRFGLLPDATKNLLQITELRLLVEPLNVVRIDAGTKAVLLRFSAKPKGIQKIYSINSKRTYWCIDLRAH

SEQ ID NO: 3645 - DNA, 108 bp, Haemophilus influenzae
  n 92, 102, 104: n is any nucleotide
  Name: NTH2031
ttggtgtatcgatttgagggcccattaaaatttaagtttattgaagatcttatccgaaacaaagggccggtagaaattgggggggatttgtnaaaaacaacngntgca

SEQ ID NO: 3646 - protein, 36 aa, Haemophilus influenzae
  Xaa 31, 35: Xaa is any amino acid
  Name: NTH2031
LVYRFEGPLKFKFIEDLIRNKGPVEIGGDLXKTTXA

SEQ ID NO: 3647 - DNA, 258 bp, Haemophilus influenzae
  Name: NTH2032
gtgcagttatgggcgaaggcattaagtgcagttgttcgtatgctttatccaattacgccacatatctgttttgaattatggcaagctcttggcaatgaaagtgctattgatactgcagaatgggtaaaagtcgatgaagccgcaatggtagaagatgaaaaactgattgttgtgcaagtaaatggcaaggttcgtggcaaagttactgttgcggcagatgcagatgaagacacagtcaaaacgattgcttttgcgata

SEQ ID NO: 3648 - protein, 86 aa, Haemophilus influenzae
  Name: NTH2032
VQLWAKALSAVVRMLYPITPHICFELWQALGNESAIDTAEWVKVDEAAMVEDEKLIVVQVNGKVRGKVTVAADADEDTVKTIAFAI

SEQ ID NO: 3649 - DNA, 2064 bp, Haemophilus influenzae
  n 2045: n is any nucleotide
  Name: NTH2034
atgcaagaacaatatcgccccgatatgatcgaaccaaaggttcaacaatattgggcagaaaataaagttttcaaagcaatcaaagacgaatctaaagaaaaatattactgtctttctatgttcccatatccttctggtcgcctgcatatggggcacgtgcgtaactacactattggtgatgtcatttctcgttatcaacgcatgctaggcaaaaacgtattgcaaccatttggttgggatgctttcggcttacctgcggaaggggcagcaattaaaaataaaaccgcaccagcaaaatggacttacgaaaatatcgcctacatgaagaaacaacttcaacttttaggctttggttttgactgggatcgtgaaatcgcaacctgtaaaccagaatactacaaatgggaacaatggttcttcactgagctttacaaaaaaggcttagtgtacaaaaaaacctcaaccgtaaactggtgtccgaatgatgaaacagtactcgcaaacgagcaagtacacgaaggttgttgctggcgttgtgatacaccagtggaacaaaaagaaatcccacaatggtttatcaaaattactgactatgccgagcaattattaggtggtttagatgcccttccacaatggcctgacatggtaaaaaccatgcaacgtaactggattggtcgctctgaaggggtagaaattacctttgatgttgcaaataccaacgaaaaagtagcagtttacaccacgcgtccagataccttttacggcgtgagttatttaggcattgcagcggcacatccattagcaagtttagcagctcaaaacaattccgaattagccgcctttatccaagaagcgaaaaacgccaaagtggcagaagctgatcttgcgacaatggagaaaaaaggaatggcaacgggcttatttgctattcatccattgacgggcgaaaaattaccgatttgggtcgctaatttcgtgttaatgcactacggtactggcgcagtaatggcagttcctgctcacgaccaacgtgactttgaatttgctcaaaaatacagtttacaaatcaagcaagttattgaacccattgcagatgaagaaattgatttaactaaacaagctttcgttgagcacggtaaattagtgaactcagctgaatttgatggtaaagactttgatggtgcattcaacggtatcgcggataaattagaaaaattaggtgttggaaaacgtcaagttaattaccgtttacgtgactggggcgtttctcgccaacgttattggggtgcgccaattccgatgctaacccttgaaaatggcgatgtagtacctgcaccaatggaagatttacctattattctgcctgaagatgtggtaatggatggcgtaaaaaacccaattaaagcagatcctaactgggcaaaaacaacccttaacggcgcaccagcgttaaaagaaacggatacctttgatacctttatggaatcctcttggtattacgcgcgctacacttgtccacaatatcaaaatggcatgcttgatgcggaagaagcaaactattggttaccagtggatcaatatatcggtggtattgaacacgcaacaatgcacttactctacttccgcttcttccacaaattattgcgtgatgcaggatttgtaaccagtgacgaaccagccgataaattattatgtcaaggtatggtgcttgcagatgccttctactacacaagtccaaccaatgagcgtatttgggtaagtccaacactggtgactcttgaacgtgatgaaaaaggcagaattattaaagccaccgatcctgaagggcgtgaattagtccacagtggcatgaccaaaatgtcgaaatccaaaaataacggtattgacccacaagaaatggtagaaaaatatggtgccgatactgttcgcctctttatgatgtttgcctctccagcagaaatgaccttggaatggcaagaatctggcgtagaaggggcgaaacgtttcttagggcgtgtttggaattggtatatcaatatcaacanaatccagcacaaactagcc

SEQ ID NO: 3650 - protein, 688 aa, Haemophilus influenzae
  Xaa 682: Xaa is any amino acid
  Name: NTH2034
MQEQYRPDMIEPKVQQYWAENKVFKAIKDESKEKYYCLSMFPYPSGRLHMGHVRNYTIGDVISRYQRMLGKNVLQPFGWDAFGLPAEGAAIKNKTAPAKWTYENIAYMKKQLQLLGFGFDWDREIATCKPEYYKWEQWFFTELYKKGLVYKKTSTVNWCPNDETVLANEQVHEGCCWRCDTPVEQKEIPQWFIKITDYAEQLLGGLDALPQWPDMVKTMQRNWIGRSEGVEITFDVANTNEKVAVYTTRPDTFYGVSYLGIAAAHPLASLAAQNNSELAAFIQEAKNAKVAEADLATMEKKGMATGLFAIHPLTGEKLPIWVANFVLMHYGTGAVMAVPAHDQRDFEFAQKYSLQIKQVIEPIADEEIDLTKQAFVEHGKLVNSAEFDGKDFDGAFNGIADKLEKLGVGKRQVNYRLRDWGVSRQRYWGAPIPMLTLENGDVVPAPMEDLPIILPEDVVMDGVKNPIKADPNWAKTTLNGAPALKETDTFDTFMESSWYYARYTCPQYQNGMLDAEEANYWLPVDQYIGGIEHATMHLLYFRFFHKLLRDAGFVTSDEPADKLLCQGMVLADAFYYTSPTNERIWVSPTLVTLERDEKGRIIKATDPEGRELVHSGMTKMSKSKNNGIDPQEMVEKYGADTVRLFMMFASPAEMTLEWQESGVEGAKRFLGRVWNWYININXIQHKLA

SEQ ID NO: 3651 - DNA, 105 bp, Haemophilus influenzae
  Name: NTH2035
ttgccattttacggtattctatgccacattttctattgtcaaaatgctgcaaaagtgcggttaaaatttaaggtgattttatgcaagaacaatatcgccccgata

SEQ ID NO: 3652 - protein, 35 aa, Haemophilus influenzae
  Name: NTH2035
LPFYGILCHIFYCQNAAKVRLKFKVILCKNNIAPI

SEQ ID NO: 3653 - DNA, 843 bp, Haemophilus influenzae
  Name: NTH2036
ttgttttttacaataaattttcaatttttacagaacagattagaacaaaggaatccatggcaagccaatataacttatgatatagtttaccaccaaatttatagaggtctctcaataataaaaataatgatagagttggatcaaacaaatataccaaaacacgttgccattattatggatggtaatggccgttgggcaaaacagaaaaataaaatgcgaattttcggacacgccaatggcgttactgcggtacgcaaagcagtggcttatgcacgacaaatcggtgtggaagtactcacactttatgcctttagtagcgaaaattggagtcgcccagaacaagaaatcagcgcgttaatgtcgctttttatgcaagccttggatcgcgaagtgaaaaaattacataaaaataatatttgtctgaaaattataggcgatgtatctcgttttagtgaaactttacaagaaaaaatcaaaaaagcggaaaatttaacagaaaaaaataccgcacttacactcaatattgcggcaaattacggcggttgttgggatattattcaagccgctaaacaaattgcagaaaaagttaaaaaagaagaaatgtcagtttcagatattaataactcgacttttcaacatcatcttgcaacccaaaatgcaccacctgtggatttattaattcgcaccagtggagaacagcgcataagcaactttttattatggcaaattgcctatgcggaattatatttttccgatgtgctttggcctgattttaatcaattagaatttaatcacgcgattgcaagttatcaacaacgtcatcgccgttttggcgggactgaa

SEQ ID NO: 3654 - protein, 281 aa, Haemophilus influenzae
  Name: NTH2036
LFFTINFQFLQNRLEQRNPWQANITYDIVYHQIYRGLSIIKIMIELDQTNIPKHVAIIMDGNGRWAKQKNKMRIFGHANGVTAVRKAVAYARQIGVEVLTLYAFSSENWSRPEQEISALMSLFMQALDREVKKLHKNNICLKIIGDVSRFSETLQEKIKKAENLTEKNTALTLNIAANYGGCWDIIQAAKQIAEKVKKEEMSVSDINNSTFQHHLATQNAPPVDLLIRTSGEQRISNFLLWQIAYAELYFSDVLWPDFNQLEFNHAIASYQQRHRRFGGTE

SEQ ID NO: 3655 - DNA, 864 bp, Haemophilus influenzae
  Name: NTH2038
atgcttaaacaacgagttttatctgctattgtgttaattgctgcagttttatgtgcgctatttttattcacgcctttttattttgccctcgctttaggggcggtagcgattttaggcatttgggaatggactcaatttgctcgccttaaacaacctttgatacgtttttttgtggctacctttttaggcgtatttatcttcttatggctctatactgagggcaactatttagatgcagggcgtgtgtttgaacaacatcttcagcttttattgataaatgctgttagctggtggggtttagctttgttgcttgtgatcagttatcctaaatcagctaaattttggtctaaaaatccacttttacaacttttatttgccttttctacgttgattccatttgtcgcaggtgtattacgtttacgtttagaacactatacccatgatccttatcacggcttatttttattactttacgtatttatacttgtttgggcggctgattctggtgcttattttagcggacgcgcctttggcaaacgtaaacttgcccctaaagtatcgccaggtaaaagttgggaaggggtcattggtggattaattacagcattagtgctttcttttatctttattcatttctctaacaatactttagtaggcgatcgaaatattactggatttatcattctttctgtagcgacagttgcaatttcagtattgggcgatttaactgaaagtatgtttaaacgtgagtcaggagttaaagacagtagccaattgattcctggtcacggcggtgtgttagatcgcattgatagcttgactgccgcagtaccttttttcagctatttctatttctttgtctta

SEQ ID NO: 3656 - protein, 288 aa, Haemophilus influenzae
  Name: NTH2038
MLKQRVLSAIVLIAAVLCALFLFTPFYFALALGAVAILGIWEWTQFARLKQPLIRFFVATFLGVFIFLWLYTEGNYLDAGRVFEQHLQLLLINAVSWWGLALLLVISYPKSAKFWSKNPLLQLLFAFSTLIPFVAGVLRLRLEHYTHDPYHGLFLLLYVFILVWAADSGAYFSGRAFGKRKLAPKVSPGKSWEGVIGGLITALVLSFIFIHFSNNTLVGDRNITGFIILSVATVAISVLGDLTESMFKRESGVKDSSQLIPGHGGVLDRIDSLTAAVPFFSYFYFFVL

SEQ ID NO: 3657 - DNA, 99 bp, Haemophilus influenzae
  Name: NTH2039
atgtcatttttgtggtcactaggttcttttatcattgcgattgctgtattagtatccgttcacgaatatggtcactttgggcagcgagaaagtgcggta

SEQ ID NO: 3658 - protein, 33 aa, Haemophilus influenzae
  Name: NTH2039
MSFLWSLGSFIIAIAVLVSVHEYGHFGQRESAV

SEQ ID NO: 3659 - DNA, 1146 bp, Haemophilus influenzae
  Name: NTH2040
atgattcctttaggcggctatgtaaaaatgcttgatggacgtaatgaagtagttcctgctgagcaaaaatcacaagcatttgacagtaaaagcgtattacaacgcgcatttgtaattattgcaggccctttagctaattttatttttgcaatttttgcttattggatcatctacctttatggaatgccaacggttaaaccagtgattcaatcaataacaccaagttccatcgcagcacaagctcacattgaacctaatacacaaattctagcggttgatggcgaagaaactcaagattgggaaaccatcaatatgctacttgccacaaaaatgggtgagcctaatgttgaaattaccctttctcctttcaattctaatattgaacaacaacggactttaaatcttacaaattggatattcgatcctgaaaaagaaagtgcttttgaggcattagggattatgcctatgcgccctaaaattgaaatggtgctttctaaagttgttcaaaattctcccgctgagaaagctggtttacaaatcggtgataaaattttaaaagaaaatttaaccgcacttccttggcaagattttataaaacaggtcgaacaaggcgaatctttttctattaaagttgaacgtaatggagaaacatttgacaaagtcctaactccagtgcgtaatcaaaatggcaaatggtttgttggggttagcccaaccttgacaaaattagcggatgaataccgtactgaattaaaatatggtattcttgaatctttacaaaaaggcattgaaaaaacagggcagctttcccttttaaccttgaaaatattagggaaattacttactggcgatttgtcattaaataatttaagtgggccaatttctattgcaaaaggtgctggtgcatcagcaaatattggattggtgtattttttaagttttatggcattgattagtgtaaatttagggattatgaatttatttccattaccagtattagatggcggtcatttagtttttttaacaatggaagctgttaaaggaaaacctgtttctgagcgggtgcaaagcatctgttatcgaattggcgcagcactgttattaagcttaacggtgtttgcattatttaatgattttttacgtcta

SEQ ID NO: 3660 - protein, 382 aa, Haemophilus influenzae
  Name: NTH2040
MIPLGGYVKMLDGRNEVVPAEQKSQAFDSKSVLQRAFVIIAGPLANFIFAIFAYWIIYLYGMPTVKPVIQSITPSSIAAQAHIEPNTQILAVDGEETQDWETINMLLATKMGEPNVEITLSPFNSNIEQQRTLNLTNWIFDPEKESAFEALGIMPMRPKIEMVLSKVVQNSPAEKAGLQIGDKILKENLTALPWQDFIKQVEQGESFSIKVERNGETFDKVLTPVRNQNGKWFVGVSPTLTKLADEYRTELKYGILESLQKGIEKTGQLSLLTLKILGKLLTGDLSLNNLSGPISIAKGAGASANIGLVYFLSFMALISVNLGIMNLFPLPVLDGGHLVFLTMEAVKGKPVSERVQSICYRIGAALLLSLTVFALFNDFLRL

SEQ ID NO: 3661 - DNA, 849 bp, Haemophilus influenzae
  n 571, 633, 696, 718, 805, 823: n is any nucleotide
  Name: NTH2041
ttgcattatttaatgattttttacgtctataatttatataggatacaatcgatgaaaaaacttctaatcgcaagtttattattcggtacgacaacgactgtgtttgccgcaccttttgtggcaaaagatattcgtgtggatggtgttcaaggtgacttaaaacaacaaatccgagcaagtttacctgttcgtgccggtcagcgtgtgactgacaatgatgtggctaatattgtccgctctttattcgtaagtggtcgattcgatgatgtgaaagcgcatcaagaaggcgatgtgcttgttgttagcgttgtggctaaatcgatcatttcagatgttaaaatcaaaggtaactctattattcccactgaagcactaaaacaaaacttagatgctaacgggtttaaagttggcgatgttttaattcgagaaaaattaaatgaatttgccaaaagtgtaaaagaacactatgcaagtgtaggtcgctataacgcaaccgttgaacctattgtcaatacgctaccaaataatcgcgctgaaattttaattcaaatcaatgaagatgataaagcanaattggcatcattaactttcaaggggaacgaatctgttagtagcagtacattacaagaacanatggaattacaacctgattcttggtggaaattatggggaaataaatttgaaggtgcgcaattngagaaagatttggagtcaattngggatttattatttaataatgggctatgccaaagcaccaattactataaccgtgtggttagcttaatgctgaaaaaaacaaaaggtnatgggaaccattggtggnaaccggacggttccggcgtgcccttc

SEQ ID NO: 3662 - protein, 283 aa, Haemophilus influenzae
  Xaa 191, 211, 232, 240, 269, 275: Xaa is any amino acid
  Name: NTH2041
LHYLMIFYVYNLYRIQSMKKLLIASLLFGTTTTVFAAPFVAKDIRVDGVQGDLKQQIRASLPVRAGQRVTDNDVANIVRSLFVSGRFDDVKAHQEGDVLVVSVVAKSIISDVKIKGNSIIPTEALKQNLDANGFKVGDVLIREKLNEFAKSVKEHYASVGRYNATVEPIVNTLPNNRAEILIQINEDDKAXLASLTFKGNESVSSSTLQEXMELQPDSWWKLWGNKFEGAQXEKDLESIXDLLFNNGLCQSTNYYNRVVSLMLKKTKGXGNHWWXPDGSGVPF

SEQ ID NO: 3663 - DNA, 378 bp, Haemophilus influenzae
  n 69, 74, 78, 94, 238, 266, 268, 318, 320, 342, 362, 365, 369, 370, 371, 372, 373: n is any nucleotide
  Name: NTH2043
gtgatctgcgcggctttgcttccgcttctccacctctttcgtgcgcccccgccttattttctgctccgncgccncctncgttttcccgttcgtntcgtcgtttcctgctctgctctccgctggctgtcttcagtcatcctccgccttcttttctcctattcccccttccctcccttctctgttccacctctttttgttgttgcttgcgttcctctccctcgtgctcgccctcccgccncgtctgctctttcattctgctttgtttngncttgcctcttctctctcattgttccttcttcttcccctttcctcgtgacncncgtgtgttccctttcgtcgttncgcgttcttgtcgaacttcncancctnnnnnttaat

SEQ ID NO: 3664 - protein, 126 aa, Haemophilus influenzae
  Xaa 25, 32, 80, 89, 90, 107, 114, 121, 122, 124, 125: Xaa is any amino acid
  Name: NTH2043
VICAALLPLLHLFRAPPPYFLLRRXLRFPVRXVVSCSALRWLSSVILRLLFSYSPFPPFSVPPLFVVACVPLPRARPPAXSALSFCFVXXCLFSLIVPSSSPFLVTXVCSLSSXRVLVELXXLXXN

SEQ ID NO: 3665 - DNA, 768 bp, Haemophilus influenzae
  Name: NTH2044
atgcgtgacatttgcgatgcagtcgcacgaggcgaacaaaaagcacgtcgagctaaaaaagaaatggttgaagctaacttgcgtttagtaatttccatcgcgaaaaaatacacaaatcgaggtttacaattcttagatttaattcaagaagggaatatcggtttaatgaaagcggtagataaatttgaatatcgacgtggctacaaattctctacatatgctacttggtggattcgtcaagcaatcactcgctctattgcggatcaagcgcgtacaatccgtattcctgtgcatatgattgaaacaatcaataaacttaatcgtatttctcgccagttactacaagaaatgggacgtgaagcaacaccagaagaattggcagaacgtatgggaatgccagaagataaaatccgtaaagtactgaaaattgcaaaagagccgatttcgatggaaacacctattggcgatgacgatgattcacatttaggcgattttattgaagattcaaccttagaacttcctcttgattctgccacagcacaaagtttaaaagttgcaactcacgaagtgctagaaggcttgacgccacgtgaagcaaaagtattacgtatgcgttttggcattgatatgaataccgaccatacgcttgaagaagtgggtaaacaattcgatgtaacacgcgaacgtattcgtcaaattgaagcaaaagcattacgtaaattacgtcatcctagccgttctgaaacactgagaagttttttagatgaa

SEQ ID NO: 3666 - protein, 256 aa, Haemophilus influenzae
  Name: NTH2044
MRDICDAVARGEQKARRAKKEMVEANLRLVISIAKKYTNRGLQFLDLIQEGNIGLMKAVDKFEYRRGYKFSTYATWWIRQAITRSIADQARTIRIPVHMIETINKLNRISRQLLQEMGREATPEELAERMGMPEDKIRKVLKIAKEPISMETPIGDDDDSHLGDFIEDSTLELPLDSATAQSLKVATHEVLEGLTPREAKVLRMRFGIDMNTDHTLEEVGKQFDVTRERIRQIEAKALRKLRHPSRSETLRSFLDE

SEQ ID NO: 3667 - DNA, 900 bp, Haemophilus influenzae
  Name: NTH2045
atggaaaaaaatcaacaatctacggctgaacaatattcagaacaaattgagcaattgatggagctaggtcgtacacaagggtatttaacttttgctgaaatcaatgacttattgcccgaagatgctattgatcctgaatattacgacaaattgctacaaacgttgcaaaatgatgcaggtatccctgtattagatgaagcaccagaaagcgatgatatgatgttgagtgataccatccctgatgaagatgcagtggaagaagcaactcaaattctttcaaatgtagaatctgaaatcggtcgaacaacggatcccgtacgcatgtatatgcgcgaaatgggaacggtggatcttcttactcgtgaagatgaaattagcattgcaaaacgtattgaaggagggattgatgaagttcaaacctctatcgcagcctatcctgaagcattaaatggattactaaaaaactatgatgatgtagaaaaaggtaatttccgtttgaccgatttaattacgggttttgttgatccaaatgccgaaatagaagaacacaacggacttgatgaagacttttctgacgaagatgatgaagaagaatctagtaatgcagatgtggaagacaatgaatcagaatctacatcagattcaagcgactctgataacagtattgatcctgaagttgctcgcgaaaaatttcagcaattaagagaacagcactctaaaacccttgctgttattgaaaaacacggtcgctctggaaaacgtgcccaagatcaaattgcactacttggcgaaatttttaaacaattccgtttagtaccaaaacaatttgatttactcgttctatcaatgaaagaaatgatgaaacgtgtgcgctaccaagaacgtcagctacaaaaaaat

SEQ ID NO: 3668 - protein, 300 aa, Haemophilus influenzae
  Name: NTH2045
MEKNQQSTAEQYSEQIEQLMELGRTQGYLTFAEINDLLPEDAIDPEYYDKLLQTLQNDAGIPVLDEAPESDDMMLSDTIPDEDAVEEATQILSNVESEIGRTTDPVRMYMREMGTVDLLTREDEISIAKRIEGGIDEVQTSIAAYPEALNGLLKNYDDVEKGNFRLTDLITGFVDPNAEIEEHNGLDEDFSDEDDEEESSNADVEDNESESTSDSSDSDNSIDPEVAREKFQQLREQHSKTLAVIEKHGRSGKRAQDQIALLGEIFKQFRLVPKQFDLLVLSMKEMMKRVRYQERQLQKN

SEQ ID NO: 3669 - DNA, 1041 bp, Haemophilus influenzae
  Name: NTH2046
atggtttgtatgaagccttacaaaccaacgatgaacccaaacaattacttgttggttgaaggttatatggacgtggtggcattagcacaatttggcgtggattatgcggtcgcttctttaggtacgtccacgacatcagaacaaattcaacttatttttcgttcgaccgaacaggttgtttgttgttacgatggtgaccgtgcaggacgtgatgctgcttggcgagcactagaaaatgcgttgccttacttagaagatggcagacaactcaaatttattttcttgccagatggagaagatcctgatacttacattcgtcaatacggcaaagaaaaatttgaagaatacatcgaaagtgcgcaatctttaagcgagtttatgtttgcacatttaagtcctcaggttgatttttccactaaagaagggcgcggaaaattagttgcgctagctgcgccgttaattcaccaaattccaggagaaatgcttcgcttatcgctacgcaatatgcttgctcaaaaacttgggatttttgatcaaactcagctggaaaatcttattcccaaacaattagaacaagccaatacacaacaaaaagtcactcataataagatcaagaagacaccaatgcgaatggtcatttcattgcttctgcaaaatcctgagttagtaaaacgtatgtctgaaagcggcgtgcaagcattacgtgcagaagcagggtttgaaattctggaaaaattgaccgcactttgtcgccaacgagagggcattactacggggcaaattttggaatacttccgcaatacatcttacagtaatccccttgaaatactggcaacttgggatcatttattagacgaatccgacataatcaacgcattttctcaaaattaccgtcgcttaaatattcaagctattgagcgcgatattgaaatgcttattgctaaagaacgaacagagggtctcactaatgaagaaaaaacggtacttgtacatcttttagctggtaaagaacagcagaaaaaacagttagtgaatccgcta

SEQ ID NO: 3670 - protein, 347 aa, Haemophilus influenzae
  Name: NTH2046
MVCMKPYKPTMNPNNYLLVEGYMDVVALAQFGVDYAVASLGTSTTSEQIQLIFRSTEQVVCCYDGDRAGRDAAWRALENALPYLEDGRQLKFIFLPDGEDPDTYIRQYGKEKFEEYIESAQSLSEFMFAHLSPQVDFSTKEGRGKLVALAAPLIHQIPGEMLRLSLRNMLAQKLGIFDQTQLENLIPKQLEQANTQQKVTHNKIKKTPMRMVISLLLQNPELVKRMSESGVQALRAEAGFEILEKLTALCRQREGITTGQILEYFRNTSYSNPLEILATWDHLLDESDIINAFSQNYRRLNIQAIERDIEMLIAKERTEGLTNEEKTVLVHLLAGKEQQKKQLVNPL

SEQ ID NO: 3671 - DNA, 573 bp, Haemophilus influenzae
  Name: NTH2047
atggattatgacaaacttgaatttatagaggcgattgaagaacttgcagcaatggcagggcttgaaataccttacgaaaaacgcgctaatcacagcggaaaacctcaagctaattaccaaaccaaacgaaatctctatgaattaatgcaagagattgccacgttttatcaaaaccaattaccattaaatactcaagcacaagaatatttacaacaacgtgggctttcacctgaaattattgagcgtttccaaattgggtttgtgccgaatgcaatggatactgtactgcgtaaatttggtgttaatcgtgaagaacaacaaaaactcattgaattaggcatgctttctcgaaatgatcgtggcaatatttacgataaattccgaaatcgcatcatgtttccgattcgtgataaacgtggtcgcacagtggcttttggtgggcgtgtattaacagatgaaaaaccgaaatatctgaattcgccagaaaccattacttatcataaaggtaaggagctttatggtttgtatgaagccttacaaaccaacgatgaacccaaacaattacttgttggt

SEQ ID NO: 3672 - protein, 191 aa, Haemophilus influenzae
  Name: NTH2047
MDYDKLEFIEAIEELAAMAGLEIPYEKRANHSGKPQANYQTKRNLYELMQEIATFYQNQLPLNTQAQEYLQQRGLSPEIIERFQIGFVPNAMDTVLRKFGVNREEQQKLIELGMLSRNDRGNIYDKFRNRIMFPIRDKRGRTVAFGGRVLTDEKPKYLNSPETITYHKGKELYGLYEALQTNDEPKQLLVG

SEQ ID NO: 3673 - DNA, 156 bp, Haemophilus influenzae
  Name: NTH2048
atgaaaggttctattccacgcccctttattgatgatttgctgacaaagtccgatattgtcgatgtgattaacacgcgcgtaaaactaaaaaaagctggccgcgattatcaagcctgctgccctttccatcacgaaaaaactcccatccttcacagt

SEQ ID NO: 3674 - protein, 52 aa, Haemophilus influenzae
  Name: NTH2048
MKGSIPRPFIDDLLTKSDIVDVINTRVKLKKAGRDYQACCPFHHEKTPILHS

SEQ ID NO: 3675 - DNA, 213 bp, Haemophilus influenzae
  Name: NTH2049
atgcctgtaattaaagtacgtgaaaacgaatcatttgacgtagctttacgtcgtttcaaacgctcttgcgaaaaagcgggaatcttagctgaagtacgcgctcgcgaattttacgaaaaaccaactacaattcgtaaacgtgaaaatgcaacacttgcaaaacgtcacgcaaaacgcaacgctcgcgaaaacgcgcgcaatacccgtttatac

SEQ ID NO: 3676 - protein, 71 aa, Haemophilus influenzae
  Name: NTH2049
MPVIKVRENESFDVALRRFKRSCEKAGILAEVRAREFYEKPTTIRKRENATLAKRHAKRNARENARNTRLY

SEQ ID NO: 3677 - DNA, 1026 bp, Haemophilus influenzae
  Name: NTH2050
atgaaaatcttaggcattgaaacttcctgtgatgaaacgggcgtggcgatttatgatgaagaaaaagggttaattgctaatcaactttatactcaaattgccctgcatgcagattatggtggtgtggttcctgaattagcatcacgtgatcatattcggaaaacagcgcctcttattaaagcggcattagaggaagccaatttaaccgcaagcgatattgatggtattgcttatactagtggccctgggcttgtcggcgcattgcttgttggtgctacgattgcacgttctttagcctatgcttggaatgtgccagcgattggtgttcatcatatggaagggcatttacttgcgccaatgcttgatgaaaattcaccgcactttccttttgttgctctgttggtatcgggtggccacactcaattagtgcgtgtcgatggtgtaggaaaatatgaagtgataggagaatctattgatgatgctgctggcgaagcctttgataaaacagcaaaattacttggattagattatccaggcggcgcggcactttctcgtttagcggaaaaaggcacgccaaatcgctttatatttccacgtccaatgacagatcgtgcaggccttgattttagtttttctggtttaaaaacatttgccgcaaatacagttaatcaagcaattaaaaacgagggcgaactgacagaacaaactaaatcggatattgcttatgctttccaagatgcggtggtggatactcttgccattaaatgtaagcgcgcattaaaagaaactggctataaacgtttagtgattgcgggaggagtgagtgcaaataaaaaactccgagaaacgcttgcgcacttaatgcaaaatttaggtggcgaagtgttttatcctcaacctcaattttgtacagataatggcgcaatgattgcttacacaggttttttacgtttaaaacaaggtcagcatagcgatctggctattgatgttaaacctcgttgggcaatgacggaattaccggcaatt

SEQ ID NO: 3678 - protein, 342 aa, Haemophilus influenzae
  Name: NTH2050
MKILGIETSCDETGVAIYDEEKGLIANQLYTQIALHADYGGVVPELASRDHIRKTAPLIKAALEEANLTASDIDGIAYTSGPGLVGALLVGATIARSLAYAWNVPAIGVHHMEGHLLAPMLDENSPHFPFVALLVSGGHTQLVRVDGVGKYEVIGESIDDAAGEAFDKTAKLLGLDYPGGAALSRLAEKGTPNRFIFPRPMTDRAGLDFSFSGLKTFAANTVNQAIKNEGELTEQTKSDIAYAFQDAVVDTLAIKCKRALKETGYKRLVIAGGVSANKKLRETLAHLMQNLGGEVFYPQPQFCTDNGAMIAYTGFLRLKQGQHSDLAIDVKPRWAMTELPAI

SEQ ID NO: 3679 - DNA, 618 bp, Haemophilus influenzae
  Name: NTH2051
ttgggcaatgacggaattaccggcaatttaggagaaaaaatggcgaaactctacttctattactccacaatgaacgctggaaaatcaacgacgttgctacaatcttcctataactatcgtgagcgtgatatgagcacattagtttatacggctgcgattgatgatcgttttggcgtgggaaaagtcacatcgcgtattggcatttcgcaagatgcctttttatttcgctcggaaaccaatttgtttgatgaaatcaatgagcacttaaaaaaagaaaaagtgcattgcgtgttggtggatgaagctcaatttcttagcaaacaacaagtttaccagttgagtgatgttgttgataaactcaaaatccctgtgctttgttatggcttgcgtacagatttccaagcggaactttttgaaggaagtaaatatttactggcttgggcggatcaactcgaagaattaaaaacaatttgttattgtggccgcaaggctaattttgttttgcgtttaaatgatcagggcgaggtcattaaagaaggtgcacaaattcaaattgggggcaatgattcttatctttctgtttgccgtttacactataaagaaaagtgcggtcaaatt

SEQ ID NO: 3680 - protein, 206 aa, Haemophilus influenzae
  Name: NTH2051
LGNDGITGNLGEKMAKLYFYYSTMNAGKSTTLLQSSYNYRERDMSTLVYTAAIDDRFGVGKVTSRIGISQDAFLFRSETNLFDEINEHLKKEKVHCVLVDEAQFLSKQQVYQLSDVVDKLKIPVLCYGLRTDFQAELFEGSKYLLAWADQLEELKTICYCGRKANFVLRLNDQGEVIKEGAQIQIGGNDSYLSVCRLHYKEKCGQI

SEQ ID NO: 3681 - DNA, 1218 bp, Haemophilus influenzae
  Name: NTH2052
atgctaaaaaacaaaacttttgggagtgcgctgattattgcaggcacaaccattggagcaggtatgcttgctatgccgcttacatcagcgggtatgggctttggttataccctgttattgctcgttggcttgtgggctttgttggtttacagcggattgttgtttgtagaagtgtatcaaacagcggatcagttggatgatggtgtcgccacgctcgctgaaaaatattttggggttcctgggcgaattttcgccacgttgagtttgttagttttactttatgcactttcagccgcttatattactggtggtggatctttactttcaggcttgccaacggcttttggaatggacgcaatctcacttaaaacggcgattattatctttactgttgtattaggttctttcgtggttgtaggaacgaaaggcgtggatggtttaactcgcgtgttatttattggtaagttagtcgcttttgcttttgtactgtttatgatgcttcccaaagtggcaacagataatttaatggcattgcctttggattatgcttttgtggtttctgcggcaccaatattttttacttctttcggtttccacgttataatggcgagtgtgaatagctacttaggtggaagtgttgataaatttcgtcgtgccattttgattggtactgcgattccattagctgcttaccttgtatggcagttagcaactcatggtgtattaagtcaaagtgaatttgtgcatattttacaagctgacccaacgctaaatggcttagtgaatgcaacacgtgaaattacaggttctcattttatgggagaggttgtacgtgtgttctcatcacttgctttaattacttcattcttaggcgtaatgcttggtgtatttgaaggcttaggtgatttattcaaacgctatcatttgccaaataatcgctttgtattaactgtagccgcatttttaccgccacttgtatttgcattgttttatcctgaaggatttattacagcattaagttacgcaggtttgttgtgtgcgttctattgcttaattttaccaattagcttggcatggcgtacacgtattgaaaatccaacattgccatatcgtgtttctggcggtaatttcgctttggtgtttgcgttattaattggcgtcgtgattatgctcattccatttttaattcaatggggatatttaccagtggtggcgggg

SEQ ID NO: 3682 - protein, 406 aa, Haemophilus influenzae
  Name: NTH2052
MLKNKTFGSALIIAGTTIGAGMLAMPLTSAGMGFGYTLLLLVGLWALLVYSGLLFVEVYQTADQLDDGVATLAEKYFGVPGRIFATLSLLVLLYALSAAYITGGGSLLSGLPTAFGMDAISLKTAIIIFTVVLGSFVVVGTKGVDGLTRVLFIGKLVAFAFVLFMMLPKVATDNLMALPLDYAFVVSAAPIFFTSFGFHVIMASVNSYLGGSVDKFRRAILIGTAIPLAAYLVWQLATHGVLSQSEFVHILQADPTLNGLVNATREITGSHFMGEVVRVFSSLALITSFLGVMLGVFEGLGDLFKRYHLPNNRFVLTVAAFLPPLVFALFYPEGFITALSYAGLLCAFYCLILPISLAWRTRIENPTLPYRVSGGNFALVFALLIGVVIMLIPFLIQWGYLPVVAG

SEQ ID NO: 3683 - DNA, 258 bp, Haemophilus influenzae
  Name: NTH2053
atggcattattcatcactagcaaatgtaccaactgcgatatgtgcttgcctgaatgcccaaacgaagccatttccattggcgatgagatttatgtgatcgatcctatactttgcacggaatgtgtcggccattacgacaccccaacctgccaaaaagtttgcccaatcactaactgtattaagcccgatcctgaacatcaagaaaccgaagaacagctttgggaacgctttgtaatgattcatcattcggataaattg

SEQ ID NO: 3684 - protein, 86 aa, Haemophilus influenzae
  Name: NTH2053
MALFITSKCTNCDMCLPECPNEAISIGDEIYVIDPILCTECVGHYDTPTCQKVCPITNCIKPDPEHQETEEQLWERFVMIHHSDKL

SEQ ID NO: 3685 - DNA, 147 bp, Haemophilus influenzae
  Name: NTH2055
atgaaaaaactttccttccattctttctcttatggttctcgttatattagcaatttggcaatatttttacccgatacaaccaaaactaaacatcaatcatcctcgcccgtaattgagcagacgaagcaaacaaaagtatctgagccc

SEQ ID NO: 3686 - protein, 49 aa, Haemophilus influenzae
  Name: NTH2055
MKKLSFHSFSYGSRYISNLAIFLPDTTKTKHQSSSPVIEQTKQTKVSEP

SEQ ID NO: 3687 - DNA, 111 bp, Haemophilus influenzae
  n 39: n is any nucleotide
  Name: NTH2056
ttgcccaatatgatcattgcgcataatcacatcatagtngcaaaaacatctggattttttaccgcactttttcaatatccgtccgctttgtctcaaattgaggctcgaatt

SEQ ID NO: 3688 - protein, 37 aa, Haemophilus influenzae
  Name: NTH2056
LPNMIIAHNHIIVAKTSGFFTALFQYPSALSQIEARI

SEQ ID NO: 3689 - DNA, 642 bp, Haemophilus influenzae
  n 82: n is any nucleotide
  Name: NTH2057
ttgaacctaaattcgagcctcaatttgagacaaagcggacggatattgaaaaagtgcggtaaaaaatccagatgtttttgcnactatgatgtgattatgcgcaatgatcatattgggcaaaacgcaaaggcaccggtcgattattatatgttggcattatcttggtcgcctggattttgtgatattcagcgtgaaaaatatggcgatcagttgccttattcctctcaatatcaatgtggaaatacccgcacttttggttgggttgtacatgggctatggccacaaaatgcaaatgctcgcgctgtttcagatcatcctcgtttttgcaaaggcgatttacccgccttgccaaaaggtttattagcacaatatttggcgatttctccgggcgagaaattattgcaaggcgaatgggaaaaacacggtagttgcgcctttgattctgcccagcaatattttgctaaggagcaggaattatttaacgcattaaaattaccgaatcaaaaattaagtcgagatgaactttttggttggatgaagcaacataatccacaattaaaaaatgcgtatttgagggctagtcgaaatgaattatttatttgttatgataaaaaatggcaggtaatgaattgccaaagcaaa

SEQ ID NO: 3690 - protein, 214 aa, Haemophilus influenzae
  Xaa 28: Xaa is any amino acid
  Name: NTH2057
LNLNSSLNLRQSGRILKKCGKKSRCFCXYDVIMRNDHIGQNAKAPVDYYMLALSWSPGFCDIQREKYGDQLPYSSQYQCGNTRTFGWVVHGLWPQNANARAVSDHPRFCKGDLPALPKGLLAQYLAISPGEKLLQGEWEKHGSCAFDSAQQYFAKEQELFNALKLPNQKLSRDELFGWMKQHNPQLKNAYLRASRNELFICYDKKWQVMNCQSK

SEQ ID NO: 3691 - DNA, 789 bp, Haemophilus influenzae
  Name: NTH2058
atgtcagtaatcaaaatgaccgatttagatttagcgggtaaacgtgtatttatccgtgcagatcttaatgtgccagtaaaagatggcaaagtgacctcagatgcgcgtattcgtgcgaccattcctactttaaaattagccttagaaaaaggtgcaaaagtgatggttacctctcacttaggtcgtccaactgaaggagaattcacaccagaagattctttacaaccagttgttgattacttaaaaaacgcaggctttaatgtgcgtttagaacaagattatttaaatggtgtggatgttaaagatggcgaaatcgttgttttagaaaacgtacgcataaacaaaggcgaaaagaaaaatgatccagaattaggtaaaaaatatgccgcactttgcgatgtatttgtaatggatgcctttggtacagcgcaccgcgcgcaagcatcaacttacggcgttgcagaatttgcaccgatcgcttgtgcaggcccattattagccgctgaattagatgcattaggtaaagcattaaaagaacctgctcgtccaatggtcgcgatcgtaggcggttctaaagtttcaactaaattagaagtattaaattctctttcaaaaatcgctgaccaaattattgtgggcggtggcattgcaaatactttcatcgcggcagctggtcacaatgtaggtaaatctttatatgaagctgatttaatgccagttgcgaaagaattagccgcaaatacagatattccagttccagttgatgtgcgtgtaggttttagagttctc

SEQ ID NO: 3692 - protein, 263 aa, Haemophilus influenzae
  Name: NTH2058
MSVIKMTDLDLAGKRVFIRADLNVPVKDGKVTSDARIRATIPTLKLALEKGAKVMVTSHLGRPTEGEFTPEDSLQPVVDYLKNAGFNVRLEQDYLNGVDVKDGEIVVLENVRINKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLMPVAKELAANTDIPVPVDVRVGFRVL

SEQ ID NO: 3693 - DNA, 243 bp, Haemophilus influenzae
  n 234, 235, 236, 237, 238: n is any nucleotide
  Name: NTH2059
gtgaaagatgatgaatctatttttgatattggcgataaatcagcagaacaattggctgaaatatcaaaatgcaaacccgttttgtggatggccaatggtggggtttgggattccctcattcccgaaggaactgaatcatttctacgccttgcaacagggagcatctttttgctggcggggggtaccttacggtttgattattgggattgcggaaaattctacttcacggggggnnnnnttaat

SEQ ID NO: 3694 - protein, 81 aa, Haemophilus influenzae
  Xaa 79, 80: Xaa is any amino acid
  Name: NTH2059
VKDDESIFDIGDKSAEQLAEISKCKPVLWMANGGVWDSLIPEGTESFLRLATGSIFLLAGGTLRFDYWDCGKFYFTGGXXN

SEQ ID NO: 3695 - DNA, 240 bp, Haemophilus influenzae
  n 227, 228, 229, 230, 231: n is any nucleotide
  Name: NTH2060
atgatgaatctatttttgatattggcgataaatcagcagaacaattggctgaaatatcaaaatgcaaacccgttttgtggatggccaatggtggggtttgggattccctcattcccgaaggaactgaatcatttctacgccttgcaacagggagcatctttttgctggcggggggtaccttacggtttgattattgggattgcggaaaattctacttcacggggggnnnnnttaattaat

SEQ ID NO: 3696 - protein, 80 aa, Haemophilus influenzae
  Xaa 76, 77: Xaa is any amino acid
  Name: NTH2060
MMNLFLILAINQQNNWLKYQNANPFCGWPMVGFGIPSFPKELNHFYALQQGASFCWRGVPYGLIIGIAENSTSRGXXLIN

SEQ ID NO: 3697 - DNA, 621 bp, Haemophilus influenzae
  n 71: n is any nucleotide
  Name: NTH2061
ttgcttgaacgaccagagcaaggcattttggaatttactgatggcagtctaaaaattgattttagccaganaattagtaaagcagatgaattgaagttacgccgacgttcatcaatggtctttcagcaatacaatttattccctcatcgttctgcccttgaaaatgttatggagggaatggttgttgtgcaaaaacaagataaagctcaagctcgtgaaaaagcacttagtttgctagaaaaagtagggcttaaaaataaagcggatttatttccatcccaactttctggcggtcagcaacagcgagtggggattgctcgagcccttgcggtaaaacctgatattattttattagatgaacctacatcggcattagatcctgaattggtgggcgaagtgttacaaacactaaaaatgctcgcccaagaaggctggacaatgattattgttactcacgaaatgcagtttgcgaaagatgtcgcggatcgtgtgattttaatggcggatggatatattgtagaacaaaatacggcagataaattcttcacttgcccacaacacgagcgcactaaacagttcttgttacaagcaaaaataccacttgagcttgattattatatt

SEQ ID NO: 3698 - protein, 207 aa, Haemophilus influenzae
  Xaa 24: Xaa is any amino acid
  Name: NTH2061
LLERPEQGILEFTDGSLKIDFSQXISKADELKLRRRSSMVFQQYNLFPHRSALENVMEGMVVVQKQDKAQAREKALSLLEKVGLKNKADLFPSQLSGGQQQRVGIARALAVKPDIILLDEPTSALDPELVGEVLQTLKMLAQEGWTMIIVTHEMQFAKDVADRVILMADGYIVEQNTADKFFTCPQHERTKQFLLQAKIPLELDYYI

SEQ ID NO: 3699 - DNA, 237 bp, Haemophilus influenzae
  Name: NTH2062
gtgaggcagcttgatttatggatatttctgtttgtttatctattctacaaagatcgtcttgaaattcgcttatctcgccattataaaggaatgtctatgttaaaagtaagtaatattcagaaaaactttaatggcaatcatgtgttaaaaggcattgattttgaaattaataaaggtgaagtggtcgcaattttaggccctctgggttctggaaaaaacccacctttttacgttgtt

SEQ ID NO: 3700 - protein, 79 aa, Haemophilus influenzae
  Name: NTH2062
VRQLDLWIFLFVYLFYKDRLEIRLSRHYKGMSMLKVSNIQKNFNGNHVLKGIDFEINKGEVVAILGPLGSGKNPPFYVV

SEQ ID NO: 3701 - DNA, 195 bp, Haemophilus influenzae
  Name: NTH2063
ttgaatgactatactcaacgtattgtgccattaaatgatgcgatgaaaggaatgaataactattacaaagaccgtaaaaaagcctttgtgctaggttatttcggtgatcaccaagtggcatttgataatgctatccctccgaagaaaggggattatgccacagcccgattatgtgacgcaatttgttgtaagaag

SEQ ID NO: 3702 - protein, 65 aa, Haemophilus influenzae
  Name: NTH2063
LNDYTQRIVPLNDAMKGMNNYYKDRKKAFVLGYFGDHQVAFDNAIPPKKGDYATARLCDAICCKK

SEQ ID NO: 3703 - DNA, 243 bp, Haemophilus influenzae
  Name: NTH2064
gtgacgcaatttgttgtaagaagtaattatgcaagtcaatttaagcaagaacaaaagtttttagatcttgcttttgctggaggcgtcttgatgaatgtagctggattatcagcagaagatgaatttatgaaagcgaatatggcaatgtgtaaactaagtcacggaaaattagaagattcttctgatattcagctactcaatgattatcgccattatttatatcaaacattggcgattgccaga

SEQ ID NO: 3704 - protein, 81 aa, Haemophilus influenzae
  Name: NTH2064
VTQFVVRSNYASQFKQEQKFLDLAFAGGVLMNVAGLSAEDEFMKANMAMCKLSHGKLEDSSDIQLLNDYRHYLYQTLAIAR

SEQ ID NO: 3705 - DNA, 690 bp, Haemophilus influenzae
  Name: NTH2065
atggttattttttctattttctctgcttttcctgtattcaatgaagtgacgggagaattaaaagaaatgatttttactaattttgcaccatcagcgagtgatatggtgggcgaatatatcgatcaatttgtatcaaactcaaagaaaatgagtgcggtgggaattgtgagtttaattgccgttgccttgatgctaattaataacatcgaccgaacactaaatagtatttggcacaatagtcaatctcgctctccgctttcttcttttgcgatttattggatgattttgacacttggcccacttattattggcgtgagtattgggattagttcgtatattaaaataatgtttgagcaatcggaacatttatcattaggcttaaaattgctcagttttgtgccttttttatttacttggtttatttttacgcttatttatacggttgtaccgaataaaaaagtgaaaattaagcattcagcttacggtgcatttcttgccgcgatttttttcactcttggtaaacaagcatttacttggtatgtcgtcacttttccctcttatcaattaatttacggtgcaatggcaactttaccaattatgttattgtggattcaaataagttggcttgtggtattagttggtgcacaattagcttcaaccttagatgaaattggcgagcagatcgagcaa

SEQ ID NO: 3706 - protein, 230 aa, Haemophilus influenzae
  Name: NTH2065
MVIFSIFSAFPVFNEVTGELKEMIFTNFAPSASDMVGEYIDQFVSNSKKMSAVGIVSLIAVALMLINNIDRTLNSIWHNSQSRSPLSSFAIYWMILTLGPLIIGVSIGISSYIKIMFEQSEHLSLGLKLLSFVPFLFTWFIFTLIYTVVPNKKVKIKHSAYGAFLAAIFFTLGKQAFTWYVVTFPSYQLIYGAMATLPIMLLWIQISWLVVLVGAQLASTLDEIGEQIEQ

SEQ ID NO: 3707 - DNA, 159 bp, Haemophilus influenzae
  Name: NTH2066
gtgtatgtggttatggtaaaaaatttaaacattgttgtgggggatttctatgatttcattaaaaaattttggattattattttggaacgtttttcagaaaataaacttaatcaagtcgctggtgcattgacttatagcacaatgttagcaatagttcct

SEQ ID NO: 3708 - protein, 53 aa, Haemophilus influenzae
  Name: NTH2066
VYVVMVKNLNIVVGDFYDFIKKFWIIILERFSENKLNQVAGALTYSTMLAIVP

SEQ ID NO: 3709 - DNA, 483 bp, Haemophilus influenzae
  Name: NTH2067
atgtcagaaatttcaaccgcactttctttagaaaattgtccatgtcaatctagtcatcattacgcagattgttgtggcaaatttcatttgagacaagcatttcccgaaacggcagagcaacttatgcgttcacgttatacggcttatgtgttaaaaaatattccctatattgttgtaacaactgcgccaagccaacaaactttattaaagcctaggttattgcaagaatgggcggacaacactacgtggctaggattagaaattctaaaaacggaaagccttacaaaaactcaaagtgcggtagaatttaaggcgatttttcaaggcgaagagggagaactagcccatcaagaacggtcaatttttgtaaaaattgaaaaccgttggtattttgttgatccgaccgtatcattaccgacaatgaaacaaccttgtgtatgtggttatggtaaaaaatttaaacattgttgtgggggatttcta

SEQ ID NO: 3710 - protein, 161 aa, Haemophilus influenzae
  Name: NTH2067
MSEISTALSLENCPCQSSHHYADCCGKFHLRQAFPETAEQLMRSRYTAYVLKNIPYIVVTTAPSQQTLLKPRLLQEWADNTTWLGLEILKTESLTKTQSAVEFKAIFQGEEGELAHQERSIFVKIENRWYFVDPTVSLPTMKQPCVCGYGKKFKHCCGGFL

SEQ ID NO: 3711 - DNA, 564 bp, Haemophilus influenzae
  Name: NTH2068
gtgccatcggtaaaaattcattctcttggtgcggaaggaaacgatgttggtttaaaaaaacatcacgggggtgtagataaagctctcttttttatgtcggcagattcttttaatgaattaaatactttattaaataaagatttttcttatatggatactgcgatatacggagaaaattttgtcgtgtcaggcttgaatgaagacaatgtatgtattggcgatcgttatcaaatcggctcaaccattttagaagtatctcaaccacgtaaaccttgtgagcgtttatcaaaaaacacggaaaacgaagatactcgcgatattgtttatcaaactgggcttagtggatggtatgttcgtattattgaaacaggaacaattaagcaaaaggatgaactaaaattactcgcccgtccttatccgcaaataacaattcgtcatttaaatcgcttgttatctgcgcccgaaaatgaagctgaattagatgcagcattagagattgaagtattagctgaagcctttaaacgctcaattcgatcgcaaatatcgaaattcaaacaacaggga

SEQ ID NO: 3712 - protein, 188 aa, Haemophilus influenzae
  Name: NTH2068
VPSVKIHSLGAEGNDVGLKKHHGGVDKALFFMSADSFNELNTLLNKDFSYMDTAIYGENFVVSGLNEDNVCIGDRYQIGSTILEVSQPRKPCERLSKNTENEDTRDIVYQTGLSGWYVRIIETGTIKQKDELKLLARPYPQITIRHLNRLLSAPENEAELDAALEIEVLAEAFKRSIRSQISKFKQQG

SEQ ID NO: 3713 - DNA, 111 bp, Haemophilus influenzae
  Name: NTH2069
ttgaccgcacttctttttttacttattattcgttatcagaaaaacaaaaaagaaataataaaaatgtttgaaagagaaaaaaattttctaaaaatattttatttcttttct

SEQ ID NO: 3714 - protein, 37 aa, Haemophilus influenzae
  Name: NTH2069
LTALLFLLIIRYQKNKKEIIKMFEREKNFLKIFYFFS

SEQ ID NO: 3715 - DNA, 819 bp, Haemophilus influenzae
  Name: NTH2070
ttgaaaataagatttttcctaagggcgaaatcatcacgttcaatgataataaggagatttattatgtcagacgtattccacctaaacctcactaaagcacaacttaaaggtgcaacactcgctattgttcctggcgatcctgcgcgtagtgagcgtattgcgaaacaacttgataatccagagtttcttacaagcacgcgtgaatttacatcgtggttaggttatatcaatggtcagcctattgttgtatgttctacgggtattggtggcccatcaacatcaatttgtgtggaagaacttgctcaacttggtgttcgcactttcttacgtattggcacaacgggggcaattcaaccgcacattaatgtaggcgatgttcttatcacaactgctgctgttcgcttagatggtgcaagctgtcattttgtaccattagaatatccagctgtggcaaactttgaatgtacaaccgcactttataatgcagcgaaagcaaaaggtattgagccttatgtaggtgtaaccgtatcatctgatacattctatccaggtcaagaacgttacgatacttatagtggtaaagtatatcgtgattaccaaggtttgcttaaacaatggcaagatttgaatgtcatgaattacgaaatggaatcttcaacattgtttactatgtgtagcgcattaggtttgcgtgcaggaatggttgcaggcgtgattgtaaaccgcactcaacaagaaattccaaatgaagcaacgataaaacaaacagaagaaaaagcggtgtctgttgtgatcgcagctgcacaagcgttgttaagt

SEQ ID NO: 3716 - protein, 273 aa, Haemophilus influenzae
  Name: NTH2070
LKIRFFLRAKSSRSMIIRRFIMSDVFHLNLTKAQLKGATLAIVPGDPARSERIAKQLDNPEFLTSTREFTSWLGYINGQPIVVCSTGIGGPSTSICVEELAQLGVRTFLRIGTTGAIQPHINVGDVLITTAAVRLDGASCHFVPLEYPAVANFECTTALYNAAKAKGIEPYVGVTVSSDTFYPGQERYDTYSGKVYRDYQGLLKQWQDLNVMNYEMESSTLFTMCSALGLRAGMVAGVIVNRTQQEIPNEATIKQTEEKAVSVVIAAAQALLS

SEQ ID NO: 3717 - DNA, 1314 bp, Haemophilus influenzae
  Name: NTH2071
atgtctacacaacttcgtaataatccgatgaaagtggcgttagcctcgatggtcggtacggcaatcgaattttttgattattatatctatgcggctgccgctgtattagttttcaatacgcaattctttcatagcgatgatccgctttctaatgatttactttctctttctacgcttgctttagcattttttgcgcgtcctattggttcggcattattcggtcactttggcgataaaattggtcgtaaaaaaaccttggttgcctctcttgttttaatgggtggttcaacggtagtaattggtttacttcctaattatgctcaaattggtatctgggcgccgattttgctttgtgtatgtcgcgtaggtcaaggaattggacttggtggagaatggggaggtgcagcgttagtcgcaacagaaaatgcaccagaaggaaaacgagcttggtacggtacttttcctcaattaggcgcaccaattggtttatttgtcgctaatggaacgttcttcttagctagctatttacttggtcataatgcacttgttgaatgggcgtggcgtattccatttgtatcttccattttattagttgcagttggtttatatgttcgcttaactttgcacgaaagccacgtatttgtggaagcagagcaaaaaggcaaaaaattgaatgcaccagtgagtgttgtgtttaccaaacacttaaaaccaatgatcattggtacatttattatggtggcaacttattctttgttttacattatgacggcttttgcacaggcatattctcgaaccgtgccaaagctttctgaagcaggttatgcgcttggtttaggaatcccagcaaatacatttactggcttgttattaattagtgccattgtatttggtatttttatcagtatttccggtttttatgcagataaaatcggtcgtcgtaaatggttgatttgggtgactattgctatcggcgtgcttggtttagcaatgccgttattcttagaaaatggcactccagttagcgtatttgcatttttagtgattggtatggcgattatgggaatgacatttggtccaatggctgcgctattaccagaattattcccaacagaagtccgttattcaggtgcctctcttgcgtataatttagcatcaattattggtgcaacaattgcagcaatgatttctttaaaaattaacgcgtcattcggtgtaatgggcgtaggaatttatttagcaatcaatgcattaatgactttcttggcattattagcctcaaaagagactaaaaatgtagatttaacagaaatc

SEQ ID NO: 3718 - protein, 438 aa, Haemophilus influenzae
  Name: NTH2071
MSTQLRNNPMKVALASMVGTAIEFFDYYIYAAAAVLVFNTQFFHSDDPLSNDLLSLSTLALAFFARPIGSALFGHFGDKIGRKKTLVASLVLMGGSTVVIGLLPNYAQIGIWAPILLCVCRVGQGIGLGGEWGGAALVATENAPEGKRAWYGTFPQLGAPIGLFVANGTFFLASYLLGHNALVEWAWRIPFVSSILLVAVGLYVRLTLHESHVFVEAEQKGKKLNAPVSVVFTKHLKPMIIGTFIMVATYSLFYIMTAFAQAYSRTVPKLSEAGYALGLGIPANTFTGLLLISAIVFGIFISISGFYADKIGRRKWLIWVTIAIGVLGLAMPLFLENGTPVSVFAFLVIGMAIMGMTFGPMAALLPELFPTEVRYSGASLAYNLASIIGATIAAMISLKINASFGVMGVGIYLAINALMTFLALLASKETKNVDLTEI

SEQ ID NO: 3719 - DNA, 741 bp, Haemophilus influenzae
  Name: NTH2072
atgataaacatcatttttcttcacggacttcttggtacaaaaaatgactggcaaaaagtcattgaaaatctaccgcactttaattgtattgcgctagatttgccttttcacgggcaagctagagatattgaagtcacaaattttgaagaaacggctgagtatttggctaagcaaattaaaagtgcggtgaaaaatgaaccctattttcttgttgggtattctctaggtggaaggatcgctttgtattatgcgctgaaagctcaggtggaacgatctaatttgcaaggcgttattttagaaggagcgaatctaggtttaaaaactgacgaagaaaagcaggctcgttttcagcaggattttgcttgggcgcaacgttttatacaagaaccaccagaaaaagtgttgaatgattggtatcaacaacctgtgttttctcatttgactgcagaagaaagattacagttggttgaaaaacgaaaatcaaattgtggggaaaatattggcaaaatgctgctggcgacaagtctatccaaacaacctgattttagtgaaaaagtgcggttaagttctttgccatttttttatttttgtggcgaaagagatcataagttccaagtattagccaaagaaaatcaaattgatttagtgacaattccctgcgctggacataactcacatttagaaaactcaaaatatttctctaaaaaaatagaaaattgcatattaaaaattgttagacct

SEQ ID NO: 3720 - protein, 247 aa, Haemophilus influenzae
  Name: NTH2072
MINIIFLHGLLGTKNDWQKVIENLPHFNCIALDLPFHGQARDIEVTNFEETAEYLAKQIKSAVKNEPYFLVGYSLGGRIALYYALKAQVERSNLQGVILEGANLGLKTDEEKQARFQQDFAWAQRFIQEPPEKVLNDWYQQPVFSHLTAEERLQLVEKRKSNCGENIGKMLLATSLSKQPDFSEKVRLSSLPFFYFCGERDHKFQVLAKENQIDLVTIPCAGHNSHLENSKYFSKKIENCILKIVRP

SEQ ID NO: 3721 - DNA, 1704 bp, Haemophilus influenzae
  Name: NTH2073
atgtcggtaagcgtgtttaatcgttgttggtcgaaagtgattttagaaaccttggtgcgccaaggcgtttctcacgtttgtatcgcgccaggttcgcgttcgacacctttaactctagaagccgtacgtttgcaaaatgcaggttcagtcacttgtcatacgcattttgatgaacgcggtttaggtttttttgcacttggtattgctaaggcaactcaatcacctgttgccattattgtgacatcaggcacggcgactgcaaacctttatccagcaattattgaagcgcgccaaaccggtgtgaatttatttgttttaactgctgatcgtccaccagaactttgggagtgcggtgcaaatcaagctattttgcaacaaaatatgtttggtcagtatccagttgcaaatgttaatttacctaaaccgaacgctgattattctgcgcagtggttgatttctctacttgaacaggcagctttccaacaaaaacaacaaggtggcgttgttcatattaatgtgccatttaccgagccactttatgatgcaactgatgaggaagtaaattcccatagttggctacagccgttacaacgctggttaattcaaaacaagtcttggataaatgtagaagtccaacaaaacgaagtattaatgcatgaaaattgggatcattggcgtaccaaacgtggtgtcgttgtggttggtcaattacctgcagaacaagcgatgggcattaattcttgggcaagtgctatgggctgggtgttactgacggatattcaatctggtgttgttccaacgacgccttatgaagatatttggctagcaaaccaaactgttcgtgaaaaacttctacaagctgatattgtgattcaatttggcgcgcgttttattagtaaacgcattaatcaattcttgcaggcgtttaaaggggaattttggctagttgaacaaagcggtaaagcactagatccttaccatcattcattgacaagattcaatgctaaagcgcatcattggttacgtgcgcatccacctttacgccaaaagccttggttgcttgagccgttagctttatctaagttctgtgcgacctttattgaacagcaagtgggcggaaatttaacggaagcctcgctagcattacgtttaccaacacttttaccttataacggtgttttatttttaggtaatagtttacttgttcgtctggttgatgcgctaacgcaattacccgaaagttatcccgtttataccaatcgtggtgcgagtggaattgatggtttgttggctactgctgctggaataggtattggttcaaataaacctgttgttgcggtgattggcgatacgtccactttatatgatctaaattctttcgcattattcaaaaatgttacgcaaccaacgctaatctttgtgatcaataataatggtggtgcgatttttgatatgttacctgtggatgaacaagtcaaagatcagttctatcgattaccgcataatggcgatttttctcaaatcgcggcaatgttcgatctcaaatacgctcatccttatacttgggcggatctcaattccgttgttaaacaggcttatagtcgtcgcaaggcaacgttaattgaaattaaaacgaatccgagtgatggtagtagtttgtataaacgcttaatcgatcaaattagtcacgccgtgattggtgct

SEQ ID NO: 3722 - protein, 568 aa, Haemophilus influenzae
  Name: NTH2073
MSVSVFNRCWSKVILETLVRQGVSHVCIAPGSRSTPLTLEAVRLQNAGSVTCHTHFDERGLGFFALGIAKATQSPVAIIVTSGTATANLYPAIIEARQTGVNLFVLTADRPPELWECGANQAILQQNMFGQYPVANVNLPKPNADYSAQWLISLLEQAAFQQKQQGGVVHINVPFTEPLYDATDEEVNSHSWLQPLQRWLIQNKSWINVEVQQNEVLMHENWDHWRTKRGVVVVGQLPAEQAMGINSWASAMGWVLLTDIQSGVVPTTPYEDIWLANQTVREKLLQADIVIQFGARFISKRINQFLQAFKGEFWLVEQSGKALDPYHHSLTRFNAKAHHWLRAHPPLRQKPWLLEPLALSKFCATFIEQQVGGNLTEASLALRLPTLLPYNGVLFLGNSLLVRLVDALTQLPESYPVYTNRGASGIDGLLATAAGIGIGSNKPVVAVIGDTSTLYDLNSFALFKNVTQPTLIFVINNNGGAIFDMLPVDEQVKDQFYRLPHNGDFSQIAAMFDLKYAHPYTWADLNSVVKQAYSRRKATLIEIKTNPSDGSSLYKRLIDQISHAVIGA

SEQ ID NO: 3723 - DNA, 555 bp, Haemophilus influenzae
  Name: NTH2074
ttgttgctaaccgaagctttggcggggacagcatcggtttctgaaagtgaggaagaaacgcaatctcaagccaattggttgttaaatgatgagaaaaatttaaaagaaaattggttggtcgtagaagatatttcgcagaatttacgtaagcaagtagaaagttttgatgtaagcaatgtggaattgaaaccgttacgtaaagtacaacatttgattcgtaaaattcgcgcaaatttgaccgcacattatgcagatgtaaatatattaaaagcgattcatcctacagctgcagtatctggtttgccacagcaacaagccaaaatgattttgtcagaaatcgaaacctttgatcgaggctggtatgcgggaacattgggcgtgatgagcgatgtatgttcagagttttgtgtggcgattcgttctgcttttattgaaggtcatcgtattcgtgtatttgctggcgcgggcattgtggcaggctcgcagccattggaagaatggaaagaaattgaacgtaaagcagcagggttaatttccttgtttgcagaagaaaaa

SEQ ID NO: 3724 - protein, 185 aa, Haemophilus influenzae
  Name: NTH2074
LLLTEALAGTASVSESEEETQSQANWLLNDEKNLKENWLVVEDISQNLRKQVESFDVSNVELKPLRKVQHLIRKIRANLTAHYADVNILKAIHPTAAVSGLPQQQAKMILSEIETFDRGWYAGTLGVMSDVCSEFCVAIRSAFIEGHRIRVFAGAGIVAGSQPLEEWKEIERKAAGLISLFAEEK

SEQ ID NO: 3725 - DNA, 231 bp, Haemophilus influenzae
  n 120, 146, 218, 219, 220, 221, 222: n is any nucleotide
  Name: NTH2075
ttgatttttgttttttcgctttctgctaaaaaatcgtacgcattaatcgcttgctttaatgaaaagtggtttcattggctacacaatttttgtcagctctccacttttaatttccaccanagcctgatttacccaacacaccaagntcttttattagctcgaggctcttatgcaaagaaattggtttggtacgcaaaagggggggagattttaaaggnnnnnttaattaat

SEQ ID NO: 3726 - protein, 77 aa, Haemophilus influenzae
  Xaa 40, 49, 73, 74: Xaa is any amino acid
  Name: NTH2075
LIFVFSLSAKKSYALIACFNEKWFHWLHNFCQLSTFNFHXSLIYPTHQXLLLARGSYAKKLVWYAKGGEILKXXLIN

SEQ ID NO: 3727 - DNA, 2037 bp, Haemophilus influenzae
  Name: NTH2076
atgtctgaaaaaatcaacacaaaaccgttcattctacattccgactttcgtccctctggcgatcagccacaagctatcgaaaaattggctgaaaatttaacggatggtttggcgcatcaaactttgctcggggtaacaggctcggggaagacgtttactatcgccaatgtaatcgctcaattaaatcgacccgcaatgttacttgcgccaaataaaacccttgctgctcagctttatgcagaaatgaaagctttttttccagaaaatgcggtggaatattttgtgtcttactatgattattatcagcctgaagcctatgtgcccagcagtgatacatttattgaaaaagatgcgtctattaatgatcaaatcgaacaaatgcgtctttctgcgacgaaatcttttctagaacgtcgagataccatcgtggtggcttccgtttctgcaatttatggtttgggcgatcctgatagctatttacaaatgatgttgcatttacaacaaggtgccattatcgatcaacgccaaattttagcgaagttagcggaattgcaatatacccgaaatgatcaagcatttcagcgtggaactttccgtgttcgcggagaaattattgatatttttcctgctgaatccgatgatcgtgcggtgcgtattgaattatttgatgatgaaatcgagcgtttaagtttatttgatccgctcactggcagtagttttggtgctgtcccacgttttacgatctatcctaaaactcactatgttacgccaagagaacgtattttagatgcgatagaaaacatcaaaaaagaactggtatcacgccgtgaatacttcattaaagaacataaacttttagaagaacaacgtatcagccagcgtacccaatttgatattgaaatgatgaatgaattgggctattgctcgggaattgaaaactactctcgctatttatcgggaagaaatgagggcgaacctccaccaacattatttgattatatgccctctgatgccattttaattattgatgaatctcatgtaactgtgcctcaaattggtggaatgtatcgtggcgaccgttcacgtaaagaaaccttagtcgaatatggtttccgtttgccatccgccttggataatcgtccgttacgctttgaggaatttgaacgcttagctccgcaaaccatttatgtttccgcaacaccagggccttatgaattagaaaaatcaggcactgaaatcatcgatcaagtggttcgccccactggtttacttgatccactcattgaaattcgtccagtgtcaattcaagtggatgatttactttccgaagctcgccaaagagcggataaaaatgagcgagttttagtcacaacactcactaaaaaaatggcggaagatttaacggattatttggatgaacacgggattcgtgtgcgttatctgcattccgatattgatactgtggagcgagtagaaattatccgtgatttgcgtttaggggaatttgatgtattggttggaattaacttattgcgtgaaggtttagatattcctgaagtgtctcttgtggcgattttagatgcggacaaagaaggatttttacgttctgaacgctctttgatccaaaccatcggtcgtgctgcgcgaaacttaaatggtaaagcaattttatatgcagatagcatcacaaaatccatggaaaaagccatcaccgaaactaatcgtcgtcgtgaaaaacaaataaaatacaatgaagaacatggcattgtgccacaagcattgaataagaaagtcggtgaattattagatattgggcaaggtgcaaaccaaaaagcgaaagccaataaacaacgtggaaaaatggcggcagaaccaaccgcactttataatgcaccgaaaaatgccaaagaatatcaacaacaaatcaaaaaattggaacaacaaatgtataaatttgcgcaagatttggaatttgaaaaagccgcagcaattcgcgatcaattacatcaattacgtgaacaatttgtttttgataac

SEQ ID NO: 3728 - protein, 679 aa, Haemophilus influenzae
  Name: NTH2076
MSEKINTKPFILHSDFRPSGDQPQAIEKLAENLTDGLAHQTLLGVTGSGKTFTIANVIAQLNRPAMLLAPNKTLAAQLYAEMKAFFPENAVEYFVSYYDYYQPEAYVPSSDTFIEKDASINDQIEQMRLSATKSFLERRDTIVVASVSAIYGLGDPDSYLQMMLHLQQGAIIDQRQILAKLAELQYTRNDQAFQRGTFRVRGEIIDIFPAESDDRAVRIELFDDEIERLSLFDPLTGSSFGAVPRFTIYPKTHYVTPRERILDAIENIKKELVSRREYFIKEHKLLEEQRISQRTQFDIEMMNELGYCSGIENYSRYLSGRNEGEPPPTLFDYMPSDAILIIDESHVTVPQIGGMYRGDRSRKETLVEYGFRLPSALDNRPLRFEEFERLAPQTIYVSATPGPYELEKSGTEIIDQVVRPTGLLDPLIEIRPVSIQVDDLLSEARQRADKNERVLVTTLTKKMAEDLTDYLDEHGIRVRYLHSDIDTVERVEIIRDLRLGEFDVLVGINLLREGLDIPEVSLVAILDADKEGFLRSERSLIQTIGRAARNLNGKAILYADSITKSMEKAITETNRRREKQIKYNEEHGIVPQALNKKVGELLDIGQGANQKAKANKQRGKMAAEPTALYNAPKNAKEYQQQIKKLEQQMYKFAQDLEFEKAAAIRDQLHQLREQFVFDN

SEQ ID NO: 3729 - DNA, 1953 bp, Haemophilus influenzae
  Name: NTH2078
ttggatgtcgttgtgttagtggtttttacaatgaaaaaagcacattttcctttattccccatcttcacattcgtgttgattaatctcatcatcctttccttatcccgtttgggacttgctgtgtggcaatcagagcgtgtatccgccgtagatggctggttgcaattatttttgcaaggcgtacgaatggatgttgtggcactttgttatttatttggcgtaccagcattgctcacaacattgttccatagcagtaaagtttgggtaaaaattttacgcctttggctaacccttggtagtgtgtttattatctttatggaaattgccacacctgcctttattgaaacctacgattaccgcccaaatcgtttatttatcgaatacttgatttatccgaaagaagttttttcaatgcttgcggaaggacatttaagtgcggtaatttttagccttgttttcacgattttagctgccgtgatttattggaaaatttctggttgggcagtcaaaaatttaggttcaatcagttggaaacttcgccctgtgattgctttgcttgtgattgtcttgagcttccttggggcacgttcaagttttcaacaccgtggtataaatcccgctatggtggcattttcttctgatgcgttagtgaattctctggtgcttaattctggctattccgtgatttatgcggcacagcaatttaaagatgaagaaaaatcttcagaaatgtacggaaaaatggatgcagatgaaatttttcgtattgttaaagccagtcgtggccgtccagaaagtgattacatttcagataaatacccaactttaacgaaaaatgtcgcgacttatcagggtaaacctaaaaatatcgtgattttgctacaagaaagtctcggtgctcagtttattggaacacttggtggcaaaccactttctccaaatgtggatcagctcgcaaaagaagggtggttatttgaaaatctttatgcaacaggcacacgttcagtacgtggtattgaagcaacaacggcaggttttacgccaacaccagctcgtgcagtggtgaaacttaataatgcccaaagtggtttctttactattgcggatttattacataaacaaggctataacacttcgtttatttatggtggcgaaaagcacttcgacaatatggcgagttttttctacggtaatggctttaaagatatttgggatcaacaagactatcagaatccaaaatttactggcacttggggcgtgagtgatgaggatttatttgataaagccaatgaaactttcacgaaattacaaaatgaaggtaaaccgttttttagtttagtgtttagttccagcaatcacgatccatttgaatatccagatggcaagattgagctttatgagcaaccaaaagccactcgtaataacgcagcaaaatatgcggattatgccttaggtcatttctttaaaatggcaaaacagtctaattattggaaagatacgattttcttaattgttgcggatcacgattctcgtgtaggcggagcaagtcttgtgccgattaagcatttccatattccagccttgattcttggtgatggcattacgccacgccgtgatagccgtcttgtgagccaaattgatatgccaactacattgctttctttagctggcgtaagtggcaattatccaatgattggttttgatttaacgcaagatgtaaacccagatcgtgcttttatgcaatacgatcaaactcaagcaatgatgaaaggcaataatgatgtggtaattcaaatgtcaaataaagcagcgcaaggttatcattatgataaatcaacagaaactttaacgccaaaagacgtacctgatgcaatgaaaaaagaggcattggctcacgctttattaggtagttatttatataaaaatcgcttgtattcttcaggtgaaaataaa

SEQ ID NO: 3730 - protein, 651 aa, Haemophilus influenzae
  Name: NTH2078
LDVVVLVVFTMKKAHFPLFPIFTFVLINLIILSLSRLGLAVWQSERVSAVDGWLQLFLQGVRMDVVALCYLFGVPALLTTLFHSSKVWVKILRLWLTLGSVFIIFMEIATPAFIETYDYRPNRLFIEYLIYPKEVFSMLAEGHLSAVIFSLVFTILAAVIYWKISGWAVKNLGSISWKLRPVIALLVIVLSFLGARSSFQHRGINPAMVAFSSDALVNSLVLNSGYSVIYAAQQFKDEEKSSEMYGKMDADEIFRIVKASRGRPESDYISDKYPTLTKNVATYQGKPKNIVILLQESLGAQFIGTLGGKPLSPNVDQLAKEGWLFENLYATGTRSVRGIEATTAGFTPTPARAVVKLNNAQSGFFTIADLLHKQGYNTSFIYGGEKHFDNMASFFYGNGFKDIWDQQDYQNPKFTGTWGVSDEDLFDKANETFTKLQNEGKPFFSLVFSSSNHDPFEYPDGKIELYEQPKATRNNAAKYADYALGHFFKMAKQSNYWKDTIFLIVADHDSRVGGASLVPIKHFHIPALILGDGITPRRDSRLVSQIDMPTTLLSLAGVSGNYPMIGFDLTQDVNPDRAFMQYDQTQAMMKGNNDVVIQMSNKAAQGYHYDKSTETLTPKDVPDAMKKEALAHALLGSYLYKNRLYSSGENK

SEQ ID NO: 3731 - DNA, 2268 bp, Haemophilus influenzae
  Name: NTH2079
atgagcgaacaattacgtcaagcagccttagatttccacgaatttccaattcctggaaaaatcgaagttaccccaacaaaatcactcgcaacacaacgcgatctggctttagcttattcaccgggtgtggcagagccttgtttagaaattgaaaaagatcctgccgcctcttacaaatataccgcgcgtggcaatttagtagcggtgatttccaatggtacagcggtgcttggacttggcaatattggcgcgctagcgggcaaacctgtaatggaaggaaagggcgtattgttcaaaaaatttgcaggcatcaacgtgtttgatattgaagtgaatgagcatgatcccgataaacttgtggatattattgcctcgttagagccaactttcggtggagtaaatcttgaagatattaaagcaccagaatgtttttatattgaacaaaaattacgtgagcgtatgaatattcctgtattccatgatgaccaacatggaacagcgatcatcagtgctgccgcgatcatcaattctcttcgtattgtaggtaaaaaaattgaagatgttcgacttgttgcttctggtgcgggtgcagcatcaattgcgtgcttgaacttattgctttctttaggtatgaaacgtgaaaatatcacggtttgcgactcgaaaggcgtagtatataaaggtcgtgatgacaaaatggatcaaaccaaaaaagattatgcaattgaagataatggctggcgtaaacttggtgatgcgatgccaaatgcagatattttcttaggttgttctgcggctggtgcgcttacacaagatatggtgaaaaccatggctgcgcatccaattattcttgctttagctaatccaaatcctgaaattaccccgccagaagcaaaagcggttcgtcctgatgcgattgtatgtacaggtcgttctgattatccaaaccaagtaaataacgtgctttgtttcccatttattttccgtggtgcattagatgtgggcgcaaccactattaatgaagaaatgaaacgtgcggcagtttatgccattgctgatcttgcattagaagagcaaaacgaagtggtaacctctgcttacggtggagaaggggcaacatttggtgcggattatgtgattcctcgtccatttgatcctcgcttgattgtgcgtattgctccagcggtagcaaaagctgcaatggaatctggtgtggcaactcgtccgattcaaaattgggatatttatattgaccaactcactcagtttgtttacaaaaccaacttgtttatgcgccctattttcagccaagcaaaatcggcaaaacaacgcattattttagcggaaggggaagaaaataaagcattacacgctacccaagaagtgatttcaatgggcttggcaaatccaattttaattggtcgccgcagtgtgattgaagaaaaaattaaaaaacttggtttacgtttaactgcaggtgtggattttgaaattgtggataacgaagataatcctcgctatgaagaatgttggaaacactattacgaacttactaaacgtaaaggcattacacctgcgattgcaaaacgtgtcgtgcgttctaacactaccgtattagcttctacattgcttagcttaggttatgcagacgctttagtatgtggtttatttggttcatacggaaaacaccttgcatctattcgcgatattattggcttaaaagacggcgtgaaaactgccgctgctttaaatagtcttgtattaccgacgggtaacgtattcttaacagatactcacgtaaacagtaatcctacagcagaagaattagctgaaattaccttaatggcagcagaagaaattcatcgttttggtattgaacctgcagttgcattgctttctcattctaattttggttcgtctgattcattaggcgcaccaaaaatgcgcgaagtattacaaatcgtcaaagagcgcaatccacatttaatgattgatggggaaatgcgtggcgatttagcgatgaatgaagctcaccgaaaagaagtcatgcctgatagcccattgaaaggaagcgcaaatttattagtgttccctgatttgagtgcatcacgtattagttatagcttattacgcagcaccactacggcaattaccgttggcccgatcttaatgggtatgaataaatctgcgcatattcttaatccaggtgcatctgttcgtcgtattatcaatatgattgcctatgcagcagtgaaagcacaacaagag

SEQ ID NO: 3732 - protein, 756 aa, Haemophilus influenzae
  Name: NTH2079
MSEQLRQAALDFHEFPIPGKIEVTPTKSLATQRDLALAYSPGVAEPCLEIEKDPAASYKYTARGNLVAVISNGTAVLGLGNIGALAGKPVMEGKGVLFKKFAGINVFDIEVNEHDPDKLVDIIASLEPTFGGVNLEDIKAPECFYIEQKLRERMNIPVFHDDQHGTAIISAAAIINSLRIVGKKIEDVRLVASGAGAASIACLNLLLSLGMKRENITVCDSKGVVYKGRDDKMDQTKKDYAIEDNGWRKLGDAMPNADIFLGCSAAGALTQDMVKTMAAHPIILALANPNPEITPPEAKAVRPDAIVCTGRSDYPNQVNNVLCFPFIFRGALDVGATTINEEMKRAAVYAIADLALEEQNEVVTSAYGGEGATFGADYVIPRPFDPRLIVRIAPAVAKAAMESGVATRPIQNWDIYIDQLTQFVYKTNLFMRPIFSQAKSAKQRIILAEGEENKALHATQEVISMGLANPILIGRRSVIEEKIKKLGLRLTAGVDFEIVDNEDNPRYEECWKHYYELTKRKGITPAIAKRVVRSNTTVLASTLLSLGYADALVCGLFGSYGKHLASIRDIIGLKDGVKTAAALNSLVLPTGNVFLTDTHVNSNPTAEELAEITLMAAEEIHRFGIEPAVALLSHSNFGSSDSLGAPKMREVLQIVKERNPHLMIDGEMRGDLAMNEAHRKEVMPDSPLKGSANLLVFPDLSASRISYSLLRSTTTAITVGPILMGMNKSAHILNPGASVRRIINMIAYAAVKAQQE

SEQ ID NO: 3733 - DNA, 714 bp, Haemophilus influenzae
  Name: NTH2081
atgaacaaaactgtaggcagcacacttcttgttgctggtacgatgattggcgcgggaatgttggctatgccactcacttccgctggcattggcttcggctttactttagtcttgttattggggctttgggcattattaacttttagcgcacttttattcgttgaactctatcaaactgcggaaagtgatgcaggtatcggcacacttgcagaacaatattttggtaaaacaggacgcattattgccacagccgtgctaattattttcttatacgcattaattgccgcttatatcagcggtggcggttcactactaaaagatttattaccagaaagttttggcgataaagttagcgtcttattatttaccgtgattttcggttcatttattgtcatcggcacacatagcgtagataaaattaatcgcgtgttatttttcgttatgcttgctgcctttgccgtggtgttaagcttaatgttgccagaaatcaaatttgataacttaatggcgacgccaattgttaaggctttaattatctctgcaagccctgtatttttcacggcgtttggtttccacggttccattccaaggttaaataaatacttagatggcattgtaaaagcattgcgcttctctattttggtcggctctgccataacactttgtgcttatattctatggcaactatccacgctcgggcttgcttacaccaaa

SEQ ID NO: 3734 - protein, 238 aa, Haemophilus influenzae
  Name: NTH2081
MNKTVGSTLLVAGTMIGAGMLAMPLTSAGIGFGFTLVLLLGLWALLTFSALLFVELYQTAESDAGIGTLAEQYFGKTGRIIATAVLIIFLYALIAAYISGGGSLLKDLLPESFGDKVSVLLFTVIFGSFIVIGTHSVDKINRVLFFVMLAAFAVVLSLMLPEIKFDNLMATPIVKALIISASPVFFTAFGFHGSIPRLNKYLDGIVKALRFSILVGSAITLCAYILWQLSTLGLAYTK

SEQ ID NO: 3735 - DNA, 192 bp, Haemophilus influenzae
  n 111: n is any nucleotide
  Name: NTH2082
ttgtttgggcaattcaatatcatcgtaaaatacagtgaaactatggtaattaaatgtattgataaacaacaaaatttaggaaatatcattttattccttcttcttaagcancaatatagcaaggaagatagtaaaaaattcacaatttataaattttatttacagactgtaaattatacaatacaattatcg

SEQ ID NO: 3736 - protein, 64 aa, Haemophilus influenzae
  Xaa 37: Xaa is any amino acid
  Name: NTH2082
LFGQFNIIVKYSETMVIKCIDKQQNLGNIILFLLLKXQYSKEDSKKFTIYKFYLQTVNYTIQLS

SEQ ID NO: 3737 - DNA, 684 bp, Haemophilus influenzae
  Name: NTH2083
atgaatattactaaaatagactggcaaaaagttaatggtcttcttcctgttattattcaaaatataagtactcgtgaggtactaatgcttggctatatgaatgaagaagcccttacaaaaaccatcaaagaacgtaaagtaactttcttctctcgtaccaaacaacgattatggacaaaaggagaaatctcgggcaattttttaaatgtggaagaaatgagcttagattgcgataacgacactttgctcattttagttgatcccattggggcaacttgccacacaggtgaatacagctgcttccatcaatttacctctccacaatcagagaacaagaagcaacaatttgcaaattgggcgtggtttataaaattagaacaacatttaaaagaaaagaaaaatgcagatccttctaattcttatactgcaacattacacgcaaaaggtaccaaaaaaatcgcccaaaaagtgggggaagaaggtgtggaaactgccttggctgcggtcgcacaagataaagcggaagtcatttctgaagctacagatttggtctatcacttaaccgtattattacacaatcaagatcttcagtggtacgaaattatcgcaaaactacaagaacgccatcaagggattggattacatccagaaggaggaaataataagaaaatggtcaggcaatat

SEQ ID NO: 3738 - protein, 228 aa, Haemophilus influenzae
  Name: NTH2083
MNITKIDWQKVNGLLPVIIQNISTREVLMLGYMNEEALTKTIKERKVTFFSRTKQRLWTKGEISGNFLNVEEMSLDCDNDTLLILVDPIGATCHTGEYSCFHQFTSPQSENKKQQFANWAWFIKLEQHLKEKKNADPSNSYTATLHAKGTKKIAQKVGEEGVETALAAVAQDKAEVISEATDLVYHLTVLLHNQDLQWYEIIAKLQERHQGIGLHPEGGNNKKMVRQY

SEQ ID NO: 3739 - DNA, 774 bp, Haemophilus influenzae
  Name: NTH2084
atgttggcaaaacggataattccttgtttggatgtacgtgatggacaggtggtaaaaggggtacaattccgtacccacgaaattattggcgatattgtgccacttgctcaacgctatgcgcaagaaggagctgatgaattggtattttatgatattacggcttcatcagacggtcgtaccgtggataaaagttgggtagaacgaatcgctcaggtaattgatattccgttttgcgtagcaggtgggattaaaaccattgaagatgcggaaaaattgtttgcatttggggcggataaaatttcgattaattcccctgctctcgctgatccaacgctcatttctcgcttagcagatcgttttggcgtacaagcgattgtagtaggtattgatagttggtttgaacaggaaacaggtaagtattgggtaaaccaatatacaggcgatgaaacacgtacccgacaaactcattggcagttgttagattgggtaaaagaagtacaacaatgcggtgcaggagaaatcgtgctaaatatgatgaatcaagatggtttacgaaacgggtacgatttagcccagctcaagctggtgcgaggagtatgtagagtacctctaattgcatctggcggtgcgggtaaaatggtacattttcgtgatgcttttattgaagcaaaagtagatggggcattagctgccagcgtattccataaacagattattgaaattggcgagttaaaatcctaccttgtgcaatcagccatcgagattcggagtgaa

SEQ ID NO: 3740 - protein, 258 aa, Haemophilus influenzae
  Name: NTH2084
MLAKRIIPCLDVRDGQVVKGVQFRTHEIIGDIVPLAQRYAQEGADELVFYDITASSDGRTVDKSWVERIAQVIDIPFCVAGGIKTIEDAEKLFAFGADKISINSPALADPTLISRLADRFGVQAIVVGIDSWFEQETGKYWVNQYTGDETRTRQTHWQLLDWVKEVQQCGAGEIVLNMMNQDGLRNGYDLAQLKLVRGVCRVPLIASGGAGKMVHFRDAFIEAKVDGALAASVFHKQIIEIGELKSYLVQSAIEIRSE

SEQ ID NO: 3741 - DNA, 747 bp, Haemophilus influenzae
  Name: NTH2085
atgaaacaatctattattatccctgctcttgatcttatcaatggtcaagttgtgcggttacaccaaggcgattatgccaagcaaactacctattctgacaatccaattaagcaatttgataattatgtacgtcaaggagcaaaacaactacatctagtcgatttaacgggagcgaaaaatccccagtcaagacaaaccgcacttattggaaaaatcgttgaagcaacacaatgtaaagtacaagtgggaggaggcattcgtacagagcaagatgtggcagatttattggctgtgggtgcgaatcgcgtggtgattggttcaaccgccgtaactcatcgttcaatggtgaaaaactggttcatcaaatatggtgcggaaaaatttgttctagcattagacgtgaatattaatgcaagcggtcagaaaatcgttgcgattagcggttggcaggaagaaagtggtgtactattagaaacgttgatcgaagatttccaaaccgttggcttacaacaagttttatgtaccgatatttcacgcgatggcaccttgacaggttcaaatattggactttatcaagaaatttgtgagaaatatccacctattcagtttcaatcttctggagggattgggtcactggctgatattgaggctctaaaaggcacaggtgtgtcaggtgtaattgtaggtcgcgctttattagaagaaaaatttacgctttcggaggcatcaaaatgttggcaaaacgga

SEQ ID NO: 3742 - protein, 249 aa, Haemophilus influenzae
  Name: NTH2085
MKQSIIIPALDLINGQVVRLHQGDYAKQTTYSDNPIKQFDNYVRQGAKQLHLVDLTGAKNPQSRQTALIGKIVEATQCKVQVGGGIRTEQDVADLLAVGANRVVIGSTAVTHRSMVKNWFIKYGAEKFVLALDVNINASGQKIVAISGWQEESGVLLETLIEDFQTVGLQQVLCTDISRDGTLTGSNIGLYQEICEKYPPIQFQSSGGIGSLADIEALKGTGVSGVIVGRALLEEKFTLSEASKCWQNG

SEQ ID NO: 3743 - DNA, 597 bp, Haemophilus influenzae
  Name: NTH2086
atgacaaacatcacgattatagacacaggttgtgccaacctttcttctgtaaaattcgcctttgaccgattaggttacaataccgagatcacttttgatctcaataaaatcaaatctgccgataagctgattttacctggcgtaggcactgcaaatgcagcaatgtataatttacaagaacgtcaattgatcgaaaccattcaaaatctaactcaaccagtgctaggaatttgtttgggtatgcagttaatgaccgaattttccgaagagggtaatgtgccgaccttaaacctaataagcggaaaaactaatcgaattcccgatacgggtttaccgttacctcaaatgggatggaatcgcgtgcaatttgtaaaaaactgtccgttatttgatggtattgtgcaaaatagtcacttctattttgtgcatagttatgcagttagcccgaatgaacattcggtggcaataagcaattatggtgtgaatttttctgctgcgatagcgaaagagaatttttacggtgtacaatttcatcccgaacgttcgggtaaaaatggtgcgttgttgctaaaaaattttgtggaaaaagtaccgttt

SEQ ID NO: 3744 - protein, 199 aa, Haemophilus influenzae
  Name: NTH2086
MTNITIIDTGCANLSSVKFAFDRLGYNTEITFDLNKIKSADKLILPGVGTANAAMYNLQERQLIETIQNLTQPVLGICLGMQLMTEFSEEGNVPTLNLISGKTNRIPDTGLPLPQMGWNRVQFVKNCPLFDGIVQNSHFYFVHSYAVSPNEHSVAISNYGVNFSAAIAKENFYGVQFHPERSGKNGALLLKNFVEKVPF

SEQ ID NO: 3745 - DNA, 1143 bp, Haemophilus influenzae
  Name: NTH2087
ttgtataaagcaaatgataaacctcataccattcatataacatacacggagaaaaatatgcaacctactctttttatcgaccgagacggcacattaattgatgaaccaaaaactgatttccaaattgacagtttagagaaactaaaattagaaccgaaagtgattcccgcactcctcagactgaaagcgaaataccgttttgtgatagtttctaatcaagatgggcttggtacggatgcttttccgcaaacaaattttgataagccccacaatgtaatgatggcattatttgaatctcagggcattacctttgatgaagtactcatttgcccgcataagcccgaagaaaattgtctatgtcgcaaaccaaaaattaagttgcttgatcactatattcgtaaaaatttattcgatattgaccgctcttttgtcattggtgaccgagagaccgatgtgcaattagcagaaaatctaggtattcgagctattcaatacgatccacagaaaatgaattgggatctgattgcagaaaaattgttgggggaaacggtcacaaactgtggcaaacgtccgccacgttttgcagaagtaattcgtcaaactaaagagaccgatattaaagtgcagatttggctagatgaagctggtgtaaatgaaatcaaaactggcgttggtttttttgaccatatgctcgatcaaatcgccacacacggtgggtttagaatgaacgtgcagtgtaaaggcgatttatggattgacgaacatcacacggtggaggacaccgctctcgcccttggacaagcactgaaacaagccattggtgacaaacgtggtattgcccgtttcggctttgtgcttccaatggacgaatgtaaagcagaatgtgctttagatttatcgggcagaccttggatcaaattcaatgcctgctttaaacgcgataaagtgggcgattttagtacggaactcactgaacatttctttcaatctttggcattttcaatgcttgccacgattcatttaaatgtcacgggtaataacgatcatcataaaatagagagcttatttaaagcctttgggagaacattaagacaggcgattcggattgaaggaaatgaaatgccaagttcaaaaggagtttta

SEQ ID NO: 3746 - protein, 381 aa, Haemophilus influenzae
  Name: NTH2087
LYKANDKPHTIHITYTEKNMQPTLFIDRDGTLIDEPKTDFQIDSLEKLKLEPKVIPALLRLKAKYRFVIVSNQDGLGTDAFPQTNFDKPHNVMMALFESQGITFDEVLICPHKPEENCLCRKPKIKLLDHYIRKNLFDIDRSFVIGDRETDVQLAENLGIRAIQYDPQKMNWDLIAEKLLGETVTNCGKRPPRFAEVIRQTKETDIKVQIWLDEAGVNEIKTGVGFFDHMLDQIATHGGFRMNVQCKGDLWIDEHHTVEDTALALGQALKQAIGDKRGIARFGFVLPMDECKAECALDLSGRPWIKFNACFKRDKVGDFSTELTEHFFQSLAFSMLATIHLNVTGNNDHHKIESLFKAFGRTLRQAIRIEGNEMPSSKGVL

SEQ ID NO: 3747 - DNA, 1101 bp, Haemophilus influenzae
  Name: NTH2088
atgaatgattacaattcgcacattttacaatggaagaaaacaataatgacaatcacaactttatcccgacaaaatatacaagccttaacgccatatcaatccgctcgaaaactcggcggcaatggtacgatttggctgaatgcaaatgaatatccaacctcgcctgaatttcagctttcgggtaaggatttaaaccgctaccccgaacctcagcctcaaagagtggtacaggcttatgcgaattatgcgggcgtttcaactgaaaatgtactcgttactcgtggcggtgatgaaggcattgaattgataatccacactttttgcgaacccaaacaagatgccattttattctgtcctccgacttacggaatgtatgcagtgagtgctgaaacggcaggtgtgctaagtaagagcgtgcctttaactgacgattttcagcttaatttgccagaaatcaaaaatcatcttaatgatgtaaaagtagtctttgtatgcagcccaaataatccgacaggtaatttgctcaagcaatcagatatactcgatcttttgcaaatcacggcaggcaaagcgattgtggtggtggacgaagcctatattgagttctgtcctgaagcaagcgttattaatttgcttaaaaattacccgcacttagcaattatccgcacgctctctaaagcctttgctttagctggattgcgttgtggttttgtgttagcaaaccctgagctaattgacatcttaagtaaggtaatcgctccatatcctatccctgtgccgagtgctgatcttgcggaacaagcgttaagacctgcgaacatcgccactgttcaagctctcacacaagaacttctttccaatcgtcaatggcttgctaaagctcttttagttttacatcaagtggaaaaagtgtatgaaagtgaagctaattatctgttgatcaaatgtcaaaacgggcaagctgtgtttaaggcattgtgggaacaaggaattattttaagagaccagaataagacattgcatttacaaaattgtattcgcattactgtgggaacaaggaatgagtgtgagaaagttgttgaagcaattaaggaggtaaaa

SEQ ID NO: 3748 - protein, 367 aa, Haemophilus influenzae
  Name: NTH2088
MNDYNSHILQWKKTIMTITTLSRQNIQALTPYQSARKLGGNGTIWLNANEYPTSPEFQLSGKDLNRYPEPQPQRVVQAYANYAGVSTENVLVTRGGDEGIELIIHTFCEPKQDAILFCPPTYGMYAVSAETAGVLSKSVPLTDDFQLNLPEIKNHLNDVKVVFVCSPNNPTGNLLKQSDILDLLQITAGKAIVVVDEAYIEFCPEASVINLLKNYPHLAIIRTLSKAFALAGLRCGFVLANPELIDILSKVIAPYPIPVPSADLAEQALRPANIATVQALTQELLSNRQWLAKALLVLHQVEKVYESEANYLLIKCQNGQAVFKALWEQGIILRDQNKTLHLQNCIRITVGTRNECEKVVEAIKEVK

SEQ ID NO: 3749 - DNA, 1281 bp, Haemophilus influenzae
  Name: NTH2089
atgcaaacaattatttggaatcatttatcagaaactgaaaaacgcaaagtcattatgcgtccagtccaacaaaatggggaaaacattcagcaggcagttaatgccattcgtgaaaatgtggcatacaatggcgatcgggcgttatttgaactctgtgaaaaatttgatggcgtgaagttagataaactcattgtttcggcagatgaaattcaagcggcaagcagtcggatttctgtaaaacttcgcaatgcgattgagcaagccaaaacgaacattgaagcctttcacaaagcacagcaaaatcaggaaattgacctagagatccaagaaggcgtgcgttgccaagttgtgactcgtccaatttcttgtgtagggctttatattccgggtggttcagcaccgctgttttccaccgtattgatgttagctattcctgctaaaattgcaggttgtaaaaaaatcgtgctttgttcaccgccaccgatctcagatgaaattctctacactgctcatctttgcggtgtggaaactatctacgctataggtggtgctcaagcagtttttgcgatggctcaaggcacggaaagtgtggcgaaagtagataaaattttcggacctggaaacgcatttgtgacagaagcaaaacgtcaggtagcacaaaatagtacggcgattgatatgccagcgggaccttcagaagtgttagtaattgcagatgaatcggcagatcctgaatttgtggcaagcgatttactctctcaagcggaacatggggcagatagccaagtgattttggtggcgacctgtgaaactctggcaaaagagaccgcacttgcgattgaacgccaacttgctctattacctcgtgctgaaaccgctcgaaaagcgttaaaccacagccgtatttttatagcagaaagccttgaacaagcggtagaaattagcaatgaatatgcccctgaacatttaattgtgcaaacaaaaaacgcccgtaaattattaccatatttagataacgcaggctcaattttcttaggtgcatattcgcctgaaagtatgggcgattatgccagtggcacaaaccacgttttgcctacttatggttacaccaaaacttattctagtctaggattagctgattttagtaagcgaatgacagtacaagaactcacaccaaaaggttttaaaaaccttgctgaaacggtggaagtgatggcagaagctgagcaattggcagcacataaaatggcagtaagtgtaagattggcgaaactcaatatc

SEQ ID NO: 3750 - protein, 427 aa, Haemophilus influenzae
  Name: NTH2089
MQTIIWNHLSETEKRKVIMRPVQQNGENIQQAVNAIRENVAYNGDRALFELCEKFDGVKLDKLIVSADEIQAASSRISVKLRNAIEQAKTNIEAFHKAQQNQEIDLEIQEGVRCQVVTRPISCVGLYIPGGSAPLFSTVLMLAIPAKIAGCKKIVLCSPPPISDEILYTAHLCGVETIYAIGGAQAVFAMAQGTESVAKVDKIFGPGNAFVTEAKRQVAQNSTAIDMPAGPSEVLVIADESADPEFVASDLLSQAEHGADSQVILVATCETLAKETALAIERQLALLPRAETARKALNHSRIFIAESLEQAVEISNEYAPEHLIVQTKNARKLLPYLDNAGSIFLGAYSPESMGDYASGTNHVLPTYGYTKTYSSLGLADFSKRMTVQELTPKGFKNLAETVEVMAEAEQLAAHKMAVSVRLAKLNI

SEQ ID NO: 3751 - DNA, 105 bp, Haemophilus influenzae
  Name: NTH2090
atgcacgtagtgagccaagaaaatttattttgggaaacaatggaacagttaaaagaggcaggagctagttcaattttagtgttaccaattgagaagatgatggag

SEQ ID NO: 3752 - protein, 35 aa, Haemophilus influenzae
  Name: NTH2090
MHVVSQENLFWETMEQLKEAGASSILVLPIEKMME

SEQ ID NO: 3753 - DNA, 597 bp, Haemophilus influenzae
  n 584, 585, 586, 587, 588: n is any nucleotide
  Name: NTH2091
ttggatattctcgttgatggacaagattatcgcttagtgccaatgcttcctttattaaatcctcagcaaatatcaaccgcactttttccttatggcatccattatcagccgataatttcctctacaaatgagtggatactacaaaatattccttccttaaaaaaaggtgatctttgtgtggctgaatatcaaactgcagggcgcggtcggcgtggtcgccaatggttatcgccttttgctgggcaaatcatgtttagtttttattggacgtttgatcctaaaaaatcaattgaggggttaagtttagtcatcggtttggcgattgcggaagtgctaaatgtacaagtgaaatggccaaatgatattttgtttgatgaaagaaagttaggtggcattttagttgaaattgctaatcataaaaatggcatgctcaatttagtgattggcgtaggtattaatgcgtcgttgtcaaaacaaacagaaattagtcagccttatgcggaagtgtgtgaaattgatcctgatgtagaccgacaaaccttattacccaaacttatacaacatttatatacacgtttaaattnnnnnttaattaat

SEQ ID NO: 3754 - protein, 199 aa, Haemophilus influenzae
  Xaa 195, 196: Xaa is any amino acid
  Name: NTH2091
LDILVDGQDYRLVPMLPLLNPQQISTALFPYGIHYQPIISSTNEWILQNIPSLKKGDLCVAEYQTAGRGRRGRQWLSPFAGQIMFSFYWTFDPKKSIEGLSLVIGLAIAEVLNVQVKWPNDILFDERKLGGILVEIANHKNGMLNLVIGVGINASLSKQTEISQPYAEVCEIDPDVDRQTLLPKLIQHLYTRLNXXLIN

SEQ ID NO: 3755 - DNA, 1464 bp, Haemophilus influenzae
  Name: NTH2092
atgtcattacgcattaaacaagaagcccttacttttgacgatgttctactcgtcccagctcactcaacagtgcttccaaatactgccaacctttcaactcaacttaccaaagaaattcgcctaaatattccaatgctttcagcagcaatggataccgtaactgaaaccaaacttgcgatctctttagcacaagaaggcggtattggctttattcataaaaatatgacgatcgaacgccaagcagatcgtgttcgtaaagtaaaaaaattcgaaagtggtatcgtttctgaaccagtaactgttttaccaaatttaacgcttgccgaacttgctgaaatggtgaagaaaaacggatttgcgggctaccctgttgtagatgaggaaaataacttaatcggtatcattactggccgtgatacacgtttcgtaaaagatttaagcaaaacagtttcacaagtaatgacgaaaaaagaagacttggtgaccgtaaaagaaggggcgagtcgcgaagaaattttggaattaatgcatcaacaccgtgttgaaaaagtattagtggttaatgatagtttcaaacttaaaggtatgattaccgttaaagacttccaaaaagcagaacaaaaaccaaatgcgtgtaaagatgaatttggtcgtttacgtgtcggtgcggctgtaggtgcaggcccaggtaacgaagaacgtattgatgcattactaaaagctggggtggatgtgttgttaatcgactcttctcacggtcactcagaaggcgtattacaacgtgttcgtgaaactcgtgcaaagtatccaaatttgcctatcgttgcaggtaacgtagcaacggctgaaggcgcaattgcattagcagacgcaggcgcaagtgcggtaaaagtaggtattggtcctggttcaatttgtacaactcgtattgtaactggcgtaggtgttccacaaatcacggctatcgcagatgcagcagcagcattaaaagatcgtggcattccagttattgctgacggtggtatccgtttctctggtgatattgcaaaagccatcgctgcaggcgcaagctgtgtaatggttggttctatgtttgcgggtactgaagaagcaccaggtgaaatcgaactttatcaaggtcgtgcatttaaatcttaccgtggtatgggctcattaggtgcgatggctaaaggctcttcagaccgttatttccaatcggataacgcggcagataaactcgtaccggaaggtattgaaggtcgtattccatataaaggttacttaaaagaaatcatccaccaacaaatgggtggcttacgttcttgcatgggcttaactggctgcgcaactattgatgaactacgcaccaaagcggaatttgttcgcattagcggtgcaggcattaaagaaagccacgttcatgatgttgctattactaaagaagcaccgaactatcgtatgggc

SEQ ID NO: 3756 - protein, 488 aa, Haemophilus influenzae
  Name: NTH2092
MSLRIKQEALTFDDVLLVPAHSTVLPNTANLSTQLTKEIRLNIPMLSAAMDTVTETKLAISLAQEGGIGFIHKNMTIERQADRVRKVKKFESGIVSEPVTVLPNLTLAELAEMVKKNGFAGYPVVDEENNLIGIITGRDTRFVKDLSKTVSQVMTKKEDLVTVKEGASREEILELMHQHRVEKVLVVNDSFKLKGMITVKDFQKAEQKPNACKDEFGRLRVGAAVGAGPGNEERIDALLKAGVDVLLIDSSHGHSEGVLQRVRETRAKYPNLPIVAGNVATAEGAIALADAGASAVKVGIGPGSICTTRIVTGVGVPQITAIADAAAALKDRGIPVIADGGIRFSGDIAKAIAAGASCVMVGSMFAGTEEAPGEIELYQGRAFKSYRGMGSLGAMAKGSSDRYFQSDNAADKLVPEGIEGRIPYKGYLKEIIHQQMGGLRSCMGLTGCATIDELRTKAEFVRISGAGIKESHVHDVAITKEAPNYRMG

SEQ ID NO: 3757 - DNA, 108 bp, Haemophilus influenzae
  Name: NTH2093
ttgtggatatttgtcatttataatgctcttattattgatagtgtaagcggttcatattatttaaaactttgcaaaaaccaaccgcactttaaacagcaaaaggcaggc

SEQ ID NO: 3758 - protein, 36 aa, Haemophilus influenzae
  Name: NTH2093
LWIFVIYNALIIDSVSGSYYLKLCKNQPHFKQQKAG

SEQ ID NO: 3759 - DNA, 1569 bp, Haemophilus influenzae
  Name: NTH2094
atgacaaatatccacaatcacaaaatcctaatcctcgacttcggttcacaatatactcaactgattgcgcgtcgtgtgcgtgaaatcggtgtgtactgtgaactttgggcttgggatgtaaccgaacaacaaatccgtgaatttgctccaacgggtatcattctttctggcagccctgaaagcacaactgaagaaaacagccctcgtgcacctgaatatgtgtttaatgctagtgtaccagtattaggcatttgctatggaatgcaaactatggcgatgcaacttggcggtttaaccgaaacttctgaccaccgagagttcggctatgcttcagtttctcttgaaaattccaccgcactttttgcaaatttaaacgataattcgaccgcttctgagccgaagttagacgtttggatgagccacggcgataaagtaacgcgcttaccagaaaacttcaaagtaactggcacaacgccaacctgcccaattgctgcaatgtcggatgaaaatcgtcgtttctacggcgtacaattccaccctgaagtaacgcatactaaaaaaggcttggaattattaaccaacttcgtagtaaacatctgtggttgcgaaaccaaatggacagcagaaaacattatcgaagatgccgttgctcgcattaaagagcaagtaggcgatgatgaagtgattttaggtttatctggtggtgtggactcttctgtggttgcattacttttacaccgtgctatcggcaaaaacttacactgcgtatttgtggataacggtttactccgcttacacgaaggcgatcaagtcatggaaatgtttggcgataaattcggtttaaatattacccgtgttgatgctgaaagccgtttcttaggcgaacttgcaggcgtatctgatcctgaagcaaaacgtaaaattatcggtaaagtatttgttgatgtatttgatgatgaatcgaaaaaactcactaatgtgaaatggttagcacaaggtacgatttaccctgatgtcatcgaatctgcagccagcaaaacaggcaaagcccacgtcattaaatcacaccataacgtaggtggcttaccagactatatgaaacttggcttggttgaaccattacgtgaattgtttaaagatgaagtacgtaaaatcggtttggcattaggcttgccagctgaaatgatcaaccgccatccattccctggccctggtttaggcgtgcgagtattaggcgaagtgaaaaaagaatactgtgatttattacgccgtgcggatgcgatctttatcgaagaattacgcaacagcggttggtatgaaaaaaccagccaagcattcagtgtgttcctgcctgtgaaatctgttggagtgatgggcgatggtcgtaaatacgattgggttatttccctacgcgcagtagaaacaatcgattttatgaccgcacattgggcacatttgccttatgatttattaggcaaagtgtctaaccgcatcattaacgaagtgaacggcatttcccgcgtcgtgtacgacatcagcggaaaaccaccagcgacaatcgagtgggaa

SEQ ID NO: 3760 - protein, 523 aa, Haemophilus influenzae
  Name: NTH2094
MTNIHNHKILILDFGSQYTQLIARRVREIGVYCELWAWDVTEQQIREFAPTGIILSGSPESTTEENSPRAPEYVFNASVPVLGICYGMQTMAMQLGGLTETSDHREFGYASVSLENSTALFANLNDNSTASEPKLDVWMSHGDKVTRLPENFKVTGTTPTCPIAAMSDENRRFYGVQFHPEVTHTKKGLELLTNFVVNICGCETKWTAENIIEDAVARIKEQVGDDEVILGLSGGVDSSVVALLLHRAIGKNLHCVFVDNGLLRLHEGDQVMEMFGDKFGLNITRVDAESRFLGELAGVSDPEAKRKIIGKVFVDVFDDESKKLTNVKWLAQGTIYPDVIESAASKTGKAHVIKSHHNVGGLPDYMKLGLVEPLRELFKDEVRKIGLALGLPAEMINRHPFPGPGLGVRVLGEVKKEYCDLLRRADAIFIEELRNSGWYEKTSQAFSVFLPVKSVGVMGDGRKYDWVISLRAVETIDFMTAHWAHLPYDLLGKVSNRIINEVNGISRVVYDISGKPPATIEWE

SEQ ID NO: 3761 - DNA, 888 bp, Haemophilus influenzae
  Name: NTH2095
atgaaagtagttactcaaggtgtattattgtgcattttttcacaatgtttatttggcatattgtatttatttagtatatggctccaaccacttagcggaacggatgtttttgcgtggcgtatgctgaccatgatctttgggttacttttaattttattcccgactattggttgccgctctcttttgtctcttatcacgacaacgttaggaaaaagttggacgcgttgggttttatttttactggggacattagatgcgggaagtcaattctggctctttatgtgggctccgctaaatggtgaagggataaatattgcgatgggatattttctttttccgctgattatggctgttttaggatgggcttggttaaaagaacgtttatcatttattcagaaaatcgcgcttttactggctgcctgcggtgttgcacatgaattatggcacactcaaagtttttcatggacaagtttgtgggtttgtacggtttatccattttattatctaagccgtaaattgatgaaaatccctgctctacaaggaattacattggatattattttaatttcgattccttggtttatttatattctttctcaaagcgatacgctttctttggttacgcaagaatatcgttattggttattgctaccagcacttggtattgtgagtgcgatttcgctttcagccaacttaaaatccagccaacaaattccagttagtatttttgcggtgttgagttatattgaacccatactgctttttttaatagctgtctttgtgctggataatcaaataaccacaagcgactattttacttatgtgcctatttggttaagtctcattgtgattggcatagaagggcttttaaacaaaaataaagtgcgg

SEQ ID NO: 3762 - protein, 296 aa, Haemophilus influenzae
  Name: NTH2095
MKVVTQGVLLCIFSQCLFGILYLFSIWLQPLSGTDVFAWRMLTMIFGLLLILFPTIGCRSLLSLITTTLGKSWTRWVLFLLGTLDAGSQFWLFMWAPLNGEGINIAMGYFLFPLIMAVLGWAWLKERLSFIQKIALLLAACGVAHELWHTQSFSWTSLWVCTVYPFYYLSRKLMKIPALQGITLDIILISIPWFIYILSQSDTLSLVTQEYRYWLLLPALGIVSAISLSANLKSSQQIPVSIFAVLSYIEPILLFLIAVFVLDNQITTSDYFTYVPIWLSLIVIGIEGLLNKNKVR

SEQ ID NO: 3763 - DNA, 93 bp, Haemophilus influenzae
  Name: NTH2096
ttgagtaactactttcattttgaacctcatctcatcaatgtgattattataaaatcccaagacaataaaaaatctcaactttattttttattg

SEQ ID NO: 3764 - protein, 31 aa, Haemophilus influenzae
  Name: NTH2096
LSNYFHFEPHLINVIIIKSQDNKKSQLYFLL

SEQ ID NO: 3765 - DNA, 504 bp, Haemophilus influenzae
  Name: NTH2097
gtgataatatttttctcgatagttacatttttgagaaattatcttatgcaaacactggataaattagatcgtcatattttgaatgtattacaacaagatgccatgattccgttaaaagaactgtcagagaaagtgaatagttccgttgcaacctgtcaacgacgtgtgcaatcattaactgattcaggcgttattacaaaacgagttgcagttgtttccccaaaagccgttgggcgtacgattagcgtatttgtcatggtcgaaatggataatcaccattcttattatcaagagcaatttgaacggaaaatgcgtcaagaagacgaagtggtaagctgttacgaaatctcaggggactatgattttatgttgctactccatgcaaaagatatggaaagctatcacgcattcacacgccgagtattgacgggtgaatttcatgtaagaacttataaaagtttatttgtaatgaattttaccaaagcagatagtggaattatctta

SEQ ID NO: 3766 - protein, 168 aa, Haemophilus influenzae
  Name: NTH2097
VIIFFSIVTFLRNYLMQTLDKLDRHILNVLQQDAMIPLKELSEKVNSSVATCQRRVQSLTDSGVITKRVAVVSPKAVGRTISVFVMVEMDNHHSYYQEQFERKMRQEDEVVSCYEISGDYDFMLLLHAKDMESYHAFTRRVLTGEFHVRTYKSLFVMNFTKADSGIIL

SEQ ID NO: 3767 - DNA, 963 bp, Haemophilus influenzae
  Name: NTH2099
atggcggtgttttttgtattagtgggaatggaagtcaaaaaagaattatttgaaggcgcgctttctacctatcagcaagctattttccctgctattgcagctattggcggaatggttataccggctgtagtttattggtttatcgctaaacaagatccaagtttagctaatggctgggcaattccaatggcaacagacattgcttttgcactgggaattatggcgttattgagtaaacaagtgccacttccactgaaaatatttttacttgcccttgctattattgatgacctcggtgcgatagttgttattgcattatttttctcgcacggattgagtgtacaagcactaattttttctgccgtggcaattattgtgctgatattactaaatcgtttcaaagtttccgcactttgcgcttatatggtcgtaggtgcaattttatgggcttccgtattaaagtctggtgtgcatgctactttagcaggcgttattattggttttagcattccattgaaaggtaaaaaaggagaacgcccattagatgatttcgagcatattttatcctcttggtcatctttcgttattttaccacttttcgcatttgccaatgctggtgtgagttttgctggcatagatgtgaatatgatttcgtcgccattattattggctatagcaagcggtttaattattggtaaaccagtcggtatatttggatttagttatctttctgttaaattgggattagctaaattaccagatggaattaattttaaacaaatttttgctgttgcggttttatgtggaatcggttttacgatgtcaatgttcttagcaagccttgcgtttgatgctaatgcgggggaaagtgtcaatactctttctcgtttaggtattctacttggatcaactgtttcggcaatacttggttatttattcttaaaacagacgacaaaactaagt

SEQ ID NO: 3768 - protein, 321 aa, Haemophilus influenzae
  Name: NTH2099
MAVFFVLVGMEVKKELFEGALSTYQQAIFPAIAAIGGMVIPAVVYWFIAKQDPSLANGWAIPMATDIAFALGIMALLSKQVPLPLKIFLLALAIIDDLGAIVVIALFFSHGLSVQALIFSAVAIIVLILLNRFKVSALCAYMVVGAILWASVLKSGVHATLAGVIIGFSIPLKGKKGERPLDDFEHILSSWSSFVILPLFAFANAGVSFAGIDVNMISSPLLLAIASGLIIGKPVGIFGFSYLSVKLGLAKLPDGINFKQIFAVAVLCGIGFTMSMFLASLAFDANAGESVNTLSRLGILLGSTVSAILGYLFLKQTTKLS

SEQ ID NO: 3769 - DNA, 96 bp, Haemophilus influenzae
  Name: NTH2100
gtgacttctgcagatagtcgtcgattaattcaacttcgcgtgacagtgccagatgaacatttggcagaaatgaataatgtagatgaaaaatctgaa

SEQ ID NO: 3770 - protein, 32 aa, Haemophilus influenzae
  Name: NTH2100
VTSADSRRLIQLRVTVPDEHLAEMNNVDEKSE

SEQ ID NO: 3771 - DNA, 1566 bp, Haemophilus influenzae
  Name: NTH2101
atgaaaaatctgaataggattttattatcaattaaatttatgaataaatatttaacttattttattgcttttatatcgggtttagtcggtgtttttgccttttcgccatttgattattggcctttagcctatgtgtctttactcggtttactttatgtcgctaaaaatcctaaaaaatccaccgcacttttatccactttcttgtgggcgatgggatttttctgctttggagtaagttggcttaatgttagtatccatcaatttggtggcgcgtcgttaggagtgagttatttccttgtcggtttgcttgcggcttatcttgcgctatatccaatgctctttacctatttagttcagcgtttcaaagtgcaaagtgcggtaatttttgccgtgatttggacattgacagaatttttacggggttggatttttactggttttccttggcttcagtttggttatacacaaattgacagcccattttatggtctcgccccgatttttggggtaacaggattgacattctttaccctttgggcaagtgcggtcatttttaatctcgtttcatctttgtttaaaacgaaaaattttaaattagttttagcgaatgctttgttattgattattgtagggggattaagtgcttattcatcgcgaattcactttgtaaaatctgttgaaaataaggcaatttcagtcacgcttgcgcaaggcaatattgaacaaaatcttaaatgggatcctaattatttctattctactttggcaatttatcaaaaattaatcgcagaaaatcttggtaaaaccgatttaattattttgcctgaatcagccttaccaacccttgaaaatgcaattacaccattttttgaaaaattagagcatgctgctaaagaaactaaaacggagattatgattggaacggtattccaagatacaaaatctggtaagttattaaattcaattatgactactggaaacccagattttccttatcaaccagatacgccaaatcgttataataaacatcatctcgtgcctttcggggaatatgttccgctagaaagtattttgcgaccgcttaattcagtgtttaatttaccaatgtcagcatttcaaagtggagaggctgttcaaccctctttaatcgcaaaaaaacgtgctttttcgccagcaatttgttatgaaattattttcggcgagcaagtgcgacaaaatttgaaacaagatacggattatttgctcaccttatctaatgatgcgtggtttggcgattctattgggccttggcaacatttacagatggcaagaatgcgcgctttagaattaggcaaaccgcttattcgtgcaacaaatacggggatttcagtttttgttgatgcgcaaggtaaggtattagcacaagccccgcaatttattgaaacaactttgacttataaaattgcacctgcggaaggcaaaaccccttattctgtgttaggaaatatgcctttgtatgctttatctttattgtttttactcttgcacagtatgatggcgtttattcgtcgtaagatgaatatctta

SEQ ID NO: 3772 - protein, 522 aa, Haemophilus influenzae
  Name: NTH2101
MKNLNRILLSIKFMNKYLTYFIAFISGLVGVFAFSPFDYWPLAYVSLLGLLYVAKNPKKSTALLSTFLWAMGFFCFGVSWLNVSIHQFGGASLGVSYFLVGLLAAYLALYPMLFTYLVQRFKVQSAVIFAVIWTLTEFLRGWIFTGFPWLQFGYTQIDSPFYGLAPIFGVTGLTFFTLWASAVIFNLVSSLFKTKNFKLVLANALLLIIVGGLSAYSSRIHFVKSVENKAISVTLAQGNIEQNLKWDPNYFYSTLAIYQKLIAENLGKTDLIILPESALPTLENAITPFFEKLEHAAKETKTEIMIGTVFQDTKSGKLLNSIMTTGNPDFPYQPDTPNRYNKHHLVPFGEYVPLESILRPLNSVFNLPMSAFQSGEAVQPSLIAKKRAFSPAICYEIIFGEQVRQNLKQDTDYLLTLSNDAWFGDSIGPWQHLQMARMRALELGKPLIRATNTGISVFVDAQGKVLAQAPQFIETTLTYKIAPAEGKTPYSVLGNMPLYALSLLFLLLHSMMAFIRRKMNIL

SEQ ID NO: 3773 - DNA, 735 bp, Haemophilus influenzae
  Name: NTH2102
atgcgcataccaagaatttatcatccaatatcccttgaaaatcaaactcaatgttatctttcagaagacgctgcaaatcacgttgctcgagtgttaagaatgacagaaggcgaacagcttgaactctttgatggttctaatcatatttatccagcaaaaattattgagtcaaataaaaagtccgtaaaagtagagattttggggcgtgagcttgcggataaagaatcccatttaaaaatccatttaggacaagtgatttctcgcggagaacgaatggaatttactattcaaaaatccgtagaattaggggtaaatgtgattacgccattatggtcagaacgctgtggcgtaaaacttgacactgagcggatggataaaaaaatccaacaatggcaaaaaattgcgattgcagcttgtgagcaatgcggtcgtaatagcgtgccagagattcgtccactgatgaaattacaagattggtgtgcagaaaatgatggtgcattgaaattgaatttacatccacgcgcgcactattctattaaaaccttaccgactattcctgctgggggtgttcgcttattaattggctcggaaggtggattatcagcacaagaaattgcccaaactgaacagcaaggatttactgaaattttattaggaaaacgtgttttacgcactgaaactgcatcacttgcagcgataagtgcattgcaaatttgttttggggacttaggcgaa

SEQ ID NO: 3774 - protein, 245 aa, Haemophilus influenzae
  Name: NTH2102
MRIPRIYHPISLENQTQCYLSEDAANHVARVLRMTEGEQLELFDGSNHIYPAKIIESNKKSVKVEILGRELADKESHLKIHLGQVISRGERMEFTIQKSVELGVNVITPLWSERCGVKLDTERMDKKIQQWQKIAIAACEQCGRNSVPEIRPLMKLQDWCAENDGALKLNLHPRAHYSIKTLPTIPAGGVRLLIGSEGGLSAQEIAQTEQQGFTEILLGKRVLRTETASLAAISALQICFGDLGE

SEQ ID NO: 3775 - DNA, 579 bp, Haemophilus influenzae
  Name: NTH2103
ttgttttggggacttaggcgaatgatggaattacaaggaaaatttttgatcgcaatgccacatttagacgattattttaatcgcacggtggtgtttatgtgtgagcataatgaacagggttcaatgggtttggtaattaatcagccgacagatttaagcattgcggaactttattcaaaactcaattttatgatgaaaaatgaccgcacttttggtaatgaaatggtggttgcgggtgggcctgtgcatacagaaagagggtttattttacataagaatacgcttaatgcttttcaacatacttacaaagtcacaaaggaactttcaatgacaacctccgctgatgtggtggaaacgctaggttcaacttttgcacctgaaaaatatcttgttgcgctaggatgttcaagctggggggctggtcagttagaaaaagaaatcagagataatgcgtggttggtggtgtcatctaacgatcaaattttatttgatatgccctatgaagatcgttatgctgcagccaatcagttacttggtattcatccttataattttgcgttagcgcaagtggggcatagt

SEQ ID NO: 3776 - protein, 193 aa, Haemophilus influenzae
  Name: NTH2103
LFWGLRRMMELQGKFLIAMPHLDDYFNRTVVFMCEHNEQGSMGLVINQPTDLSIAELYSKLNFMMKNDRTFGNEMVVAGGPVHTERGFILHKNTLNAFQHTYKVTKELSMTTSADVVETLGSTFAPEKYLVALGCSSWGAGQLEKEIRDNAWLVVSSNDQILFDMPYEDRYAAANQLLGIHPYNFALAQVGHS

SEQ ID NO: 3777 - DNA, 417 bp, Haemophilus influenzae
  Name: NTH2105
atgggaattaccgctctggcttttgattttggcactaaaagtatcggttgtgccataggacaaagtattactggcacagcacaagccttgcccgcttttaaggcgcaagatggcatcccaaattgggaagcgatcgaaaaatgtttgaaagaatggaaaccagatgttgtcattgttggtcttcctttaaatatggacggaacagaacaagatctcactctacgtgctcgtaaatttgcaaatcgtttacaaggtcgttttggcgttaatgttcatttacaagatgaacgattaaccaccacgcaagctcgtagtgagatttttgaacgtggtggttttaaagcattaaaaaaaggcaaaatcgatggagtgtcagcttgtttaattttagagagctggtttgaatacgctgaatat

SEQ ID NO: 3778 - protein, 139 aa, Haemophilus influenzae
  Name: NTH2105
MGITALAFDFGTKSIGCAIGQSITGTAQALPAFKAQDGIPNWEAIEKCLKEWKPDVVIVGLPLNMDGTEQDLTLRARKFANRLQGRFGVNVHLQDERLTTTQARSEIFERGGFKALKKGKIDGVSACLILESWFEYAEY

SEQ ID NO: 3779 - DNA, 579 bp, Haemophilus influenzae
  Name: NTH2106
gtgatgaatttattacctcgtgcatttagtaaaaatcagcatacggcactatggattgatatggaaaataatcttattcatattgatgccgcatcaagtaaacgcgcggaagatgcgctcgcattactgcgtaaatccttaggttcgctccctgtcgtgcctttagcctttgctaatgaacctagcacgattttaaccaattggatccttcaagataatttgccgcattggttacttgcattagaagaagccgagcttcgtggcagtcaggaagacagcgttatccgttgcaaaaaacaacctttagaaaatgaagaaattctcgctcttctgcaagatggcaaaaaagtagtaagtaaattagccttagaatgggaagataccttaactttcgtttttaacgaagattgcacaatcaaacgtttaaaatttgcagatactgtacgggaaaaaaatgatgatattctgaaagaagattttgcacagcgtttcgatgcagattttgtactgatgactggtattttagccaaactcaccgaaaatttattagatgaatttggtggcgaaaaagcaagatta

SEQ ID NO: 3780 - protein, 193 aa, Haemophilus influenzae
  Name: NTH2106
VMNLLPRAFSKNQHTALWIDMENNLIHIDAASSKRAEDALALLRKSLGSLPVVPLAFANEPSTILTNWILQDNLPHWLLALEEAELRGSQEDSVIRCKKQPLENEEILALLQDGKKVVSKLALEWEDTLTFVFNEDCTIKRLKFADTVREKNDDILKEDFAQRFDADFVLMTGILAKLTENLLDEFGGEKARL

SEQ ID NO: 3781 - DNA, 315 bp, Haemophilus influenzae
  Name: NTH2108
atgagttataaagttaatttttggttcaaaaatttaatgacttatagactgactaaaccgctagattgggatcttacacaactacaaactcaactagaagattgtcaattccatccctgcggtgctcaagatcaaagtaaatttggctggtcagccccattacgaggttctgatttactctatttttctgttggaaaacaaattctattaatcgccaaaaaagaagaaaaaatcttgccggcaaatgtggtcaaacgtgaacttgatgaacgcattgaaagccttgaaaaaaagaaaatcgcaaacttaaaaagg

SEQ ID NO: 3782 - protein, 105 aa, Haemophilus influenzae
  Name: NTH2108
MSYKVNFWFKNLMTYRLTKPLDWDLTQLQTQLEDCQFHPCGAQDQSKFGWSAPLRGSDLLYFSVGKQILLIAKKEEKILPANVVKRELDERIESLEKKKIANLKR

SEQ ID NO: 3783 - DNA, 372 bp, Haemophilus influenzae
  Name: NTH2109
atggctaaaaaagtaaaaccacttgttgacactgaaatcaagaaagcaaaagcatcaaacaaaccatatacattgactgatggttatggactatttctaatcatttcaccaacaggttcaaaatcttggcggtttaattactatcgacctataacaaagaaacgagcaaaaatttctttaggcctatatccagcaattacactatcaaaagcaagggagttgagagaacaatatcgtcaattactagctaataagattgatccgcaagaatacataaaacagcatgaattactggcattacaacgacaaaacaatacattttttgccatatcaactcaatggaaacaaaaaaaagttctgaaatcaagtctg

SEQ ID NO: 3784 - protein, 124 aa, Haemophilus influenzae
  Name: NTH2109
MAKKVKPLVDTEIKKAKASNKPYTLTDGYGLFLIISPTGSKSWRFNYYRPITKKRAKISLGLYPAITLSKARELREQYRQLLANKIDPQEYIKQHELLALQRQNNTFFAISTQWKQKKVLKSSL

SEQ ID NO: 3785 - DNA, 870 bp, Haemophilus influenzae
  Name: NTH2110
atggaaacaaaaaaaagttctgaaatcaagtctgtaacacttaaaagccgatggagaacgctagaaaaatatgcatttccatatttaggcgataaccctattgctgaaattacaccacaacagttacatgatacagttataccattatttgaacgaggagtttctcacactgggaagcttgttattgcattagttaatgaaatcatgaattttgctgttaacaaaggtattattgagtttaataaatgcatcaatgtatcaaaggcttttaatgtaaacagaacaacacatcatccaactattagacctgaaaaactacctgaattcatgtctgcgttacgtcattcacatattgaccttatggtgaaatatcttattgaattctcccttttgactatcacccgtccaagtgaagctgcaaatgcacaatggaatgaaattgattttgagaaatcgctatggaatatccctgctgaacgcatgaaaatgaaaaaagctttcaccattccattatcactacaagtgcttaaaatacttaataagctaaaaaacatttcaggccgtagtcgttttatttttcaaagccaacgttatcctgaaagaccattacattcaagctctgccaatgcagcaattaaacgcgttggttataaagatcaattaacatcacatgggctacgttctatcgcaagcacctatcttagcgagacatttaccgaaatgaatctggaaattcttgaagcttgcctttctcatcaaagcaaaaatcaagttcgtaacgcctacaatcgctcaacctatcttgaacaacgaaaaccattaatgaatgcttggggagattttgttgaagaatgtatgaaaaaaagtatc

SEQ ID NO: 3786 - protein, 290 aa, Haemophilus influenzae
  Name: NTH2110
METKKSSEIKSVTLKSRWRTLEKYAFPYLGDNPIAEITPQQLHDTVIPLFERGVSHTGKLVIALVNEIMNFAVNKGIIEFNKCINVSKAFNVNRTTHHPTIRPEKLPEFMSALRHSHIDLMVKYLIEFSLLTITRPSEAANAQWNEIDFEKSLWNIPAERMKMKKAFTIPLSLQVLKILNKLKNISGRSRFIFQSQRYPERPLHSSSANAAIKRVGYKDQLTSHGLRSIASTYLSETFTEMNLEILEACLSHQSKNQVRNAYNRSTYLEQRKPLMNAWGDFVEECMKKSI

SEQ ID NO: 3787 - DNA, 432 bp, Haemophilus influenzae
  Name: NTH2111
atgggtataagaatgaacgtacatgaaaagatcagaaaactacgtgaaacaaagcattggtcacaagaagagatggctgaaagaatgagtatgtcattgaatggctatgcaaaaattgaacgtggtgaaacgaaattacatctggataagctagagcaaattgcacagattttagatatagatattgttgaattgattaattctggtgaacgaaatgtcttcgttcaattcaatgagaattctcattttagttcgtcatttcagggagacaatgagaaatctctattgattgagattgaaaaactaaaattatcgttatcacattgtcagcaattattggaagaaaaagaaggtttgttgaataagctagtagagcaaaaagataatgaaataaagctactgagagaaatggtagagttactgaagaaaggt

SEQ ID NO: 3788 - protein, 144 aa, Haemophilus influenzae
  Name: NTH2111
MGIRMNVHEKIRKLRETKHWSQEEMAERMSMSLNGYAKIERGETKLHLDKLEQIAQILDIDIVELINSGERNVFVQFNENSHFSSSFQGDNEKSLLIEIEKLKLSLSHCQQLLEEKEGLLNKLVEQKDNEIKLLREMVELLKKG

SEQ ID NO: 3789 - DNA, 330 bp, Haemophilus influenzae
  Name: NTH2112
atgctaattatcggattcgttgataacaaaaaaattccaaccgaatttattgtttttgggattctaggtatttgttacatttgctacacatttaattcttgggcaaataagcctgaagtctgtccagtctgtaaatcaggcaaaattgaattggattcaattaaagaaattgaccgctggctgggaaaaactaaagtgcgtgaaagaatggcatctggaaaaacacgagaacgatatattcaatgcacgaaagtaaaaaaacgatatacatattgttgccaaaatcctaattgcaagcatacatatactaaaatacgggaagaagaatta

SEQ ID NO: 3790 - protein, 110 aa, Haemophilus influenzae
  Name: NTH2112
MLIIGFVDNKKIPTEFIVFGILGICYICYTFNSWANKPEVCPVCKSGKIELDSIKEIDRWLGKTKVRERMASGKTRERYIQCTKVKKRYTYCCQNPNCKHTYTKIREEEL

SEQ ID NO: 3791 - DNA, 771 bp, Haemophilus influenzae
  Name: NTH2113
atgttttcaaccgctataattgaaaaaattaattattacatctattgtcttgttgaccctagaaatcaaaatatcttctatattggtaaaggtattggcaatagagtttttcaacatgcacaaggtgcattaacttgcaaaactaatgaaaatgataaaatatcactaatcaatgatatacataaagatggacttgaacccttatactatattttaagacataatatcaaggaggaaaaacaagcacttgaatatgaggctttagcgatcgatttattatccattgttaaacctaatcaacaaccattaaccaatattcaaggtggcacacattcttctgaaaaaggtttaatgtcattatcagaactaaaacatatatatgacccacaagaattaaaaacagatttacctgttgttttaatcacaattaataaaaactataaaaaattaaaacaacaaataaaatcaggcgaaattgataaatcgcaaattgaaaaagaaatttacgaacgcactcgcggctattggaaaacgggttcacgccgtgaaaaagccaaatatgctattgcagtttatcgtggctggacattagcagcctacgaaatttcatactggattgaagcacctattgagcgtcaaggtcgttggggttttatcggtaaacttgtgccgaaagattctccaatttatcaagaacttgttaataaattaacctattcatcaaataatgattacaaggcgccacaaaatccaataacttatcgtaattgt

SEQ ID NO: 3792 - protein, 257 aa, Haemophilus influenzae
  Name: NTH2113
MFSTAIIEKINYYIYCLVDPRNQNIFYIGKGIGNRVFQHAQGALTCKTNENDKISLINDIHKDGLEPLYYILRHNIKEEKQALEYEALAIDLLSIVKPNQQPLTNIQGGTHSSEKGLMSLSELKHIYDPQELKTDLPVVLITINKNYKKLKQQIKSGEIDKSQIEKEIYERTRGYWKTGSRREKAKYAIAVYRGWTLAAYEISYWIEAPIERQGRWGFIGKLVPKDSPIYQELVNKLTYSSNNDYKAPQNPITYRNC

SEQ ID NO: 3793 - DNA, 132 bp, Haemophilus influenzae
  Name: NTH2114
atgaacaaggccaatgtattacctcatgatgaatacaaactttttaaaaaagaatgtacaactaaacccgacaatgtttcacaagcctacaaaatgagaaattcatctaactatgtggaaactcccaaaaac

SEQ ID NO: 3794 - protein, 44 aa, Haemophilus influenzae
  Name: NTH2114
MNKANVLPHDEYKLFKKECTTKPDNVSQAYKMRNSSNYVETPKN

SEQ ID NO: 3795 - DNA, 474 bp, Haemophilus influenzae
  n 465, 466, 467, 468, 469: n is any nucleotide
  Name: NTH2115
ttgagagattttttaatgatcgattacattattattggcattatcgctttttccattcttgtcagcttattacgtggttttgtacgcgaagtactttcacttggtagctgggttgtggcatttatcgtagcaagccagttctatccttatcttgccacttatcttacgcaaattgaatcaatgtatgtgcgtaatggaactgcaatcgccattctgtttgttctgactttaatcgtgggcgcaatagtaaattatgtgattagtcaattagtagttaagccgggtttaagcggcactgatcgcgtattaggtgctgctttcggtttagtgcgcggtgcattgattgtggctgcgttgttattttttatggatacttttaccaattttgaacaaactgattggtggaaagaatctcaattaataccgcattttggttttattattgaatggtttcttcaacagctnnnnnttaat

SEQ ID NO: 3796 - protein, 158 aa, Haemophilus influenzae
  Xaa 156, 157: Xaa is any amino acid
  Name: NTH2115
LRDFLMIDYIIIGIIAFSILVSLLRGFVREVLSLGSWVVAFIVASQFYPYLATYLTQIESMYVRNGTAIAILFVLTLIVGAIVNYVISQLVVKPGLSGTDRVLGAAFGLVRGALIVAALLFFMDTFTNFEQTDWWKESQLIPHFGFIIEWFLQQLXXN

SEQ ID NO: 3797 - DNA, 345 bp, Haemophilus influenzae
  Name: NTH2116
atgaaagccacgagttttgcacaaaaatttatgccttttgttgctgtatttgcaatactgtggcaacagatttatgcaaaaaatgatttaatggcattttctatcgcaattttgaccgcactttttgccttgcttattccttttcaagggctttattggcttggtaagcgtgcaaattcgccattagaaaatcaaagtgcggtatggttttacgatatttgcgaacgcttaaaacaacaaaatgaacccttgccttttgtgcaagaaaaaccgacatatcaacatttagcggaagtcttaaggaaagctcaaagcaaatttgaacgtgctttttggcaggaaatt

SEQ ID NO: 3798 - protein, 115 aa, Haemophilus influenzae
  Name: NTH2116
MKATSFAQKFMPFVAVFAILWQQIYAKNDLMAFSIAILTALFALLIPFQGLYWLGKRANSPLENQSAVWFYDICERLKQQNEPLPFVQEKPTYQHLAEVLRKAQSKFERAFWQEI

SEQ ID NO: 3799 - DNA, 123 bp, Haemophilus influenzae
  Name: NTH2117
ttgtccctgtttaaaaatggaaaaaaacgccataaaaaacacctcaaaaaattgaccgcacttatcatacgctattttaagtctatttttagtaaaaatagtttaatttttcaaaaaatacga

SEQ ID NO: 3800 - protein, 41 aa, Haemophilus influenzae
  Name: NTH2117
LSLFKNGKKRHKKHLKKLTALIIRYFKSIFSKNSLIFQKIR

SEQ ID NO: 3801 - DNA, 1323 bp, Haemophilus influenzae
  Name: NTH2118
ttgtattttttccttaccgatgaatttattttattcatcaaaaggtgtatcctatacctaatttttcaaaccatcttaaatgatggatttctattaacctcaatcaaatatagggttcctatgtcaaaacttgttcttatccttaactgcggtagttcttcactaaaatttgcaattcttgatccagcaacaggggaagaaaaattatctggcttagccgaagcatttttcttaccagaagcacgtatcaaatggaaactcaatggagagaaaggtaacgcagatttaggcgcaggcgcagcgcatactgaagcgcttaattttattgcatctaacattctgactgatgaactaaaaaattctatcgcagcaattggtcaccgtatcgttcacggtggcgaaaaatacacccaatctgttatcgtaactgatgaagttgttaaaggtattgaagatgctgcacaatttgcgccacttcacaatccagctcacttaattggtattcgcgaagcatttaacgcattcccacacttaaaagataaaaacgtggtagtttttgatacagcattccaccaaactatgtctgaagaagcattcctttatgcccttccatactctttatataaagaacacggcgtacgtcgctatggtgcacacggcacaagtcactacttcatttctcgtgaagtcgctgaatatgtaggcaaacccgcagaccaagtcaatgctattatttgtcacttaggtaatggtggttctgtttctgttgtgcgtaacggtcaatgtatcgatacgtcaatgggtttaactccactagaaggtttggtaatgggtacgcgttgtggcgatattgaccctgcaatcgtattctatctatacaaaacactaggtatgtctatggaacaaatcgaagagactttagtgaaaaaatctggtcttttaggtttaactgaagtaaccagcgactgccgttatgctgaagataactacgataatgcatctaaaccagaagcaaaacgcgctttaaatgtttatagctatcgtttagcgaaatacattggtgcttatatggctgtgttgggcgatgatcacttagatgcgattgcattcactggtggtattggcgaaaactcagcgcacgttcgtgaattagcattgaatcacttaaaattatttggcattaaaattgataatgaacgaaatcttgccgcacgttttggtaaagatggcgtaatcacgactgatgattccgcatttaaagcgattgttcttccaactaacgaagaattggttatcgcacaagataccgcaagactttgtttc

SEQ ID NO: 3802 - protein, 441 aa, Haemophilus influenzae
  Name: NTH2118
LYFFLTDEFILFIKRCILYLIFQTILNDGFLLTSIKYRVPMSKLVLILNCGSSSLKFAILDPATGEEKLSGLAEAFFLPEARIKWKLNGEKGNADLGAGAAHTEALNFIASNILTDELKNSIAAIGHRIVHGGEKYTQSVIVTDEVVKGIEDAAQFAPLHNPAHLIGIREAFNAFPHLKDKNVVVFDTAFHQTMSEEAFLYALPYSLYKEHGVRRYGAHGTSHYFISREVAEYVGKPADQVNAIICHLGNGGSVSVVRNGQCIDTSMGLTPLEGLVMGTRCGDIDPAIVFYLYKTLGMSMEQIEETLVKKSGLLGLTEVTSDCRYAEDNYDNASKPEAKRALNVYSYRLAKYIGAYMAVLGDDHLDAIAFTGGIGENSAHVRELALNHLKLFGIKIDNERNLAARFGKDGVITTDDSAFKAIVLPTNEELVIAQDTARLCF

SEQ ID NO: 3803 - DNA, 993 bp, Haemophilus influenzae
  Name: NTH2119
atgtctcgcacgattattcttatccctgtaagtacaggcgtgggtttaactagcattagtcttggattaatccactctctcgaacaaaaaggcacaaaagttgcttttatgaaacccgtttctcaaccaagcactggcgaagataaattggatcgcacaacctctattattcgcactagcactagccttgaaactgccgaaccctttatgttaagcgtggcagaatcattaattggtcaaaatcagtctgacgtattgttagaaaaaattgtagctaaccaccaacaattaaccaaaaacaacgatatcgttgtggtggaaggtttaattccaacaagaaaacacggttatgcaaataatatcaactatgaaattgcacaagcattagatgcagaaatcgtattagttgcagcaccagcaactgaaaccccaaccgaattaaaagatcgtgtagaagcagcagcctctttatttggtggtaaaaacaatccaaatcttttaggcgtagttgtaaacaaattcaatgcacctgttgatgaatctggtcgtacacgccccgatcttgctgaaatctttgattcattccaacacaatcatattagcgaaacagaagtaaacaaattatttgcaggtagtgccatcaagttattagcttgtgtgccttggaatgcaaatttaatcgctacacgagcaatcgacttagtcaaacatttaggtgcatcaatcattaatgaaggggaaatcaatcgccgtattcgtggtatcactttctgcgcaagaagtttaccaaatatggttgagcatttccgtgcaggcagtttattagtcgcttcagcagatcgtccagatgtgcttgtagcagccgctctcgcagcgtcaaatggtattgaaatcggcggtattttattaacaggcggttataaaattgatgctcaaattaataaactttgccaacctacttttgaaaaagcaaaattgccgatcttccgtact

SEQ ID NO: 3804 - protein, 331 aa, Haemophilus influenzae
  Name: NTH2119
MSRTIILIPVSTGVGLTSISLGLIHSLEQKGTKVAFMKPVSQPSTGEDKLDRTTSIIRTSTSLETAEPFMLSVAESLIGQNQSDVLLEKIVANHQQLTKNNDIVVVEGLIPTRKHGYANNINYEIAQALDAEIVLVAAPATETPTELKDRVEAAASLFGGKNNPNLLGVVVNKFNAPVDESGRTRPDLAEIFDSFQHNHISETEVNKLFAGSAIKLLACVPWNANLIATRAIDLVKHLGASIINEGEINRRIRGITFCARSLPNMVEHFRAGSLLVASADRPDVLVAAALAASNGIEIGGILLTGGYKIDAQINKLCQPTFEKAKLPIFRT

SEQ ID NO: 3805 - DNA, 1209 bp, Haemophilus influenzae
  Name: NTH2120
ttgatgctcaaattaataaactttgccaacctacttttgaaaaagcaaaattgccgatcttccgtacttgaaggcaatacttggcaaacggcattaagtttacaaagctttaatcttgaagtgcctgttgatgacaaagaacgtattgagaatattaaacaatacattagccaacactttaatgctgactttatcaataatttagttgcagattctagccgtttacctcgcttatccccacctgcattccgtttccaattaactgaacttgctcgtgcggcgaaaaaacgtattgtgcttcctgaaggcgatgaacctcgtacaatcaaagcagccgtactttgcgcagaacgtggcattgcggaatgtgtgcttttagcagatcctgcatccgttcaacgtgttgcagaagcacaaggtgttaaattaggtaaaggcattacaatcattaacccagcagatgttcgagaaaactatgttgatcgtttagttgaattacgtaaagcgaaaggcatgaccgaaaccgcagcacgtgaacaattagaagataccgtagtgcttggtactatgatgttagaagcaaatgaagtagatggtttagtatctggtgccgttcacacgactgcaaacaccattcgcccaccaatgcagatcatcaaaactgcaccaggtagttcaatcgtttcttctatcttctttatgttattaccagatcaagtacttgtttacggtgactgtgcggtaaacccagatccaactgcagaacaacttgcggaaatcgcaattcaatctgcggattctgcgaaagcatttggtattgatccaaaagtcgcaatgatctcttactcaacaggtacatctggtagcggtgctgatgtggaaaaagtgaaagaagcaacccgtattgcgaaagaaaaacgccctgatttattaatcgatggcccattacaatacgatgcagctgtgatggaagacgtggctcgctctaaagcaccaaattcaccagtagcaggtaaagcaacagtattcgtattccctgacttaaatacgggtaacaccacttacaaagcagtacaacgttctgcagatttagtgtctattggcccaatgcttcaaggtatgcgtaaaccagtcaatgacttgtctcgcggtgccttagttgatgatattgtatacacaattgccttaaccgcaattcaagcaacacaa

SEQ ID NO: 3806 - protein, 403 aa, Haemophilus influenzae
  Name: NTH2120
LMLKLINFANLLLKKQNCRSSVLEGNTWQTALSLQSFNLEVPVDDKERIENIKQYISQHFNADFINNLVADSSRLPRLSPPAFRFQLTELARAAKKRIVLPEGDEPRTIKAAVLCAERGIAECVLLADPASVQRVAEAQGVKLGKGITIINPADVRENYVDRLVELRKAKGMTETAAREQLEDTVVLGTMMLEANEVDGLVSGAVHTTANTIRPPMQIIKTAPGSSIVSSIFFMLLPDQVLVYGDCAVNPDPTAEQLAEIAIQSADSAKAFGIDPKVAMISYSTGTSGSGADVEKVKEATRIAKEKRPDLLIDGPLQYDAAVMEDVARSKAPNSPVAGKATVFVFPDLNTGNTTYKAVQRSADLVSIGPMLQGMRKPVNDLSRGALVDDIVYTIALTAIQATQ

SEQ ID NO: 3807 - DNA, 501 bp, Haemophilus influenzae
  Name: NTH2121
atgcaagacgaatttgatttattccgtgcggaaaccaaaggcattaagccaatgaaacaagatacttttgttgcccctcaccaaaaacgtgatcagaaaaaaatagaattgaaagaattacgagcgaaagaagatacgttattttatttttctgatgaatatgagccgttactgaatgagcatgatggtgttgtgaaatatttacgtgatggggaagattcccatttattaaaacaacttcgtcgtggagatttttcgccagaattgtttttagatttacacggtttaacccgtgaacaagctaagcaagaattagccgcacttttactggcttgtgaaaatgagcatattgattgtgccagtatcatgacgggctatggcacctttacattgaaaaaacaaattccacgttggctagtacaacatcctaaagtgcgggcattgcatcaagcgccaagagaatggggcggtgaagccgcaattttgattttggttgatttg

SEQ ID NO: 3808 - protein, 167 aa, Haemophilus influenzae
  Name: NTH2121
MQDEFDLFRAETKGIKPMKQDTFVAPHQKRDQKKIELKELRAKEDTLFYFSDEYEPLLNEHDGVVKYLRDGEDSHLLKQLRRGDFSPELFLDLHGLTREQAKQELAALLLACENEHIDCASIMTGYGTFTLKKQIPRWLVQHPKVRALHQAPREWGGEAAILILVDL

SEQ ID NO: 3809 - DNA, 942 bp, Haemophilus influenzae
  Name: NTH2122
atggaaacttcacataaccaagaattagttgcaactatcttggaagataatgttgcaaacgaactgcaaaccatccaagattttctgcgttggacgtatagcattctcaatcgttctgatatttacttcgggcaagggcacgataatccttgggatgaaagcctgcaactcgttttaagtggcttacatttacccattgatttacctaccgaattatttaacagtcgattaaccccatctgaaaaagaaaccttagttcaacttgtattaacccgaatcgaacaacgcatacctgtggcatatttaacgaatagcgcttggttctgcggtcacgaattttatgtcgatgaacgaaccattattccacgttctccaattagtgctttaattcaagatcgctttgaagatttaatttcacaagaaccaaatcatattctcgatctatgcacaggcagcggttgtattgccattgcttgtgcttatgctttcccgaatgcggaagtagatgcggtagatttatcggttgatgcacttaatgtcgcagagatcaatatttcacgccatcaattagagcatcgtgtattcccgattcaatcaaacttatttgaaaatattttgggacagaaatacgatcttatcgtgaccaatccaccttatgtggatgaagaagatctcgccgatatgccagaagaattccattttgaaccagagttagccttaggttctggcagtgatggcttaaacattaccaaacaaattttgaaacaagcaccagattacttaaccgaaaatggcgtgttggtgtgtgaagtgggtaatagtatgattagcttaattgagcaatatccagatgtaccatttgaatgggtagaacttaaaaatggcggactaggcgtatttgctattcagcgtaaagatttagtgaaatatcacgatctgttt

SEQ ID NO: 3810 - protein, 314 aa, Haemophilus influenzae
  Name: NTH2122
METSHNQELVATILEDNVANELQTIQDFLRWTYSILNRSDIYFGQGHDNPWDESLQLVLSGLHLPIDLPTELFNSRLTPSEKETLVQLVLTRIEQRIPVAYLTNSAWFCGHEFYVDERTIIPRSPISALIQDRFEDLISQEPNHILDLCTGSGCIAIACAYAFPNAEVDAVDLSVDALNVAEINISRHQLEHRVFPIQSNLFENILGQKYDLIVTNPPYVDEEDLADMPEEFHFEPELALGSGSDGLNITKQILKQAPDYLTENGVLVCEVGNSMISLIEQYPDVPFEWVELKNGGLGVFAIQRKDLVKYHDLF

SEQ ID NO: 3811 - DNA, 969 bp, Haemophilus influenzae
  Name: NTH2123
atgaaaatgcatcaattgcgttatatcgttgagattgtaaaccaaaatttgaatgtcacagaagcggcaaatgcactttacacatcacagccgggtatcagtaaacaagttcgcctattagaagatgaattaggtctggaaatttttgagcgtcatggcaagcatataaaatcaattacaccagcagggaaaaagattatctcaattgcacgcgagttacttgttaaagcgcaaggtatccgtgccgttgccgatgaatatactcggccaaatcacggtgtattacgtattgcgacgacaaatactcaggcacgttatatgctgccaagcgtgattgaacgtttttctaaaaaatatcctgatgtgagcttgcatattcatcaaggttcgccaacacaaattcacgatgctttaatgtcaggtgaagtggatttggcaattaccactgaagcaccttatttatttgatgatttagttcagattccatgctattggtggaatcgtgccgtgattgtttcgccagaacatccgcttgccaaagtgaaagaactgaccattgaggaattaggcaaatacccacttgtgacttacacgtttggttttacgggtgtttctgatttagattacgcatttaatagtgcaggcattttaccaaatatagtttttacggctaccgatgctgatgttattaaaacttatgtgcgcttgggtttaggggtgggcattatggcatctatggcgcatacggcattagatgcggatcttgtgctaattgatgcaagccatttgttccgcccgagtatgacgaatattgcatttaaacatagcacgttcttacgtaattatatgtacgattttatggaatatttttcaccgcacttaattcgtagtgtcgtagaaaaagccgagcgtttgcgtgataacaattcagtgaaaaaattatttgaaggcattgaattggaaacaaga

SEQ ID NO: 3812 - protein, 323 aa, Haemophilus influenzae
  Name: NTH2123
MKMHQLRYIVEIVNQNLNVTEAANALYTSQPGISKQVRLLEDELGLEIFERHGKHIKSITPAGKKIISIARELLVKAQGIRAVADEYTRPNHGVLRIATTNTQARYMLPSVIERFSKKYPDVSLHIHQGSPTQIHDALMSGEVDLAITTEAPYLFDDLVQIPCYWWNRAVIVSPEHPLAKVKELTIEELGKYPLVTYTFGFTGVSDLDYAFNSAGILPNIVFTATDADVIKTYVRLGLGVGIMASMAHTALDADLVLIDASHLFRPSMTNIAFKHSTFLRNYMYDFMEYFSPHLIRSVVEKAERLRDNNSVKKLFEGIELETR

SEQ ID NO: 3813 - DNA, 213 bp, Haemophilus influenzae
  Name: NTH2124
atgttaagtggcgtagatagcctttattcaattgtgcaaatgccaaaaggaatcccagtcggaacattggctattggccctgcgggtgcggcaaatgctggattgttagccgcacaaattctagcaagttgggatgcagaattgctttcacgcttgcaatctttccgtgaaagccaaacgagtaatgtgcttgataatcccgatccacgcaca

SEQ ID NO: 3814 - protein, 71 aa, Haemophilus influenzae
  Name: NTH2124
MLSGVDSLYSIVQMPKGIPVGTLAIGPAGAANAGLLAAQILASWDAELLSRLQSFRESQTSNVLDNPDPRT

SEQ ID NO: 3815 - DNA, 1086 bp, Haemophilus influenzae
  Name: NTH2126
atgcaaaactccaccttatacccaacggtttatgtacttggcaacggacaactcggcagaatgttaggttacgctggtgcacctttagatatttatgttgaacccttagccttcaatgcgccagtttttgacttacctgaaaatgcgatcatcacggcagaaattgaacgctgggaaaaaacacctttgactgaattactcggcaatcataaaaacttcgttaatcaacatgtatttggattattagccgatcgttttgctcaaaaatccttgcttgatgaactcaatctttctacctcgccttggtgtttattaaaagataaaacgcaatggaatgatgttttccaaactgttggcgagaaagtcgtcgtcaaacgtagaacaggcggatatgatgggcgtggtcaatggattatcagcgatgaaaacaaagcggacatcactgatgacttatttggtgaagtgatcgcagaaaaatttattccttttgattatgaagtttctattgtaggcgcaagatttaaaaatggcgaaaagcgtttttatcccgttacgcataacctgcaacaaaatggtattttgcgttacagtgtgattgataatgcatttcctcaacaatccgcacaacaaaaacaagctgaaacaatgctcggcaaaattatggataagttaggctatgtgggtgtgatggcaatggaatgttttgttgtaggcgacaaattactaattaacgaacttgcgcctcgcgtacataacagtggacattggacacaactgggatgtgctattagtcaatttgaattacatttacgcacgctacttgatttgccaacacctgacttacaaatttttgccccaagtgtaatggtaaatttaatcggcacaaaccataatccaaaatggcttaatataccttttgcacaacttcattggtacggtaaagaagtgagggctgggcgtaaggttgggcatatcaatctttctcatcctaataaagcggtcattattcaacaattagaaaagctccgaattgaattacccgaagattatcaatcaggattaaattgggcgattgaaaaactaaaa

SEQ ID NO: 3816 - protein, 362 aa, Haemophilus influenzae
  Name: NTH2126
MQNSTLYPTVYVLGNGQLGRMLGYAGAPLDIYVEPLAFNAPVFDLPENAIITAEIERWEKTPLTELLGNHKNFVNQHVFGLLADRFAQKSLLDELNLSTSPWCLLKDKTQWNDVFQTVGEKVVVKRRTGGYDGRGQWIISDENKADITDDLFGEVIAEKFIPFDYEVSIVGARFKNGEKRFYPVTHNLQQNGILRYSVIDNAFPQQSAQQKQAETMLGKIMDKLGYVGVMAMECFVVGDKLLINELAPRVHNSGHWTQLGCAISQFELHLRTLLDLPTPDLQIFAPSVMVNLIGTNHNPKWLNIPFAQLHWYGKEVRAGRKVGHINLSHPNKAVIIQQLEKLRIELPEDYQSGLNWAIEKLK

SEQ ID NO: 3817 - DNA, 1188 bp, Haemophilus influenzae
  Name: NTH2127
atgtttgaacatattaaagcggcaccagccgatccaatcttaggcttaggcgaagcattcaaatccgaaactcgcgaaaataaaattaacttgggtattggcgtttataaagatgcgcaaggcacaaccccgattatgcgtgcagtgaaagaagcagaaaaacgcttatttgataaggaaaaaacgaaaaattatctgactatcgatggtattgctgattataacgaacaaacaaaagcgttacttttcggtaaagattctgaagtcatcaaatctaatcgtgcaagaacagtacaaagtttaggcggaacaggcgcattacgcattgcggcagaatttattaaacgtcaaactaaagcacaaaatgtttggatcagcaccccaacttggccaaaccacaatgccattttcaatgccgtcggtatgacaattcgtgaatatcgttattatgatgctgaacgcaaagcccttgattgggatcatttacttgaagatttaagccaagcaagcgaaggcgatgtggtgcttttacacggttgttgccataatccgactggtattgaccctactccagaacaatggcaagaattagccgcactttcggcgaaaaacggctggttgccactctttgactttgcttatcaaggtttagccaatggattagatgaagatgcttatggcttgcgtgcttttgcggcaaaccacaaagaattgttagtagcgagttcattctcgaaaaactttggtttatataatgaacgtgttggtgcctttactcttgtggcagaaaatgcagaaattgcatcaaccgcattaacccaagtgaaatcaattattcgtacactctactctaaccctgcatctcacggcggcgcaactgtagcaacagtattaaatgacactcaacttcgccaagagtgggaaaatgaattaactgaaatgcgcgaacgtatcaaaaaaatgcgtcatttattcgttcagttattaaaagaatacggtgcggaacaagatttcagctttatcattgaacaaaacggtatgttctctttcagtggattaactggggaacaagtggatcgcttaaaagaagaatttgccatttatgctgttcgttctggtcgtatcaatgtggctggtattactgaagataatattcgctatttatgtgaaagcattgtgaaagtgctt

SEQ ID NO: 3818 - protein, 396 aa, Haemophilus influenzae
  Name: NTH2127
MFEHIKAAPADPILGLGEAFKSETRENKINLGIGVYKDAQGTTPIMRAVKEAEKRLFDKEKTKNYLTIDGIADYNEQTKALLFGKDSEVIKSNRARTVQSLGGTGALRIAAEFIKRQTKAQNVWISTPTWPNHNAIFNAVGMTIREYRYYDAERKALDWDHLLEDLSQASEGDVVLLHGCCHNPTGIDPTPEQWQELAALSAKNGWLPLFDFAYQGLANGLDEDAYGLRAFAANHKELLVASSFSKNFGLYNERVGAFTLVAENAEIASTALTQVKSIIRTLYSNPASHGGATVATVLNDTQLRQEWENELTEMRERIKKMRHLFVQLLKEYGAEQDFSFIIEQNGMFSFSGLTGEQVDRLKEEFAIYAVRSGRINVAGITEDNIRYLCESIVKVL

SEQ ID NO: 3819 - DNA, 660 bp, Haemophilus influenzae
  Name: NTH2128
gtggttttcagtttggcaaaaagagagaaaaataatatgttagctgtaaataatctttgtatagaacgcaatggtagagcgattattcaagatttgagttttaccttggaaggtcaaaaacgcctcttcgtacaaggggaaattggttcaggaaaaaccactttactgcttgctttgttgggatttgttcctgtaaccaaaggggaaattaaattatttggcaaagtttgtcgtgaagaaaaagattttgcgccctttcgtggcacgattggtatttgttttcaaaatgccgatgatcaactttttggcccaacagtgttggatgatgttgccttcgggccattaaaccaaaatatgcccagagagcaggcgtatcatatcgcagagcagcaattagaacgtcttggtatcacaggtttaaaagatcgtatggtgcataccctatctggtggtgagaaaaatttcacggcacttgctggtgtcttagcgatgcagccaaaaattttattattagatgaacccaccaatggattagatcgaaaaaatactgaaaaattgaccgcacttttgcgtgagctttccttacccatgttgatttcatcccatcatcatggatttattaacgaattagccacagaaattattagatttaccaacaaa

SEQ ID NO: 3820 - protein, 220 aa, Haemophilus influenzae
  Name: NTH2128
VVFSLAKREKNNMLAVNNLCIERNGRAIIQDLSFTLEGQKRLFVQGEIGSGKTTLLLALLGFVPVTKGEIKLFGKVCREEKDFAPFRGTIGICFQNADDQLFGPTVLDDVAFGPLNQNMPREQAYHIAEQQLERLGITGLKDRMVHTLSGGEKNFTALAGVLAMQPKILLLDEPTNGLDRKNTEKLTALLRELSLPMLISSHHHGFINELATEIIRFTNK

SEQ ID NO: 3821 - DNA, 555 bp, Haemophilus influenzae
  Name: NTH2129
ttgagtgatcttacttggcttatctcccttaatgtgcttgcagtttctctcttttttatttcactgcagctcagtcaaaaatcttttttgccttatcttaaacgttggtttgctttagtcatttttattgctttaatgtgggcggcattaagttggcaaattggagaaaatggcattgaactcaattttcaaggcattgaattagcagaaaaattgagtttgcggactcatttattgttgatttctctttggctttttttgtggaatattaatgatgcagtacttgttcaagccattggtaaattgcctttgccagaaaaattaattcaactttttgtgctgaccgtacgttacattgcactgcttggcgaactgcgtcaaaaaatggatattgccatgcgagctcgtggatttcgtcctgggcttaatcgccgaaccctttatgtgacggctcaaagtgtcgctttattattgatccatgccctattaaaagccgaaacggcgcaaatggcgttaaaatgtcgtggttttcagtttggcaaaaagagagaaaaa

SEQ ID NO: 3822 - protein, 185 aa, Haemophilus influenzae
  Name: NTH2129
LSDLTWLISLNVLAVSLFFISLQLSQKSFLPYLKRWFALVIFIALMWAALSWQIGENGIELNFQGIELAEKLSLRTHLLLISLWLFLWNINDAVLVQAIGKLPLPEKLIQLFVLTVRYIALLGELRQKMDIAMRARGFRPGLNRRTLYVTAQSVALLLIHALLKAETAQMALKCRGFQFGKKREK

SEQ ID NO: 3823 - DNA, 618 bp, Haemophilus influenzae
  Name: NTH2130
atgcatttatctgaaggcgtgttacatacgcctattttattagctggtgcagtgcttgctgttgcgggcattgctgtgggggtacgtcgtttagaatcagaacgtttaccgctcaccgcactttttgccgctgcattttttgtggcaggaaccattcatgtgcctgtaggaattggtagcgtgcatttaattttaaatggcatggctggtttatttcttgggtgggccgtttttccagcattcctcatcgcacttttattgcaagtcattttcttttcttttggtggatttgccgtgttaggtgtcaatctttgcgtgatggcaataccagctgtgatcgcttattatcttttccgttctcgtttacagccacaaatggcattaaaagatcgcttattagtcggtattggtgctggcgtaattggcgttggcggagcaggcgtgcttgcttcttttgtgctgatgttagatggtgggaaaagttatctgaatcttgtttggctcttgctagtctctcatattccagtatttgttttggatagtattatcagcgtaggggtgattaccttgcttggtaaaatgtatcctgaagtcatgaatcgtaccgagaatttctct

SEQ ID NO: 3824 - protein, 206 aa, Haemophilus influenzae
  Name: NTH2130
MHLSEGVLHTPILLAGAVLAVAGIAVGVRRLESERLPLTALFAAAFFVAGTIHVPVGIGSVHLILNGMAGLFLGWAVFPAFLIALLLQVIFFSFGGFAVLGVNLCVMAIPAVIAYYLFRSRLQPQMALKDRLLVGIGAGVIGVGGAGVLASFVLMLDGGKSYLNLVWLLLVSHIPVFVLDSIISVGVITLLGKMYPEVMNRTENFS

SEQ ID NO: 3825 - DNA, 486 bp, Haemophilus influenzae
  Name: NTH2131
atgaaaaaatttgcttttttaaccgcactttttgcggcttgctatctcccgaatgcttatgcccacgcgctttatgtgtttgcccaatatgatgggcaaacactttctggcaaatcctattattctgatatgaccccagcagctgaaacttatttagaagttttccgctcaggtgtttctgatcccgttttaactggaaaaacagaccgccaaggtgcatttaagctttctattgctgatgtaccacatacaaccttaaaagttgtggtggaaggcgatgaaggacaccgtgcgtccgttgttgctgctgctcatacgtctgccgaaaatcaaagcagtgcagatttaatgctgcttcgtgaagatattgcgcatttaaaagataaaatttatttgcatgatattttaggtggaatcggttatatcgttggtattgctggacttattgctttacgtaatgcgcgtaaaattaaacaaggacgtatt

SEQ ID NO: 3826 - protein, 162 aa, Haemophilus influenzae
  Name: NTH2131
MKKFAFLTALFAACYLPNAYAHALYVFAQYDGQTLSGKSYYSDMTPAAETYLEVFRSGVSDPVLTGKTDRQGAFKLSIADVPHTTLKVVVEGDEGHRASVVAAAHTSAENQSSADLMLLREDIAHLKDKIYLHDILGGIGYIVGIAGLIALRNARKIKQGRI

SEQ ID NO: 3827 - DNA, 303 bp, Haemophilus influenzae
  Name: NTH2132
ttgaaatgggatgctgaatctttcaaatctcatcaacaagcatacgaattgattcctcaagaaaaagcacaagcgaataaaccactttctatccttgttttacataatggtaaaccagttcaaggcattaaagtgggtgtgagtgaagatgcaccgttcaatttaactaatgaaaaaggtatcgctcaatttaccccaactaaaggcttcaacaaagtatgggcagagtttgaggaaaaagtaacaaataatgcagattacgatcgtcgaactgtggaatatatgctaacttttgatgcgcaa

SEQ ID NO: 3828 - protein, 101 aa, Haemophilus influenzae
  Name: NTH2132
LKWDAESFKSHQQAYELIPQEKAQANKPLSILVLHNGKPVQGIKVGVSEDAPFNLTNEKGIAQFTPTKGFNKVWAEFEEKVTNNADYDRRTVEYMLTFDAQ

SEQ ID NO: 3829 - DNA, 249 bp, Haemophilus influenzae
  Name: NTH2133
atggaattgaaaaaaatcgctgtaggattaaccgcacttttaggtatgtctgttgctaacgcacataatgtttggcttgagcctgcttcatcgcaagatgaataccgagtgaaatttggacatgaacaaactgaaacctcaccagaatctaaacttaaatctctccaagccttaaatgcgcaaggcaaattaactgctgttgattccaattcagaaatggcgaagcctaatctttgcctaaatcagaat

SEQ ID NO: 3830 - protein, 83 aa, Haemophilus influenzae
  Name: NTH2133
MELKKIAVGLTALLGMSVANAHNVWLEPASSQDEYRVKFGHEQTETSPESKLKSLQALNAQGKLTAVDSNSEMAKPNLCLNQN

SEQ ID NO: 3831 - DNA, 456 bp, Haemophilus influenzae
  Name: NTH2134
atgataaaatatgaagtaactttagaatcaagtcattttttaaggaaattgatgaaaattggagcacttgctaaagccctaggctgtaccgtagaaaccatccgttattatgaacaacaaggtttaatcccgcccccaaaacgtactttaggcaattttcggcaatataatgaagaacacttgcaacgtttatcatttatttgtaactgccgaaatttagatatttcattaagtgaaataaaaagcctactgaatttagaaaatgcctccaaacaacaagcagaagaaattaatcgtgtgttagataaacacattaaagaggtggcaacaaggattcacgaactcgcccatttacggatgaaattaattgaattacgtgaaaaaacagtctcgaatgatgaagatccaatgaaattgctattgcaacatagtggcgtgaaatttgtgcgattaaaa

SEQ ID NO: 3832 - protein, 152 aa, Haemophilus influenzae
  Name: NTH2134
MIKYEVTLESSHFLRKLMKIGALAKALGCTVETIRYYEQQGLIPPPKRTLGNFRQYNEEHLQRLSFICNCRNLDISLSEIKSLLNLENASKQQAEEINRVLDKHIKEVATRIHELAHLRMKLIELREKTVSNDEDPMKLLLQHSGVKFVRLK

SEQ ID NO: 3833 - DNA, 540 bp, Haemophilus influenzae
  Name: NTH2135
atgaaactgaagttattttttcatatagtattactttgttttagtttgcctgtttgggcgatgaaaaccattgatattacagcgaattcgaaaatggatgatcaagcaagaatgaatttggcgcaagagtttgccaataaacagcaatggagctctgttttcgatatcatgtatccgatggcgttagagggaaacaccactgctcaaagcaatctaggtatgttatataaccttgggcgtggcacggtgagagactatgaaaaggcttattggtggtttagcgaagcggcagagaagggtagtgtgaaagggctaaataaccttggcgttatgtatctacgtggcgattacgtcaaacaaaatacagagcaagccattaagctttttgaacgtacagctcgagctaaagatacggatgcgatgatgatgttaagtaatatttatcgcttacaaaaccaacctgaaaaatcattggaatggctgaaaaaagcagctgaattaggcaataaggaagcaaaacagcgtttatctagtcagcca

SEQ ID NO: 3834 - protein, 180 aa, Haemophilus influenzae
  Name: NTH2135
MKLKLFFHIVLLCFSLPVWAMKTIDITANSKMDDQARMNLAQEFANKQQWSSVFDIMYPMALEGNTTAQSNLGMLYNLGRGTVRDYEKAYWWFSEAAEKGSVKGLNNLGVMYLRGDYVKQNTEQAIKLFERTARAKDTDAMMMLSNIYRLQNQPEKSLEWLKKAAELGNKEAKQRLSSQP

SEQ ID NO: 3835 - DNA, 714 bp, Haemophilus influenzae
  Name: NTH2136
atgaaactgcttatctctaatcagcacggtgctattgttatggcactactgccttttatttatggtatgttgcttgctaatccagtatgggcgcacatgtttttattattaggatggttttcgctttatttgatgacttatccttttttgaatttgtttaaaggtaaaaatcttgagttatataaaaaatggtctgtgatttattttgctgccgccgtgatttttgcgattcccgcgttaatttataattggcaggtgttgtattttatgtttgccatgttaccgtttgttgcggtgaatatttatttcaccaagaaaaaagatgagcgcaatttatggaatgacttggcagggatcttaatttttgccctagctggaatgggatcctattacttttctgaccgcacttttgatgaaaaaatactttgggtggcgatttatccaacattattttttattggaacaacactttatgtaaaatcaatgatgcgtgaacgaaaaaatccacgttatttttgggcatcagtgatttttcacttattatgtgtgctgatttttgtggtttcgcaacaatttattttagcattagcttttgtgcctggattagtgcgagcggtttatctgcccactaaaaagctttctgttatgcaagttggactaacagaatttgcgattactgccgtattttttattttacttttagtagcaaccttg

SEQ ID NO: 3836 - protein, 238 aa, Haemophilus influenzae
  Name: NTH2136
MKLLISNQHGAIVMALLPFIYGMLLANPVWAHMFLLLGWFSLYLMTYPFLNLFKGKNLELYKKWSVIYFAAAVIFAIPALIYNWQVLYFMFAMLPFVAVNIYFTKKKDERNLWNDLAGILIFALAGMGSYYFSDRTFDEKILWVAIYPTLFFIGTTLYVKSMMRERKNPRYFWASVIFHLLCVLIFVVSQQFILALAFVPGLVRAVYLPTKKLSVMQVGLTEFAITAVFFILLLVATL

SEQ ID NO: 3837 - DNA, 132 bp, Haemophilus influenzae
  n 124: n is any nucleotide
  Name: NTH2137
atgacaattcaacgcattttacccaatgcacgtttaagtgaagtttcaattcataacaacctcgcctattttgcagggcaagttccagaattaaccatcgagcaaaatacctacgaacaacccnagaagtat

SEQ ID NO: 3838 - protein, 44 aa, Haemophilus influenzae
  Xaa 42: Xaa is any amino acid
  Name: NTH2137
MTIQRILPNARLSEVSIHNNLAYFAGQVPELTIEQNTYEQPXKY

SEQ ID NO: 3839 - DNA, 1680 bp, Haemophilus influenzae
  Name: NTH2138
ttgaaggatagtatgaagttatttttaacccaatcagctaatgtaggcgatgcgaaagcctatttattacatgaagtttttcgagcagctgcacaaaaagcaaatgtctctattgtagaaacaccagccgaagcagatcttgttcttgtatttggttctgtattaccaaataaccctgcgttagttggtaaaaaagtctttattatcggcgaagctatcgccatgatttctcctgaagtaacattggcaaatgccttagcgaatggggctgattatgttgcaccgaaaagtgcggtgagttttacaggtgtttctggtgtaaaaaatattgttgcggtaacggcttgtccaactggcgttgcacatacgtttatgtcagccgaagcgattgaagcctatgcgaaaaaacaaggttggaatgtaaaagttgaaacccgtggtcaagttggggctggcaatgaaattactgcagaagaagtcgcggcggctgatttggtatttgttgcagcagatattgacgtgcctttagataaatttaaaggtaaaccaatataccgcacttcaacaggattagccttgaagaaaactgagcaagaatttgataaggcatttaaagaagccaaaatttttgatggtggaaataatgcgggaacgaaagaagaaagccgtgagaaaaaaggtgtgtacaaacacttaatgactggtgtttctcatatgttaccgttagtggttgctggtggattgttgatcgcgatttcctttatgttcagttttaatgtaattgaaaatacaggagtttttcaagatcttcctaatatgttgattaatatcggtagtggtgtggcgttcaagttaatgattgccgtgtttgctggttacgttgcattttctatcgctgatcgtccaggacttgcagttggtttgattgcagggatgctggcaagtgaagcgggtgcagggattcttggcggtattattgcaggtttcttagccggctatgtggtgaaagggctaaatgtgattattcgattgccagcaagcctgacttcattaaaaccgattttaattttaccgctcttgggttcgatgattgttggtttgacgatgatttacctcatcaatccaccagtggctgaaattatgaaagagctaagtaattggcttacttcaatgggcgaagtgaatgcgattgtgttaggcgtaattatcggcgcaatgatgtgtatcgatatgggcggaccagtaaataaagcagcgtacactttttctgttggattgattgcctcccaagtttatacaccaatggctgcggcaatggccgcaggtatggttcctccaattggtatgacagttgcgacttggattgctcgcaataaatttaccgttagccaacgcgatgcggggaaagcatcatttgttcttggtttatgttttatttctgaaggtgcattaccatttgtggcagcagatccaattcgagtcattattagctctgtgattggtggtgcggtggctggtgcgatttcaatgggattaaatattaccttacaagctccgcacggcggattatttgtcattccatttgtatctgagccgttgaaatatcttggtgcaattgcgattggtgctttatcaacaggtgtggtttacgccattattaaatcgaaaaacaatgcggaa

SEQ ID NO: 3840 - protein, 560 aa, Haemophilus influenzae
  Name: NTH2138
LKDSMKLFLTQSANVGDAKAYLLHEVFRAAAQKANVSIVETPAEADLVLVFGSVLPNNPALVGKKVFIIGEAIAMISPEVTLANALANGADYVAPKSAVSFTGVSGVKNIVAVTACPTGVAHTFMSAEAIEAYAKKQGWNVKVETRGQVGAGNEITAEEVAAADLVFVAADIDVPLDKFKGKPIYRTSTGLALKKTEQEFDKAFKEAKIFDGGNNAGTKEESREKKGVYKHLMTGVSHMLPLVVAGGLLIAISFMFSFNVIENTGVFQDLPNMLINIGSGVAFKLMIAVFAGYVAFSIADRPGLAVGLIAGMLASEAGAGILGGIIAGFLAGYVVKGLNVIIRLPASLTSLKPILILPLLGSMIVGLTMIYLINPPVAEIMKELSNWLTSMGEVNAIVLGVIIGAMMCIDMGGPVNKAAYTFSVGLIASQVYTPMAAAMAAGMVPPIGMTVATWIARNKFTVSQRDAGKASFVLGLCFISEGALPFVAADPIRVIISSVIGGAVAGAISMGLNITLQAPHGGLFVIPFVSEPLKYLGAIAIGALSTGVVYAIIKSKNNAE

SEQ ID NO: 3841 - DNA, 939 bp, Haemophilus influenzae
  Name: NTH2139
atggcaagcgtcgtaaccattaccttaaatgccgcctatgatttagttgggcgtttaaatcgtattcaacttggcgaagtaaatacggtagaaacattgggcttattccctgctggaaaaggcattaatgtcgcaaaagtactaaaagatttaggcgttaatgttgcagtaggcggtttcttgggcaaggataattcagctgatttcgagcaaatgtttaatcagcacggtttgaaagataaattccaccgtgttaatggcaaaacacgtatcaatgtaaaaattaccgagactgaagcggatgtgacagatttaaatttcttgggatatcaaataagcccacaaatttggcaacaatttgtgacggattctttggcttattgtttagattatgacattgtcgcagtttgtggcagtttacctcgaggtgtgtctcctgaattgtttgctgattggttaaatcagcttcatcaagctggcgttaaagtggtgcttgatagtagcaatgctgcgcttaccgctggattaaaagcgaaaccttggctagtaaaacccaatcatcgagaacttgaggcttgggttggtcattcattaaatagtcttgaagaaattattgccgctgcacagcaactcaaagcggaaggcattgaaaacgtgattatttcaatgggcgcaaaaggttctttatggattaataatgaaggcgtgcttaaagccgaaccagcaaaatgtgaaaatgtcgtgagtaccgttggagcaggggattcaatggtagcaggcttaatctatggttttgaaaaaggtttatcgaaaacagaaaccttagcttttgctacggctgtgtccgcttttgcggtatctcagagtaacgtcggtgtgagtgatttgagtttacttgaccccattttagaaaaagtacaaataacgatgattgaagga

SEQ ID NO: 3842 - protein, 313 aa, Haemophilus influenzae
  Name: NTH2139
MASVVTITLNAAYDLVGRLNRIQLGEVNTVETLGLFPAGKGINVAKVLKDLGVNVAVGGFLGKDNSADFEQMFNQHGLKDKFHRVNGKTRINVKITETEADVTDLNFLGYQISPQIWQQFVTDSLAYCLDYDIVAVCGSLPRGVSPELFADWLNQLHQAGVKVVLDSSNAALTAGLKAKPWLVKPNHRELEAWVGHSLNSLEEIIAAAQQLKAEGIENVIISMGAKGSLWINNEGVLKAEPAKCENVVSTVGAGDSMVAGLIYGFEKGLSKTETLAFATAVSAFAVSQSNVGVSDLSLLDPILEKVQITMIEG

SEQ ID NO: 3843 - DNA, 1497 bp, Haemophilus influenzae
  Name: NTH2140
atgttagaactttcggaaagcaacattcatttaaatgctaatgcaattgataaacaacaagcgatcgaaatggcagcgtccgcattggttcaagcaggcaatgttgaaaatggttacttgcaaggaatgttagcgcgcgagctgcaaacctcaacctttttaggcaatggcatcgctattcctcatggcaccttggatactcgtttgatggtaaagaaaacgggcgtgcaagtgtttcaatttcctcaaggcatagaatggggcgaaggaaatattgcttatgtcgtgattggtattgcggcgcgatctgatgagcatttgtccttattacgccaactaacccatgtattgagcgatgaagatactgcagcaaaattagcaaaaataactgatgtggctgaattttgcgcgattttaatgggcgagacaattgatccatttgaaattcctgctgccaatatcagtttagatgtaaatacccaaagtttattaactttagttgcgattaatgcggggcaattacaggtgcaaagtgcggtagaaaatcgctttatttctgaagtgataaataatgcggcattaccacttggcaaagggttatgggtaacggactctgtcgtaggaaatgtgaaaaatgccttagcatttagtcgtgccaaaacgatttttagccacaatggcaaggccgtaaaaggcgtgataaccgtttcagccgtcggtgatcaaattaatccaactttggcgcgtttattagatgacgatgtccaaacaaccttgctcaatggaaattcaacagaaattttgaccgcacttttgggttcatcgagtgatgttgaaactcaatctgtagaaggtgctgttgtaggaacctttacgattcgtaatgaacacggcttacatgcacgcccaagtgcaaatttggttaatgaagtgaaaaaattcacttctaaaataaccatgcaaaatcttactcgtgaaagtgaagtcgtcagcgcaaaaagtttgatgaagattgttgcgcttggtgtaacacaaggacatcgtttacgttttgtggcagagggggaagatgcaaaacaagcaattgaatcattgggcaaagcgatagccaatggcttgggcgagaatgtttcggtagtgccaccgtctgaacccgataccattgagattatgggcgatcaaattcacacacctgcggtaacagaagatgataatttgccggcaaatgccattgaagccgtatttgtgattaaaaacgagcaaggtttgcatgctcgtccaagtgcaatattggtaaatgaagtgaagaaatataatgcttccgtagcagttcaaaaccttgatcgtaattctcaattagtcagtgctaaaagtttgatgaaaattgtagcattaggcgtagtcaaagggactcgtttacgttttgttgcgacgggcgaagaagcgcaacaagctattgacggaatcagcgctgtgatcgaatcgggtttaggggaa

SEQ ID NO: 3844 - protein, 499 aa, Haemophilus influenzae
  Name: NTH2140
MLELSESNIHLNANAIDKQQAIEMAASALVQAGNVENGYLQGMLARELQTSTFLGNGIAIPHGTLDTRLMVKKTGVQVFQFPQGIEWGEGNIAYVVIGIAARSDEHLSLLRQLTHVLSDEDTAAKLAKITDVAEFCAILMGETIDPFEIPAANISLDVNTQSLLTLVAINAGQLQVQSAVENRFISEVINNAALPLGKGLWVTDSVVGNVKNALAFSRAKTIFSHNGKAVKGVITVSAVGDQINPTLARLLDDDVQTTLLNGNSTEILTALLGSSSDVETQSVEGAVVGTFTIRNEHGLHARPSANLVNEVKKFTSKITMQNLTRESEVVSAKSLMKIVALGVTQGHRLRFVAEGEDAKQAIESLGKAIANGLGENVSVVPPSEPDTIEIMGDQIHTPAVTEDDNLPANAIEAVFVIKNEQGLHARPSAILVNEVKKYNASVAVQNLDRNSQLVSAKSLMKIVALGVVKGTRLRFVATGEEAQQAIDGISAVIESGLGE

SEQ ID NO: 3845 - DNA, 264 bp, Haemophilus influenzae
  Name: NTH2141
gtgaaacaaattcaggataaactttacactggcggccatgattctgatgtatatgcctattatagcggcgtgttacatgcggaagcattgcaagcgaaccttaaacgtttgagcgcaaattgttgggaaaaagtggattcgcaaagtatggctcaaggtatttatgatgcgatgcgtgatttacaaaaaggcgaagcgcgcggagaaaatgatgaatatattgtgcaaggtagtgaagcgctgctgaaagcctgtacatctaaa

SEQ ID NO: 3846 - protein, 88 aa, Haemophilus influenzae
  Name: NTH2141
VKQIQDKLYTGGHDSDVYAYYSGVLHAEALQANLKRLSANCWEKVDSQSMAQGIYDAMRDLQKGEARGENDEYIVQGSEALLKACTSK

SEQ ID NO: 3847 - DNA, 201 bp, Haemophilus influenzae
  Name: NTH2142
atgactatgtttaaaaaaatctctgttttattttttacgttaatattggcaggttgttcttcttggtcatcggttactaaccatattccatttatggggaacgataaaaaagtgattgatttagataaagataaaatcgatcaaaaatcttatgcagctgcttatgaagcgactgtggcgacatataaaggtcgcgtggaa

SEQ ID NO: 3848 - protein, 67 aa, Haemophilus influenzae
  Name: NTH2142
MTMFKKISVLFFTLILAGCSSWSSVTNHIPFMGNDKKVIDLDKDKIDQKSYAAAYEATVATYKGRVE

SEQ ID NO: 3849 - DNA, 276 bp, Haemophilus influenzae
  Name: NTH2143
atgtacgcgattgcttttgatttagttgtaaaagacactcaagattatcatccaaagggcgttcaagaggcttatacagacattggcgcagttttagcaaaatttggttttgttagaacacaaggaagtttatataccaacatgaatgaagatatggcgaatctctttcaggcaatgaatgcactaaaacagttggcgtggatttctcagtcggtacgagatattcgcgcttttcgtattgagcaatggtctgattttactgattttatacgaaat

SEQ ID NO: 3850 - protein, 92 aa, Haemophilus influenzae
  Name: NTH2143
MYAIAFDLVVKDTQDYHPKGVQEAYTDIGAVLAKFGFVRTQGSLYTNMNEDMANLFQAMNALKQLAWISQSVRDIRAFRIEQWSDFTDFIRN

SEQ ID NO: 3851 - DNA, 201 bp, Haemophilus influenzae
  Name: NTH2144
ttgaggttaaatatggaactaagacaacaaattccaacaggctgtattaagcaattcgggcaatttggcgtgccttatgtggttggcgaggttgcggaatttttgccagatggtgatgtgttggtaaatatcacattgttacaatctggagaaaaagacatttatcgcttatcttacctacttgaagatcccgaagctgaa

SEQ ID NO: 3852 - protein, 67 aa, Haemophilus influenzae
  Name: NTH2144
LRLNMELRQQIPTGCIKQFGQFGVPYVVGEVAEFLPDGDVLVNITLLQSGEKDIYRLSYLLEDPEAE

SEQ ID NO: 3853 - DNA, 1296 bp, Haemophilus influenzae
  Name: NTH2145
atgattatggaattatttcatactattttggcaattgtggctttaattttaagtagtgcagttgtttcttctgctgaaatttctctggcgagttctcgtaagttaaaattgcaatctcttgcaaataaaggcgacgtgcgtgcgcttcaagtgcttaaattacaagagcatcctggtcgttttattacggtggttcaaattttgttgaatatggtggcgattttgggtgggggaattggcgaaagtgcactaagtccttacattgcagatattttaaatcgttcttttgaaggaagttggattgagccaaccgcctctacaatcgcttttatattagtgacttgtttgtttattttatttgctgatcttattccaaaacgtattgctattacttatcctgaaatggtggcgttgagcgttgtgggtattatgaattttagtatgtatgtgtttaaaccgcttgtgtgggtttttgatactattgctaatgtatttttccgcttatttcgcatttctactgtgcgtgaagatggcatgacctctgaagatattttcgccgtagttgaagcaggcgcagaagctggtgtattaaaaactcaagagcattatttgatcgaaaatattttcgatatgcaagcccgtacggtaacttccacaatgacaacccgtgaaaacatcgtatatttagaccgcactttttctcgccaagaagtgatggatacgctttctcgtgattctcattctaaaattgtgatttgtgacaatggcctcgacaaaatcttaggttatatcgaatcccatactttgctaactatgtatttgcagaatgaaaatgtggtgctcacagatcctaaactactccgtaaagccttatttgtgcctgatacgctttctctttacgaagtgttggaattgtttaaatctactggcgaagattttgcgattattgtgaatgaatatgctcttgtggtgggtattgttacgctaaatgatgtgatgagtattgttatgggggaattggtttctaacgaagaagaatatattgtgagccgtgatgaaaactcgtggctgattgatggcgcaacgccattaaaagaggtaactcgagtattagatattgcttattttcccgatgaagaaaactacgaaactatcagtggttttatgatgtatatgttacgtaaaatcccgaaaaaaaccgattctgtggtttacggaaaatacaagtttgaagtgattgatacggaaaactttaaaatcgatcagattttggtgtctttagtaaaagagcaggag

SEQ ID NO: 3854 - protein, 432 aa, Haemophilus influenzae
  Name: NTH2145
MIMELFHTILAIVALILSSAVVSSAEISLASSRKLKLQSLANKGDVRALQVLKLQEHPGRFITVVQILLNMVAILGGGIGESALSPYIADILNRSFEGSWIEPTASTIAFILVTCLFILFADLIPKRIAITYPEMVALSVVGIMNFSMYVFKPLVWVFDTIANVFFRLFRISTVREDGMTSEDIFAVVEAGAEAGVLKTQEHYLIENIFDMQARTVTSTMTTRENIVYLDRTFSRQEVMDTLSRDSHSKIVICDNGLDKILGYIESHTLLTMYLQNENVVLTDPKLLRKALFVPDTLSLYEVLELFKSTGEDFAIIVNEYALVVGIVTLNDVMSIVMGELVSNEEEYIVSRDENSWLIDGATPLKEVTRVLDIAYFPDEENYETISGFMMYMLRKIPKKTDSVVYGKYKFEVIDTENFKIDQILVSLVKEQE

SEQ ID NO: 3855 - DNA, 303 bp, Haemophilus influenzae
  n 298, 299, 300, 301, 302: n is any nucleotide
  Name: NTH2146
atgaaaaaacaccacgtagatgttttaatctcagagaatgatgttcatgcgcgtattgctgaattaggtgctcaaattacaaaattttatcaagaaaaacagatcgatagccttgttgtcgtagggcttttacgtggttcctttatgtttatggcggatatcgttcgtcagataaatttacctgtggaaattgaatttatgactacttcaagttatggcactggcatgaccacgaatcacgacgttcgtattaccaaagatttggacgggggtaccgaggctgatattcgtataacannnnnt

SEQ ID NO: 3856 - protein, 101 aa, Haemophilus influenzae
  Xaa 100, 101: Xaa is any amino acid
  Name: NTH2146
MKKHHVDVLISENDVHARIAELGAQITKFYQEKQIDSLVVVGLLRGSFMFMADIVRQINLPVEIEFMTTSSYGTGMTTNHDVRITKDLDGGTEADIRITXX

SEQ ID NO: 3857 - DNA, 1353 bp, Haemophilus influenzae
  Name: NTH2147
atgaaaacagctgaaaattcaaccgcacttttaaaagcacaagaacaagaattacgtcaagccgtcagttttgcagtggcgttagcaacgaaagctggcgcgagtgcagaagtcgcggtcactaaagtgagcggtttatctgtatctgctcgtttgcaagaaattgaaaacgtagaatttactaatgatggtgcattggggatttctgtttatatggggcaacaaaaaggcaatgcctcgacttccgatttaagcgaaagcgcaattaaaaatgcagtggaagccgcacttgctattgcaaaatacacctcgcctgatgattgcacagggttggctgataaagatctaatggcttttgatgcgcctgatttagagctttatcatgctgctgatgtggatgttgataaagcaacagaacttgcacttcaggctgaaaaggcggctttagaggcggatgaacgtattataaatagtaatggcgcaagttttaattcacatacaggcgtgaaagtgtatggtaatagtcacggtatgttgcaaagttatttatcaagccgttattctttatcttgttcggttattggtggcgtagaagctgccttagaaaatgattacgaatatacaatttctcgtgaattcgacaaactccaatcgccaatttgggtcggagaaaattgtgcaaagaaagtcgtttctcgtttaaatcctcaaaaattgagtacacgagaagtgcctgtcattttcttaaatgatgttgcaactggtcttatttctcactttgccgctgcaataagtggtggcagtttatatagaaaatcgagtttcttgctcgatcatttaggcaaacaggtcttaccagattggttcaatatcagtgagagaccacatttattacgtcgtttggcttcaacgccttttgatagtgaaggtgttcgtacgcaagatcgtgaaattgttgaaggcgggatattacaaacttatttagtgacaagctacagtggtaaaaaacttggtatgccaagtacagggcatgctggaggcattcacaactggcttgttaagccaaatttaacgggaggattgaccgcacttttacatcaaatgggaacgggattgttagtaacagatgtgatgggacaaggtgtcaatatcgttacaggcgattattcccgtggtgcatcaggtttttgggtggaaaatggtgaaattcagtatccagtggctgaaattaccattgcagggcaactacaagatatgctgaaaaatatggttgctgtagccgatgatatagagcatcgttctaacattcaaacgggttctattttgttagataaaatgaaaatttcaggaaat

SEQ ID NO: 3858 - protein, 451 aa, Haemophilus influenzae
  Name: NTH2147
MKTAENSTALLKAQEQELRQAVSFAVALATKAGASAEVAVTKVSGLSVSARLQEIENVEFTNDGALGISVYMGQQKGNASTSDLSESAIKNAVEAALAIAKYTSPDDCTGLADKDLMAFDAPDLELYHAADVDVDKATELALQAEKAALEADERIINSNGASFNSHTGVKVYGNSHGMLQSYLSSRYSLSCSVIGGVEAALENDYEYTISREFDKLQSPIWVGENCAKKVVSRLNPQKLSTREVPVIFLNDVATGLISHFAAAISGGSLYRKSSFLLDHLGKQVLPDWFNISERPHLLRRLASTPFDSEGVRTQDREIVEGGILQTYLVTSYSGKKLGMPSTGHAGGIHNWLVKPNLTGGLTALLHQMGTGLLVTDVMGQGVNIVTGDYSRGASGFWVENGEIQYPVAEITIAGQLQDMLKNMVAVADDIEHRSNIQTGSILLDKMKISGN

SEQ ID NO: 3859 - DNA, 534 bp, Haemophilus influenzae
  Name: NTH2148
atggcaaaacgtaagaaaaaagaagttttcgattgggaagatgaagatcaagaagaaattatttgggtgagtaaaagcgaaatcaaacgcgatgcggaagatttaaaacaacttggcgaaaagattgtcaatttaaccaaagctaatcttgccaaaatcccacttgatgaatccttacttgatgccattgaacttgcacagcgtttacaaaaagaagctcgtcgccgtcaattacagtatatcggcaaattatttcgaggaattgatgttgaacctattcgtgaagccttagataaaattgaaaataagcataatcaacaacaagctatgttgcacaaaatcgaaaaagtgtgcgatgaattggtggaaaaaggtgatgtggctttaactgatttactaaatgattatcctgatggcgatcgtcagcaactacgcaatctgattcgttctgcacaaaaagaactggaacaaaataaaccatcaaaagcctatcgagaaatttatcaaatgctcaaggtattaatgttggaagat

SEQ ID NO: 3860 - protein, 178 aa, Haemophilus influenzae
  Name: NTH2148
MAKRKKKEVFDWEDEDQEEIIWVSKSEIKRDAEDLKQLGEKIVNLTKANLAKIPLDESLLDAIELAQRLQKEARRRQLQYIGKLFRGIDVEPIREALDKIENKHNQQQAMLHKIEKVCDELVEKGDVALTDLLNDYPDGDRQQLRNLIRSAQKELEQNKPSKAYREIYQMLKVLMLED

SEQ ID NO: 3861 - DNA, 606 bp, Haemophilus influenzae
  Name: NTH2149
atgaatattcgttggaatgtaattttgggcgttatcgcactttgtgctttggcgtggttttattccttaaatcaggaaaccgcagatttatctgaacttgtgaaaaaaccagatagtcctgattatgtgggttataaaatggaaacaacggttttttcccctgagggtaaaaaacaatatttggctttatccgataaaattgagcattatacagtcaatgaacaaaccctttttaccgcgcctttagtttatttatatcccacaacatcaaatgaaaaggaacaaaatcccaatcaaaatgtagatttttttagcacacaaaactggaaattaagcgcaaatcaagcaagattgacaaaagatcaaatattgtatttagagggtaatgtcgtcgtgcaaagtttaacatcagattctcgtttgcaacgcattgaaacagaatcagcggtcgtcaatttaaaaacacaggatatgacttccgaaacacaggttaaaattaaggggaaaaattttagttctacaggattaaaattagtcggaaatttacgccaacaagtggcgacattaaaggaacaggtaaaaacatattatgaagttagtaagcaa

SEQ ID NO: 3862 - protein, 202 aa, Haemophilus influenzae
  Name: NTH2149
MNIRWNVILGVIALCALAWFYSLNQETADLSELVKKPDSPDYVGYKMETTVFSPEGKKQYLALSDKIEHYTVNEQTLFTAPLVYLYPTTSNEKEQNPNQNVDFFSTQNWKLSANQARLTKDQILYLEGNVVVQSLTSDSRLQRIETESAVVNLKTQDMTSETQVKIKGKNFSSTGLKLVGNLRQQVATLKEQVKTYYEVSKQ

SEQ ID NO: 3863 - DNA, 516 bp, Haemophilus influenzae
  Name: NTH2150
atgaagttagtaagcaataaaattctttttcttgcaacgatggtattagcatcaagttcagcttttgcattgaaagatgacgttaatcagccgataaatatcgtttcggataatcaatccttagatatggaaaaaagtgtagtgacattcacagataatgtagtaattacacagggatctatcatcattaaagcaaataaagttgttatcactcgtcccgctgaaaaatcagggaaaaaagaaactgtagaagcatttggtacgccagtcacattccatcaacagctagataatggcactccaatagatggaaaagcaaataaagttcattatgatcttggcaacgaatttttaacattaactaacaatgccgaattaaagcagcttgatagtaaaattaatggcagtgttattacctatgatgtgaagaaacaacaacttaaagctaatggtaatggaaaatcacgggtaacaacagttcttattccatctcaattacaacaagctaaagggaag

SEQ ID NO: 3864 - protein, 172 aa, Haemophilus influenzae
  Name: NTH2150
MKLVSNKILFLATMVLASSSAFALKDDVNQPINIVSDNQSLDMEKSVVTFTDNVVITQGSIIIKANKVVITRPAEKSGKKETVEAFGTPVTFHQQLDNGTPIDGKANKVHYDLGNEFLTLTNNAELKQLDSKINGSVITYDVKKQQLKANGNGKSRVTTVLIPSQLQQAKGK

SEQ ID NO: 3865 - DNA, 723 bp, Haemophilus influenzae
  Name: NTH2151
atgtcaattttgactgcagagaatttagctaaaagctacaaaagtcgtaaagttgtttcggatgtcagtttaaccgtaaattctaatgaaattgtcggtttgctcgggccaaacggtgcaggtaaaacaaccacgttctatatggtcgttgggcttgttcgccaagatcaaggcaaaattgttattgatggcgaagacattagtttgctcccaatgcataatcgtgcgcaacgtggcattggttatttaccgcaagaagcctcgatttttcgccgtttgactgtctatgaaaatttgatggcggtattggaaattcgtaaagatttaaccccacaacaacgtcgcgaaaaagcagatgaattaattgaagaatttaacattagtcatattcgagataatttagggcaagccttatcaggcggcgaacgtcgccgtgtagaaatcgcacgtgccttagctgcaaatccaaaatttattctattagacgaaccttttgctggtgtagatcctatttctgtgagcgatattaaaaaaattatcaccgacttacgtaaccgaggattaggtgttttgattaccgatcataatgtccgtgaaacccttgatgtttgcgaacgcgcttatattgttggtgcaggtaaaattatcgcaacaggtacaccggcacaagtgatgaacgatgaacaggttaaacgagtttatcttggcgaacaattcaaatta

SEQ ID NO: 3866 - protein, 241 aa, Haemophilus influenzae
  Name: NTH2151
MSILTAENLAKSYKSRKVVSDVSLTVNSNEIVGLLGPNGAGKTTTFYMVVGLVRQDQGKIVIDGEDISLLPMHNRAQRGIGYLPQEASIFRRLTVYENLMAVLEIRKDLTPQQRREKADELIEEFNISHIRDNLGQALSGGERRRVEIARALAANPKFILLDEPFAGVDPISVSDIKKIITDLRNRGLGVLITDHNVRETLDVCERAYIVGAGKIIATGTPAQVMNDEQVKRVYLGEQFKL

SEQ ID NO: 3867 - DNA, 492 bp, Haemophilus influenzae
  Name: NTH2152
atgaaaataactgaactattaagctctgagaatattcgtcagggcgttagtttttctagcaaaaaacgattatttgagtctattgcgcattttgtagaagaacaaatccttgcagaacaaggcgaacaagcctgttttgaatgcctttttgaacgtgaaaaactggggaattctggtttaggaaatgggattgcaatgccaaaagcaaaaatccccgtaacagtatcagataaagcaatcgcagtgtttatgcaactcgataatccgattgattacgatgctgttgatagtaaaccagtggacttaatctttgccttactgattccagaaaatcaatgtgaaagctacattccagttttagcatcattaatagaaaaactgactgataaaaatgtgttgaaacaattacgatcagccaaaagtgcggatgaaatttggcaagtttttgaaattaccgatcaatcagaaacgacacttgaagaagtgaaagaa

SEQ ID NO: 3868 - protein, 164 aa, Haemophilus influenzae
  Name: NTH2152
MKITELLSSENIRQGVSFSSKKRLFESIAHFVEEQILAEQGEQACFECLFEREKLGNSGLGNGIAMPKAKIPVTVSDKAIAVFMQLDNPIDYDAVDSKPVDLIFALLIPENQCESYIPVLASLIEKLTDKNVLKQLRSAKSADEIWQVFEITDQSETTLEEVKE

SEQ ID NO: 3869 - DNA, 867 bp, Haemophilus influenzae
  Name: NTH2153
gtggggaaatttatggaaattatcattattagtgggcgttctggtgcaggaaaatctgtagccttacgagcattagaagatacaggatattactgtgttgataatattcctttagatttgcttcctcaattgactgatattctgtctcaatctcaatcttcggtcgccattagtctcgatattcgtaatattccaagctccgctaattctcttgagcaaaccctttcaacgttacaaaagcatcatcaaattaaaatcattttcttagaggctgatcgcgctaccctgattcgccgatatagcgattcacgccgtttgcacccgctttcattaaaagatctatctcttgaagctgcaatagatgaagaatatcgctatcttgagccattgattcaacacgcaaatcttattcttgataccacccatctttctacgcatattcttgcagaacgattacgcgaatttttacgcgataatagtgaaaaagaattaaaaattattgttgaatcttttggttttaaatatgggattcctttagatgcggattatgttttcgatgtccgctttttacctaacccccattgggatccaacattacgcccaatgactggattagaagcccctgtcgcagaatttctaaatagtcatacagaagtcaatgaatttatttatctcactcgtcattacattgatacttggttgccaatgttagaaaaaaataaccgtagctatttgacgattgccattggatgtactgggggaaaacatcgctccgtttatattgcccagcagttaggcgaatattttcaagccaaaggaaaaacggtacaaattcaacataaatctttagaacggaacaaaaaaata

SEQ ID NO: 3870 - protein, 289 aa, Haemophilus influenzae
  Name: NTH2153
VGKFMEIIIISGRSGAGKSVALRALEDTGYYCVDNIPLDLLPQLTDILSQSQSSVAISLDIRNIPSSANSLEQTLSTLQKHHQIKIIFLEADRATLIRRYSDSRRLHPLSLKDLSLEAAIDEEYRYLEPLIQHANLILDTTHLSTHILAERLREFLRDNSEKELKIIVESFGFKYGIPLDADYVFDVRFLPNPHWDPTLRPMTGLEAPVAEFLNSHTEVNEFIYLTRHYIDTWLPMLEKNNRSYLTIAIGCTGGKHRSVYIAQQLGEYFQAKGKTVQIQHKSLERNKKI

SEQ ID NO: 3871 - DNA, 606 bp, Haemophilus influenzae
  Name: NTH2155
ttggcttatccaatcaaacactgtgtgcttgtcaatgataaaacagatttgagtcaaattgatacgttgtatagtcatcctcaagtgattcaacaatgtagtcaatttattcatagtcttgatcgtgtgcatattgaatattgcgaaagcagttcacacgcaatgcaattagtcgcaagtttgaataaacctaatattgcagcattgggtaatgaagatggtggaaaattgtatggacttagtgtattaaaaactaatattgctaatcaagagaacaatattacacgttttattgtggtggctaaagatcctcgcgaagtttcatcacagattcccacaaagaccttattattaatgacaacttcacagcaagctggcgcgttagtggatgctttattggtgtttaaaaagcatcaaataaatatgacaaaattggaatctcgaccgatttacggtaagccttgggaagaaatgttttatctagaaattgaagcaaatatccatcatccagatacgaaacaggctttggaagaactaaaaaattatagtaattacttaaagattttaggctgttatcctagtgagattgtaaagccagtgagcgtg

SEQ ID NO: 3872 - protein, 202 aa, Haemophilus influenzae
  Name: NTH2155
LAYPIKHCVLVNDKTDLSQIDTLYSHPQVIQQCSQFIHSLDRVHIEYCESSSHAMQLVASLNKPNIAALGNEDGGKLYGLSVLKTNIANQENNITRFIVVAKDPREVSSQIPTKTLLLMTTSQQAGALVDALLVFKKHQINMTKLESRPIYGKPWEEMFYLEIEANIHHPDTKQALEELKNYSNYLKILGCYPSEIVKPVSV

SEQ ID NO: 3873 - DNA, 105 bp, Haemophilus influenzae
  n 52: n is any nucleotide
  Name: NTH2156
ttgaaaaattcagactgggaagctgatttggtgtatgctttagaaaatacancatcgggtgcattaatgaagtttatgatttacttcagcctactgatttatcat

SEQ ID NO: 3874 - protein, 35 aa, Haemophilus influenzae
  Xaa 18: Xaa is any amino acid
  Name: NTH2156
LKNSDWEADLVYALENTXSGALMKFMIYFSLLIYH

SEQ ID NO: 3875 - DNA, 444 bp, Haemophilus influenzae
  Name: NTH2157
atgattaagctaaataatattacgaaaatttttgagctaccgaacaaaaaattgactgcgcttgataatgtttcgttgaatatcgaaaaaggtcaaatctgtggcgtaattggtgcatctggtgcaggaaaaagtacattaattcgctgtgtgaacttattagaaaaaccgacaagcggttccgttattgttgatggcgtagaattaacaaaactttctgatcgcgaattagtacttgctcgtcgtcaaattggaatgatttttcagcatttcaatttactaagttctcgcaccgtatttgaaaacgtggcattacccttagaaattggaagtgagtcaaaagcaaaaatccaagaaaaaattaccgcacttttagatcttgttggtttaagtgaaaaacgtgatgcttacccaagcaatctttctggcgggcaaaacaacgcg

SEQ ID NO: 3876 - protein, 148 aa, Haemophilus influenzae
  Name: NTH2157
MIKLNNITKIFELPNKKLTALDNVSLNIEKGQICGVIGASGAGKSTLIRCVNLLEKPTSGSVIVDGVELTKLSDRELVLARRQIGMIFQHFNLLSSRTVFENVALPLEIGSESKAKIQEKITALLDLVGLSEKRDAYPSNLSGGQNNA

SEQ ID NO: 3877 - DNA, 576 bp, Haemophilus influenzae
  Name: NTH2158
ttgacatgtataaaaggcaagagaatgaataaggctatttttttagatcgcgatggcacgttaaatattgattatggttatgtacacgaaattgataactttaaatttattgatggtgcgattgatgcattgcgagaattaaagaaaatgggatatatgttggtattagtgaccaaccagtcgggcattgcacgtggttatttttctgaggatcagtttttacaattaacagaatggatggattggtcgttagctgaacaagatgtggatttggatggcatttactattgtccacatcattctgagggaaagggcgaatataaagaagattgtgattgtcggaagcctaaatcgggaatgttattgcaagcgatcaaagaattaaagatcgatcctacgcaatctattatggttggagataaagttgaagacctaaaagcggggattggtgcgaaggtaaaaatgaacgtattagttcgtactggtaaaccagtaacaggggaaggagaaggaatagcggattatgtgttagattctatcgtagatcttccgagaattttaaaacgcttaaaaaaa

SEQ ID NO: 3878 - protein, 192 aa, Haemophilus influenzae
  Name: NTH2158
LTCIKGKRMNKAIFLDRDGTLNIDYGYVHEIDNFKFIDGAIDALRELKKMGYMLVLVTNQSGIARGYFSEDQFLQLTEWMDWSLAEQDVDLDGIYYCPHHSEGKGEYKEDCDCRKPKSGMLLQAIKELKIDPTQSIMVGDKVEDLKAGIGAKVKMNVLVRTGKPVTGEGEGIADYVLDSIVDLPRILKRLKK

SEQ ID NO: 3879 - DNA, 126 bp, Haemophilus influenzae
  Name: NTH2159
ttgacgttaaatacagaagaagcaccggctaactccgtgccagcagccgcggtaatacggagggtgcgagcgttaatcggaataactgggcgtaaagggcacgcaggcggttatttaagtgaggtg

SEQ ID NO: 3880 - protein, 42 aa, Haemophilus influenzae
  Name: NTH2159
LTLNTEEAPANSVPAAAVIRRVRALIGITGRKGHAGGYLSEV

SEQ ID NO: 3881 - DNA, 663 bp, Haemophilus influenzae
  Name: NTH2160
gtgaaagccattaaacaagaaacgggcttagaagccgcaccacatttaactggaattgatgccacacctgaagaattaaaacaaattgcgagagattattgggatagtggtattcgccgtattgttgcgttacgcggtgacgaacctaaaggttacgcgaaaaaaccattttatgcgtcagatcttgtggaattactccgttctgtcgctgattttgatatttctgtagccgcttatcctgaagttcatccagaagcaaaatccgcacaagcagacttaattaatttaaaacgtaaaattgattcaggtgcaaaccacgtcattatacaatttttctttgatattgaaaactacctacgttttcgtgatcgttgtgcatcaattggtattgatactgaaatcgtacccggtattttacctgttactaattttaaacaactccaaaaaatggcatcattcactaatgtgaaaattccagcgtggttagttaaagcctatgatggtttggatgatgatccaactacacgtaatcttgtagcagcaagtgttgcaatggatatggtaaaaattttatctcgcgaaggcgtgaatgacttccacttttatacattaaatcgtagtgaattaacttatgctatctgtcatatgttaggtgtaagacct

SEQ ID NO: 3882 - protein, 221 aa, Haemophilus influenzae
  Name: NTH2160
VKAIKQETGLEAAPHLTGIDATPEELKQIARDYWDSGIRRIVALRGDEPKGYAKKPFYASDLVELLRSVADFDISVAAYPEVHPEAKSAQADLINLKRKIDSGANHVIIQFFFDIENYLRFRDRCASIGIDTEIVPGILPVTNFKQLQKMASFTNVKIPAWLVKAYDGLDDDPTTRNLVAASVAMDMVKILSREGVNDFHFYTLNRSELTYAICHMLGVRP

SEQ ID NO: 3883 - DNA, 267 bp, Haemophilus influenzae
  Name: NTH2161
gtgggaattaaagatgcttgtgtaaatcacgctttattgacaataaaggttatccaacaggttgggtgggccgttattaggttgaatacaagtcgaattaatgcattattaagccattatgcagaaattgttgatttactggttgaacatattaatgcgccagttttaggtaaaattccttatttacataaagccgaagagcaagaattagggcattatttaacgaatatagatcgattaatgtatatgcaaacagagttcataaaa

SEQ ID NO: 3884 - protein, 89 aa, Haemophilus influenzae
  Name: NTH2161
VGIKDACVNHALLTIKVIQQVGWAVIRLNTSRINALLSHYAEIVDLLVEHINAPVLGKIPYLHKAEEQELGHYLTNIDRLMYMQTEFIK

SEQ ID NO: 3885 - DNA, 939 bp, Haemophilus influenzae
  Name: NTH2162
ttgcctaaaatttcagaagtggcgaaagcgctatggattatttatgcttcattaactgttctttgtgccattgcatattggctatcaggaatgaatctttttgatgccattgggcatagtttttcaacaatttcaaatggcggattttcaacgcacgatgcaagtattggctattttaatcaagcttccatttattgggttacaacaatttttatgctgattggtggtgttaattttagtttacatatttccgcttttcttgcactaggtaaaagaaatatttggcgaaattattggaaagatcccgaatttcgtttttttctaacgatgcaaattatttttattggtattgtatctctatctttatatggttatggtttagtttcagatataaacgaggcagtaacaaaaggtgcattacaattaacatcaatgtcaatgactgctggttatacgatttttgatattgataatcttccgccttttattgggcttttactggtaatttctgcggtaattggtggttgtggtggttcaacaactgggggattaaaagcgatacggacacttatattgtggaaacaaatcgatcgagaactgcatagtttaatccatccaaatttagtacaaccaattcgaataggtaaaaatcgtctagcaccaagaatgatagaaagtatttgggcatttttcattatttttatactggtttattgggggtgtgtttttgctgttattctttgtggaatgaatacttttgatgcgatgggagccgtattcgccacattaacgaatgcaggaccgggacttggttttattcacgaaagttttattggtgttccagaaagtgctaaattagtctttagttttgctatgatctgtggacgtttagaaatgttttcattaatcgtgctgtttattccaagctattggaaaaaa

SEQ ID NO: 3886 - protein, 313 aa, Haemophilus influenzae
  Name: NTH2162
LPKISEVAKALWIIYASLTVLCAIAYWLSGMNLFDAIGHSFSTISNGGFSTHDASIGYFNQASIYWVTTIFMLIGGVNFSLHISAFLALGKRNIWRNYWKDPEFRFFLTMQIIFIGIVSLSLYGYGLVSDINEAVTKGALQLTSMSMTAGYTIFDIDNLPPFIGLLLVISAVIGGCGGSTTGGLKAIRTLILWKQIDRELHSLIHPNLVQPIRIGKNRLAPRMIESIWAFFIIFILVYWGCVFAVILCGMNTFDAMGAVFATLTNAGPGLGFIHESFIGVPESAKLVFSFAMICGRLEMFSLIVLFIPSYWKK

SEQ ID NO: 3887 - DNA, 573 bp, Haemophilus influenzae
  Name: NTH2163
gtgcgtattttatcgattatccgaattattggtattcttgtgatgtgtttttcaggtacgatgctagttcctgcatttgttgctctgatttatggtgatgggggcggcaaggcatttatgcaggcttttatgttgagcttgacagcgggcacattgctttggtggccatgccatcaccataaacaagaattacgatcccgtgatggttttttgattgttgtggctttttggttagttttaggaagcttggcaacattgcctcttttattgttcgattcaccacatttaactattgcttcagccgtatttgaagcattttctggcttaactactactggtgcaacggtaatgacggggctggataatttacctaaatctattttgttttatcgtcagtttttacaatggttaggtggtatggggattatcgtattggctgtggcgataattccgctgttgggaattggtgggacacaattatatcgagcagaatcttcaggcctcttaaagatcaaaaatctttgcctaaaatttcagaagtggcgaaagcgctatggattatttatgcttcat

SEQ ID NO: 3888 - protein, 191 aa, Haemophilus influenzae
  Name: NTH2163
VRILSIIRIIGILVMCFSGTMLVPAFVALIYGDGGGKAFMQAFMLSLTAGTLLWWPCHHHKQELRSRDGFLIVVAFWLVLGSLATLPLLLFDSPHLTIASAVFEAFSGLTTTGATVMTGLDNLPKSILFYRQFLQWLGGMGIIVLAVAIIPLLGIGGTQLYRAESSGLLKIKNLCLKFQKWRKRYGLFMLH

SEQ ID NO: 3889 - DNA, 630 bp, Haemophilus influenzae
  Name: NTH2164
ttgaaaaaagaaatggcggaatacctcgttcctaaaagtgcggttgtttttgaagaagaaattaagaaaagccgttttattacttatttacagcacaccgaaggtttagaagacgcaagagctttttgggcaaagattaaacaagaacatccaaatgctcggcatcattgttgggctgccgtagcaggcaagccaacagattctctacaacttggtttttctgatgatggcgaacctgctggaacggcaggaaagccaatgttgagtgcattgcaaggtagtcaattaggtgaaatcagtgcggtggtggttcgctattatggcggcattttgcttggaacgggcggattagttcgtgcttacggcaatggcgtacaacaagcgttaaagctgattgaaagcgaaattaaagttgaacgaacccctttcaaacttgattgtgactatggtcagttaaggttggttcaacaactttgtgaaaaatatcaggttgagattttatctcaaggttttcaggcaaatattcatttgattttaggtattagtgaaaaaacaatagaggcgttttcttcagaattaacggaaaagtcttcaggtagattggttattcaacttttagagataggcgaa

SEQ ID NO: 3890 - protein, 210 aa, Haemophilus influenzae
  Name: NTH2164
LKKEMAEYLVPKSAVVFEEEIKKSRFITYLQHTEGLEDARAFWAKIKQEHPNARHHCWAAVAGKPTDSLQLGFSDDGEPAGTAGKPMLSALQGSQLGEISAVVVRYYGGILLGTGGLVRAYGNGVQQALKLIESEIKVERTPFKLDCDYGQLRLVQQLCEKYQVEILSQGFQANIHLILGISEKTIEAFSSELTEKSSGRLVIQLLEIGE

SEQ ID NO: 3891 - DNA, 279 bp, Haemophilus influenzae
  Name: NTH2165
gtgcggtatgatatggctctgtttttcaaaagaaaaaagaatatgtctgaaatttccgtcacacaaaccctaaatactttaggattacgttgcccagaacctgtcatgcttgttcgtaaaaatattcgtcatcttaacgatggagaaatacttttgattattgctgacgatcctgcaacaacaagagatattccaagtttctgtcaatttatggatcacacattactgcaaagtgaagtggaaaagcccccgttcaaatattgggtgaaaagaggaaaa

SEQ ID NO: 3892 - protein, 93 aa, Haemophilus influenzae
  Name: NTH2165
VRYDMALFFKRKKNMSEISVTQTLNTLGLRCPEPVMLVRKNIRHLNDGEILLIIADDPATTRDIPSFCQFMDHTLLQSEVEKPPFKYWVKRGK

SEQ ID NO: 3893 - DNA, 864 bp, Haemophilus influenzae
  Name: NTH2166
ttgagagaacacattatgatgcgaattcttcttttcttggcaaccaatatggctgtaatgctggtattggggattattttaaatgtgactggtattgcaggaaatagcactggcggcattttaattatggctttgctatttggttttgctggttcattaatttccttattcctgtctaaaacgatggcattacgttctgtagatggagaagtgattactcaacctcgtaatcaaactgaacgttggttaattgatactgttagtcgccaagcacagaaagcgggaattccgatgccagacgtggcgatttatcattcacccgatgtgaatgcttttgctacaggtgcaacgaaaagcaattctttagtggcagtgagtacgggattattaaacaacatgacggaggctgaagctgaagctgttttagcgcacgaaatttctcatatttccaatggcgatatggtgacgatggcgttattgcaaggcgtattgaatactttcgtgattttcttatctcgcgttatcgcaacggcggtagcaagttcgcgtaacaataatggagaggaaacgcgcagttcaggtatttatttcttggtttctatggtattggaaatgctctttggtgtgcttgcgagtattatcgcaatgtggttctctcgttaccgagaatttcgtgcagatgctggttccgcaagtttagtaggcaaagaaaaaatgattatggcactgcaacgtttgcaacaacttcacgaaccacaaaatctcgaaggttctttaaatgcctttatgattaatggtaaacgcagtgaactctttatgagccatccaccactcgaaaagcgtattgaagccttacgtaatctt

SEQ ID NO: 3894 - protein, 288 aa, Haemophilus influenzae
  Name: NTH2166
LREHIMMRILLFLATNMAVMLVLGIILNVTGIAGNSTGGILIMALLFGFAGSLISLFLSKTMALRSVDGEVITQPRNQTERWLIDTVSRQAQKAGIPMPDVAIYHSPDVNAFATGATKSNSLVAVSTGLLNNMTEAEAEAVLAHEISHISNGDMVTMALLQGVLNTFVIFLSRVIATAVASSRNNNGEETRSSGIYFLVSMVLEMLFGVLASIIAMWFSRYREFRADAGSASLVGKEKMIMALQRLQQLHEPQNLEGSLNAFMINGKRSELFMSHPPLEKRIEALRNL

SEQ ID NO: 3895 - DNA, 390 bp, Haemophilus influenzae
  Name: NTH2168
atgatgactcaaattattcatactgaaaaagcaccagcagccattggcccttatgttcaagcggttgatcttggcaatctagttttaacctcagggcaaattccagtgaatcctgcaacaggcgaagtgccagctgacatcgttgcacaagcacgccaatctttagaaaacgtgaaagcgattatcgagaaagcaggtttaaccgcagccgatattgtaaaaacaacggttttcgtgaaagatcttaatgattttgctgcggttaatgcagaatacgaacgtttctttaaagaaaataatcatcctaacttccctgctcgttcttgcgtagaagttgcgcgtttaccaaaagatgtgggattagaaattgaagcgattgctgtaagaaaa

SEQ ID NO: 3896 - protein, 130 aa, Haemophilus influenzae
  Name: NTH2168
MMTQIIHTEKAPAAIGPYVQAVDLGNLVLTSGQIPVNPATGEVPADIVAQARQSLENVKAIIEKAGLTAADIVKTTVFVKDLNDFAAVNAEYERFFKENNHPNFPARSCVEVARLPKDVGLEIEAIAVRK

SEQ ID NO: 3897 - DNA, 732 bp, Haemophilus influenzae
  Name: NTH2169
ttgaccgcacttttgagtgccattgcactaacaggttgtgcaaatcacaacgccacgaaacaagcaagtgagcgtaatgattcccttgaagacttcaatcgaacaatgtggaaatttaactataatgttatagatcgctatgtgctagaacccgctgcaaaaggttggaataactatgtgcctaagccgatttcttctggtcttgctggcatcgcaaataatcttgatgagccagtcagtttcataaaccgattaattgaaggtgaaccgaaaaaagcatttgttcactttaatcgcttttggattaacactgtatttggactaggtggttttattgattttgcgagcgcaagcaaagaattacgcatagataatcaacgtggatttggggaaactttaggtagctacggcgtagatgctggcacttatattgtgctaccgatttataatgcaacaacaccacgccaattaacgggtgcagtggttgatgcggcttatatgtatccattctggcaatgggttggtggtccgtgggcattagtgaaatatggtgtgcaagcagtggatgcccgtgcgaaaaatctcaataatgcagaattgttacgtcaagctcaagatccatatatcacgttccgagaagcttattaccaaaatttacaatttaaagtaaacgatgggaaattagtcgaaagcaaagaatcacttcccgatgacatactaaaagaaattgat

SEQ ID NO: 3898 - protein, 244 aa, Haemophilus influenzae
  Name: NTH2169
LTALLSAIALTGCANHNATKQASERNDSLEDFNRTMWKFNYNVIDRYVLEPAAKGWNNYVPKPISSGLAGIANNLDEPVSFINRLIEGEPKKAFVHFNRFWINTVFGLGGFIDFASASKELRIDNQRGFGETLGSYGVDAGTYIVLPIYNATTPRQLTGAVVDAAYMYPFWQWVGGPWALVKYGVQAVDARAKNLNNAELLRQAQDPYITFREAYYQNLQFKVNDGKLVESKESLPDDILKEID

SEQ ID NO: 3899 - DNA, 141 bp, Haemophilus influenzae
  Name: NTH2170
atggcactcaaaagtgcggtcaaaattacctttgttttcatttttgatccttacataaatatgggattattctacctaatttgtgaaataacaacaaattttgcgtataaaaacactcttttatgctgtttcaacaaacat

SEQ ID NO: 3900 - protein, 47 aa, Haemophilus influenzae
  Name: NTH2170
MALKSAVKITFVFIFDPYINMGLFYLICEITTNFAYKNTLLCCFNKH

SEQ ID NO: 3901 - DNA, 555 bp, Haemophilus influenzae
  Name: NTH2172
atgactgaagaaacaacagtatcaaaaaaacgttggtatgtattacaagcgttttctggctttgaaagtcgtgtagctctaactttacgtgaatacataaaacaacaacaaatggaagatcaatttggtgaagttttagtgccaactgaagaagtggtggaaaatgtagcaggtaaacgtcgcaaaagtgaacgtaaattttttccaggttatgtacttgtagaaatggaaatgaatgatgaaacttggcatttagtaaaaagtgtgccaagagtgatgggttttatcggtggtacaccagataaacctgcacctatttccaaacgtgaagcggatactattttaaatcgtcttgaacaaaatactgataaacctcgtcatcgtaatgaatatcatccgggagaggaagttcgtgtgactgaagggccatttgctgattttaatggtacagtagaagaagtggattatgaaaaaggtcgcttaaaagtgtctgtatcaatctttggccgtgctacaccagttgagcttgaatttggtcaagttgaaaaaatacac

SEQ ID NO: 3902 - protein, 185 aa, Haemophilus influenzae
  Name: NTH2172
MTEETTVSKKRWYVLQAFSGFESRVALTLREYIKQQQMEDQFGEVLVPTEEVVENVAGKRRKSERKFFPGYVLVEMEMNDETWHLVKSVPRVMGFIGGTPDKPAPISKREADTILNRLEQNTDKPRHRNEYHPGEEVRVTEGPFADFNGTVEEVDYEKGRLKVSVSIFGRATPVELEFGQVEKIH

SEQ ID NO: 3903 - DNA, 414 bp, Haemophilus influenzae
  Name: NTH2173
atggcaaccgaaaatgttgataaaaagaaaaatacgcaagaagtgatcgttgaaggcaaatctaaaggtttaaatacattcctttgggttttagttgtgatcttttttgctgctgcggcaattgggaatatttatttccaacaaatctattctttaccgattcgtgttattggtatggctattgcattagtcattgcatttattttagcggcaattactaatcaaggaacaaaagcacgtgcgttctttaatgactctcgtacagaagcgcgtaaagtcgtatggccaacccgtgctgaagcgcgtcaaacaacattgatcgttatcggggtaacaatgattgcttctctcttcttttgggcagtagattcgattattgtgacagtgattaatttcttaactgatttgagattc

SEQ ID NO: 3904 - protein, 138 aa, Haemophilus influenzae
  Name: NTH2173
MATENVDKKKNTQEVIVEGKSKGLNTFLWVLVVIFFAAAAIGNIYFQQIYSLPIRVIGMAIALVIAFILAAITNQGTKARAFFNDSRTEARKVVWPTRAEARQTTLIVIGVTMIASLFFWAVDSIIVTVINFLTDLRF

SEQ ID NO: 3905 - DNA, 1233 bp, Haemophilus influenzae
  Name: NTH2175
atgacagacaaagataaagatttgcactgctctttttgcggaaaggaaaaaggcgaagtagatagattaattgctggcacagacggttatatttgtaatgaatgtattgaactttgtcactcaatgcttgaagaaagtcatgataaaaatttagaggaaagtgcggtagaaaatgaagaaaaattaccaacacctcacgaaattcgcgctcatctagatgattatgttatcggtcaagattatgcgaaaaaagtgctttctgtggcagtttataatcattataaacgcttgcgaactaactatgaaagcaatgatgtagagcttggtaaaagtaatattttacttataggccctacaggtagcggaaaaacgttacttgcgcaaacattagctcgtcgtttaaatgtaccctttgcgatggcagatgcaaccacattaacggaagctggttatgtgggagaagatgtagagaatgtattacagaaacttttgcaaaattgtgaatacgatactgaaaaagcagagaaaggcattatttatattgatgaaattgataaaattagccgtaaatcggaaggcgcatcaattactcgagatgtttcaggagagggggtgcaacaggctttattaaaacttattgaaggtacaatagcttccattccacctcaaggcggtcgtaaacatccacaacaagaaatggtaaaattggatacgtctaaaattctctttatttgcggcggtgcatttgcaggattagataaaattattgataaacgcactcaaaccagtacgagtattggttttaatgccaaagttgaaaaagatgaaaaacaacaatctctttctgaattattccgtcaagttgaacctgatgatttgatgaaatttggtttaattccagaatttatcggacgcttgccaatgattgccccattaagtgaattagacgaagatgcgctgatacaaattctcacaaaaccaaaaaacgcattaattaaacaatatcaagccttatttggattggaaaaagtagaattggatttcacaccagaagcattaaaagcaatggcgaaaaaagcacttgaaagaaaaacgggtgcgcgtggcttacgttctatcgtagaagcagtgttgttagatacaatgtatgatctaccgtctcttgagaatttacaaaaagttatcgttgatgaatcgacaattgtagataatcttgcgccaaaattagaatat

SEQ ID NO: 3906 - protein, 411 aa, Haemophilus influenzae
  Name: NTH2175
MTDKDKDLHCSFCGKEKGEVDRLIAGTDGYICNECIELCHSMLEESHDKNLEESAVENEEKLPTPHEIRAHLDDYVIGQDYAKKVLSVAVYNHYKRLRTNYESNDVELGKSNILLIGPTGSGKTLLAQTLARRLNVPFAMADATTLTEAGYVGEDVENVLQKLLQNCEYDTEKAEKGIIYIDEIDKISRKSEGASITRDVSGEGVQQALLKLIEGTIASIPPQGGRKHPQQEMVKLDTSKILFICGGAFAGLDKIIDKRTQTSTSIGFNAKVEKDEKQQSLSELFRQVEPDDLMKFGLIPEFIGRLPMIAPLSELDEDALIQILTKPKNALIKQYQALFGLEKVELDFTPEALKAMAKKALERKTGARGLRSIVEAVLLDTMYDLPSLENLQKVIVDESTIVDNLAPKLEY

SEQ ID NO: 3907 - DNA, 633 bp, Haemophilus influenzae
  Name: NTH2176
ttgtgggttatttacgataaaataattagcagttttaatgaaaaaggtaagaaaatgagtgtaattcctatggtcgttgaacagacttcgcgtggcgaacgttcgtacgacatttattcccgtttattaaaagaacgtgtgattttcctaagtggagaagtggaagatcgtatggcaaatttaattgtggcacagcttctttttttagaatcggaagatccaactaaagatattaatatttatattaactctccaggcggttctgtgaccgcaggtatggcaatttacgacacaatgcaatttattaagccagatattcgcactctttgtattggtcaggcttgttcaatgggcgcattcttacttgctggcggaaccgctggcaaacgagctgcgttacccaatgcgcgagtgatgatccatcaacctttgggtggtttccgtggtcaagcatcagatattcaaattcacgcacaagaaattttgaaaattaaacacaccttaaatgatcgtttagcattccatactggacaaggtattgagcgtattgagaaagatactgaccgtgataattttatgtcagctgaagaagcacaagcgtatggtttggtggatgaagtcttggttaaacgt

SEQ ID NO: 3908 - protein, 211 aa, Haemophilus influenzae
  Name: NTH2176
LWVIYDKIISSFNEKGKKMSVIPMVVEQTSRGERSYDIYSRLLKERVIFLSGEVEDRMANLIVAQLLFLESEDPTKDINIYINSPGGSVTAGMAIYDTMQFIKPDIRTLCIGQACSMGAFLLAGGTAGKRAALPNARVMIHQPLGGFRGQASDIQIHAQEILKIKHTLNDRLAFHTGQGIERIEKDTDRDNFMSAEEAQAYGLVDEVLVKR

SEQ ID NO: 3909 - DNA, 1182 bp, Haemophilus influenzae
  Name: NTH2177
gtgcgcgtagatggtttccgtaaaggtcatgttcctgcccatatcattgaacaacgttttggtgcgtcaattcgtcaagatgtattaaacgatttattaccacgtcatttttttgatgctgttattgcagaaaaaattaatattgcaggtcgtccaacttttgctattgaaacttttgaagaaggtaaagacttagttttcactgcaactttcgaggtttatccagaagttaaattacaaggtttagaaaatatcaaagttgaaaaaccaactgttgaaatcacggaagctgacattgataaaatgatcgatgtgttacgtaaacaacaagctacttgggctgaaagtcaagatgttgtaaaagcagatgatcgtgtcactattgattttgttggctctgtagatggcgaagaatttgaaggtggtaaagctactgactttgtattatttatgggtcaaggtcgtatgattccaggttttgaagaaggaattgttggtcataaagcaggtgagcaatttgatattgatgtgactttcccagcggaataccacgcagaaaacttgaaaggtaaagcagcaaaatttgcgatcactttgaaaaaaatcgaaaatatggtgttgcctgaattaacagatgaatttgttgctaaatttggtcctaatactaagtctgttgctgatttgcgtgcagaaatccgtaaaaatatggaacgtgaattgaaaaatgcgttagtttctcgtgttaaacaacaagtaatcaatggtttaattgaacaaaatccgattgatgtgccagcttctgcagtagaagaagaaattaatgtattacgcaatcaagcagctcaacgttttggcggtaatgcacaacaaactgcacagttaccgcgtgaattatttgaagctgaagcaactcgtcgtgtacaagtgggtttattattctctgaagtgattaaatctaatgaattaaaagctgatgaagaacgcgctaaagcaatgattgcagatattgcatcagcttacgagcagccagcagaagttgtggaatattacagcaaaaacgaagagttaatgaataatattcgcaatgtagtattggaagaacaagctgttgatgcagtacttgcaaaagcacaagtaacagaaaaagtttcttcattcgatgaaattatgaatccacaagca

SEQ ID NO: 3910 - protein, 394 aa, Haemophilus influenzae
  Name: NTH2177
VRVDGFRKGHVPAHIIEQRFGASIRQDVLNDLLPRHFFDAVIAEKINIAGRPTFAIETFEEGKDLVFTATFEVYPEVKLQGLENIKVEKPTVEITEADIDKMIDVLRKQQATWAESQDVVKADDRVTIDFVGSVDGEEFEGGKATDFVLFMGQGRMIPGFEEGIVGHKAGEQFDIDVTFPAEYHAENLKGKAAKFAITLKKIENMVLPELTDEFVAKFGPNTKSVADLRAEIRKNMERELKNALVSRVKQQVINGLIEQNPIDVPASAVEEEINVLRNQAAQRFGGNAQQTAQLPRELFEAEATRRVQVGLLFSEVIKSNELKADEERAKAMIADIASAYEQPAEVVEYYSKNEELMNNIRNVVLEEQAVDAVLAKAQVTEKVSSFDEIMNPQA

SEQ ID NO: 3911 - DNA, 156 bp, Haemophilus influenzae
  Name: NTH2178
ttgattttgcccgagtgcaaattaattgaggtaccaaatgtcattaattatgaaacaactcaaggtttagaacgccgcgtagcgattcccgttccaactgaaattgtctctaaagccgttcgtgaagaattaaacgtgctgcaaaaaatgtgcgcg

SEQ ID NO: 3912 - protein, 52 aa, Haemophilus influenzae
  Name: NTH2178
LILPECKLIEVPNVINYETTQGLERRVAIPVPTEIVSKAVREELNVLQKMCA

SEQ ID NO: 3913 - DNA, 267 bp, Haemophilus influenzae
  Name: NTH2180
ttgaccttggctaatatcaagtcagcaaaaaaacgcgcggttcaatctgaaaaacgtcgccaacacaacgcaagccaacgctctatgatgcgtacttatatcaaaaaagtatatgctcaagtggcagcaggcgaaaaatcagcagctgaatcagcattcgttgaaatgcaaaaagttgtagaccgtatggcttctaaaggcttaatccacgctaataaagcagcaaaccacaaatctaaattagctgcacaaatcaaaaaattagcg

SEQ ID NO: 3914 - protein, 89 aa, Haemophilus influenzae
  Name: NTH2180
LTLANIKSAKKRAVQSEKRRQHNASQRSMMRTYIKKVYAQVAAGEKSAAESAFVEMQKVVDRMASKGLIHANKAANHKSKLAAQIKKLA

SEQ ID NO: 3915 - DNA, 1572 bp, Haemophilus influenzae
  Name: NTH2181
ttgagtaaacgacttttaaaatctagcattgttgttagttctatgacgttattatcaagagtgttaggtcttgtacgcgatgtagttatcgctcatctcattggggctggcgctgcggcggatgtttttttatttgctaatcgtatcccaaattttcttcgtcgtttatttgctgagggggctttttcacaggcttttgtccctgttctcgcagaatatcaaaaatctggcgatatgaataaaacccgtgaatttattggaaaagtttctggtacccttgggggattggtgagtattgttacgatccttgcgatggttggatcgcctgtcgttgccgctttatttgggatgggctggtttaccgattggatgaatgatggccctgatgcacataaatttgaacaagcctctcttcttcttaaaataacttttccttatttatggtttgttacttttgtcgcgctttttggagctgtacttaacacgattggaaaattcggcgtgatgtccttttcacccgtgttattaaatatagcgatgattgccaccgcacttttccttgcaccacaaatggataacccagatcttgcactggctatcgggatttttcttggcggattattacagttcttattccaaattccatttatgaaacaagcaggtttactggtgaaaccaaaatgggcttggcgggatgaaggcgtaaccaaaattcgtaaattaatgatccctgcgttatttggtgtatcggtaagtcaaattaatcttttgctggatacagtgattgcgagcttcttaatgacgggctctattagctggctgtattattccgaccgcttactggaatttcctctcggtttatttggcattgcgatttctaccgtaattttaccaacgcttgctcgccaccacgttaatcgtgaaggcgattcagctaaaagtgcggttgattttcgtaatacaatggattggggcgtgcgaatgattttcttacttggcgttcctgctgccattggtattgctgtattggctcaaccgatgttacttacgctctttatgcgtggaaatttcatgctaaatgatgtttatgccgcctcttattctttatgggcgtttaatgcgggtttgcttagctttatgttgattaaaatcctcgccaatggctattacgctcgccaagataccaaaaccccagtaaaaattggcattattgccatggtgagtaatatgggctttaatctattggcgattcctttcagctatgttggtttagctattgcttcagcaatgtccgcaactcttaacgcctatttgctctatcgcggcttagccaaagcggatgtgtaccatttttcacgtaaaagtgcggtcttttttgtcaaagttttattggctgcaatcgcaatgggtgcggcagtttggtattacgtgcctgaaatcaaccaatgggcaaaaatggatttctttatgcgtgtttattggcttgtttggttgattgtcttagccgcaatagtttatggcacaacgttgattttattaggcgttcgcaagcaccatttgctgacaaaaaac

SEQ ID NO: 3916 - protein, 524 aa, Haemophilus influenzae
  Name: NTH2181
LSKRLLKSSIVVSSMTLLSRVLGLVRDVVIAHLIGAGAAADVFLFANRIPNFLRRLFAEGAFSQAFVPVLAEYQKSGDMNKTREFIGKVSGTLGGLVSIVTILAMVGSPVVAALFGMGWFTDWMNDGPDAHKFEQASLLLKITFPYLWFVTFVALFGAVLNTIGKFGVMSFSPVLLNIAMIATALFLAPQMDNPDLALAIGIFLGGLLQFLFQIPFMKQAGLLVKPKWAWRDEGVTKIRKLMIPALFGVSVSQINLLLDTVIASFLMTGSISWLYYSDRLLEFPLGLFGIAISTVILPTLARHHVNREGDSAKSAVDFRNTMDWGVRMIFLLGVPAAIGIAVLAQPMLLTLFMRGNFMLNDVYAASYSLWAFNAGLLSFMLIKILANGYYARQDTKTPVKIGIIAMVSNMGFNLLAIPFSYVGLAIASAMSATLNAYLLYRGLAKADVYHFSRKSAVFFVKVLLAAIAMGAAVWYYVPEINQWAKMDFFMRVYWLVWLIVLAAIVYGTTLILLGVRKHHLLTKN

SEQ ID NO: 3917 - DNA, 936 bp, Haemophilus influenzae
  Name: NTH2182
atggataaggacatgcaattaattcgtgggcttcataatgcaaatcgtgttttacaaggttgtgcgctaacgatcggcaactttgatggtgtgcatttagggcatcaaaccgtcctccgccatttgcgccaaaaagctgacgaattaaatttacccatggcggtattgttatttgaatcacagccgcgtgaatattttatgggggaaaatgcacctgcacgtttaatgcgtttgcgtgacaaaatttattatctcgaaaaggctaaggtcgatgtcgtaattgtggcgaaatttgaccgcacttttgccgagcaaccagccgatgtttttattgaacaaacgcttgttaatcatctacatgtgaaatttttaagcattggcgatgatttcaaattcggctcaaaacgccaaggcaattttgccatgttgcaagcagctagtaagcgttttggttttattgttgaagataaccgtagtttttgtctagatgcacagcgaattagtagcactgcgattcgcgaagcgttagcgaatgatgatttacaacttgcagaaaatttactcggtaaaccttatcgtattttcgggcgtgtgattcatgggaataaattaggtagaacaataggatttccaacggcaaatattcgtttgcatagacaagtaaatccaatcaaaggcgtttatgccgtaaaagtgcggttaaaatcgggggagatttttaacggcgtggcaaacatgggaaaacgcccaactataaatggattaatgcaattattagaagtccatttatttgatttttctcagaatatttatggccaaatggtggaagtggaattctgccacaagattagaaacgagattaaattcccctcttttgatgatttgaaagtgcaaattgagaaagacgtagaaactgcgaaagcgttttttaacagt

SEQ ID NO: 3918 - protein, 312 aa, Haemophilus influenzae
  Name: NTH2182
MDKDMQLIRGLHNANRVLQGCALTIGNFDGVHLGHQTVLRHLRQKADELNLPMAVLLFESQPREYFMGENAPARLMRLRDKIYYLEKAKVDVVIVAKFDRTFAEQPADVFIEQTLVNHLHVKFLSIGDDFKFGSKRQGNFAMLQAASKRFGFIVEDNRSFCLDAQRISSTAIREALANDDLQLAENLLGKPYRIFGRVIHGNKLGRTIGFPTANIRLHRQVNPIKGVYAVKVRLKSGEIFNGVANMGKRPTINGLMQLLEVHLFDFSQNIYGQMVEVEFCHKIRNEIKFPSFDDLKVQIEKDVETAKAFFNS

SEQ ID NO: 3919 - DNA, 1452 bp, Haemophilus influenzae
  Name: NTH2183
ttggaaaataaaatgacagtcgattacaaaaacactcttaacctaccggaaaccagctttccaatgcgcggtgatttagctaagcgcgaacctgatatgttgaaaaattggtacgagaaaaatctttaccaaaaaattcgtaaagcgagtaagggcaaaaaatcttttattctgcacgatggccctccgtatgcgaatggtaacattcatattggtcacgctgtaaacaagattctgaaagatattattattaaatccaaaacggcgttaggttttgattcgccttatatcccgggttgggactgccacggcttgccaattgaattaaaagtagaaggtttagtgggcaaaccaaacgagaaaatttctgcggctgaatttcgtcaaaaatgtcgtgaatatgcctcggaacaagtagaaggtcagaaaaaagactttatccgtttaggtgtgttgggcgattgggataatccatatctcacgatgaatttcgataccgaagcgaatattatccgcactttaggtaaagtgattgaaaatggtcatttgtataaaggctcaaaaccagttcactggtgtttggattgcggttcttctttagcagaagcagaagtggaatatgaagacaaagtttctccgtcaatttacgttcgtttccctgcggaaagtgcggttgaaattgaagctaaattttctgcacaaggtagaggacaaggtaaattatcagccatcatttggactaccacaccttggacgatgccgtctaaccgtgcgattgcggtgaatgcagacttagaatacaacttagtccaacttggcgatgagcgcgtgattttagctgctgaattagttgagtcagtggcaaaagcggtgggcgtagaacaagttgaaattctgggttctgtaaaaggtgctgatcttgaattaagccgtttccatcatccattctatgattttactgtaccagtaattttaggcgatcacgtaaccactgatggcggcacgggtttagtacataccgcacctgatcacggtttagacgactttatcgtgggtaaacaatatgatttaccaatggcgggtcttgtatcgaatgatggtaaatttatttcaacgaccgaattctttgcaggcaaaggcgtatttgaagcaaatccgcttgtgatagaaaaattacaagaagtaggtaacttattaaaagttgagaaaatcaaacacagctatccacactgctggcgtcacaaaacgccaattattttccgtgcaacaccgcaatggtttatcggcatggaaacgcaaggtttacgccaacaagcattaggcgaaatcaaacaagttcgctggattccagattggggtcaagcacgtatcgagaaaatggttgaaaaccgccccagactggtgtatttcacgccaacgtacttggggtgtgccgatgaccttgttcgtgca

SEQ ID NO: 3920 - protein, 484 aa, Haemophilus influenzae
  Name: NTH2183
LENKMTVDYKNTLNLPETSFPMRGDLAKREPDMLKNWYEKNLYQKIRKASKGKKSFILHDGPPYANGNIHIGHAVNKILKDIIIKSKTALGFDSPYIPGWDCHGLPIELKVEGLVGKPNEKISAAEFRQKCREYASEQVEGQKKDFIRLGVLGDWDNPYLTMNFDTEANIIRTLGKVIENGHLYKGSKPVHWCLDCGSSLAEAEVEYEDKVSPSIYVRFPAESAVEIEAKFSAQGRGQGKLSAIIWTTTPWTMPSNRAIAVNADLEYNLVQLGDERVILAAELVESVAKAVGVEQVEILGSVKGADLELSRFHHPFYDFTVPVILGDHVTTDGGTGLVHTAPDHGLDDFIVGKQYDLPMAGLVSNDGKFISTTEFFAGKGVFEANPLVIEKLQEVGNLLKVEKIKHSYPHCWRHKTPIIFRATPQWFIGMETQGLRQQALGEIKQVRWIPDWGQARIEKMVENRPRLVYFTPTYLGCADDLVRA

SEQ ID NO: 3921 - DNA, 1455 bp, Haemophilus influenzae
  Name: NTH2184
ttgaaaaccgccccagactggtgtatttcacgccaacgtacttggggtgtgccgatgaccttgttcgtgcataaagaaaccgaagaacttcatccgcgtaccttagagctacttgaagaagtggcgaaacgtgtagaaagagcgggtattcaagcgtggtgggatttagacgaaaaagaattattaggggcggatgcagaaacctatcgcaaagtgccagatacccttgacgtatggtttgactcaggatcaacctattcttctgttgttgcaaatcgcctagaatttaatggtcaagatattgatatgtatttagaaggttccgaccaacaccgtggctggtttatgtcttctttaatgctttctactgcaacaaacagcaaagcaccatacaagcaagtattaactcacggtttcactgtggatggtcaaggccgtaagatgtcaaaatctatcggtaacatagtgacgccacaagaagtcatggataaattcggtggtgatattttacgtttatgggttgcttcaacagactatacaggcgaaatgaccgtttctgatgagatcttaaaacgtgcagcggacagctatcgtcgtattcgtaacaccgctcgtttcttattagcaaacttgaatggttttgatccaaaacgtgatttagtcaaaccagaagaaatgattagcctagatcgttgggcggtagcttgtgcattagatgcacaaaatgaaattaaagatgcatacgataactatcaattccacactgtggtacaacgtttaatgcgtttctgttcggtagaaatggggtcattctatttagatattatcaaagatcgtcaatatacaaccaaagcagacagccttgcgcgtcgtagctgtcaaactgcgttatggcatattgctgaagcattagttcgttggatggcaccgatcttatctttcactgccgatgaaatttggcaacacttgccacaaactgaaagtgctcgtgcggaattcgtatttactgaagaattctatcaaggcttatttggtttaggcgaggatgaaaaattagatgatgcttactggcaacaactgattaaagttcgttcagaagtaaaccgtgtattagaaatttctcgtaacaataaagaaataggcggcggtttagaagcagaagtgaccgtttatgctaatgacgaatatcgtgcattgttagcacaattaggtaatgaattacgtttcgtattaattacctcaaaagtagatgtaaaatctttatcggaaaaacctgctgatttagcggacagcgaattagagggtattgcggtaagcgtaacacgttctaacgcagaaaaatgccctcgttgctggcattattctgacgaaattggggtaagcccaggacatccaacactttgtgcacgttgtgtagaaaatgtagtgggcaatggagaagttcgatactttgca

SEQ ID NO: 3922 - protein, 485 aa, Haemophilus influenzae
  Name: NTH2184
LKTAPDWCISRQRTWGVPMTLFVHKETEELHPRTLELLEEVAKRVERAGIQAWWDLDEKELLGADAETYRKVPDTLDVWFDSGSTYSSVVANRLEFNGQDIDMYLEGSDQHRGWFMSSLMLSTATNSKAPYKQVLTHGFTVDGQGRKMSKSIGNIVTPQEVMDKFGGDILRLWVASTDYTGEMTVSDEILKRAADSYRRIRNTARFLLANLNGFDPKRDLVKPEEMISLDRWAVACALDAQNEIKDAYDNYQFHTVVQRLMRFCSVEMGSFYLDIIKDRQYTTKADSLARRSCQTALWHIAEALVRWMAPILSFTADEIWQHLPQTESARAEFVFTEEFYQGLFGLGEDEKLDDAYWQQLIKVRSEVNRVLEISRNNKEIGGGLEAEVTVYANDEYRALLAQLGNELRFVLITSKVDVKSLSEKPADLADSELEGIAVSVTRSNAEKCPRCWHYSDEIGVSPGHPTLCARCVENVVGNGEVRYFA

SEQ ID NO: 3923 - DNA, 306 bp, Haemophilus influenzae
  n 297, 298, 299, 300, 301: n is any nucleotide
  Name: NTH2185
atggacaggttaattcgccgcactttttatagggagcaaacaatggcagaagaaacaatttttagtaaaattatccgtaaagaaattccggcaaatatcgtctatcaagatgaattagtcactgcatttcgtgatatttcccctcaagctaaaacacatattttgattattccaaataaagtcattcccacagtgaatgatgtgacggagcaagatgaagtagcgctaggtcgattatttagcgtagcggctaaactcgctaaagaagaaggcattgcggaagaggttggggtctcnnnnnttaat

SEQ ID NO: 3924 - protein, 102 aa, Haemophilus influenzae
  Xaa 100, 101: Xaa is any amino acid
  Name: NTH2185
MDRLIRRTFYREQTMAEETIFSKIIRKEIPANIVYQDELVTAFRDISPQAKTHILIIPNKVIPTVNDVTEQDEVALGRLFSVAAKLAKEEGIAEEVGVSXXN

SEQ ID NO: 3925 - DNA, 552 bp, Haemophilus influenzae
  Name: NTH2186
ttgccaataaattcttatgctttagtgacaaatttacataacaatcgtaaagttatcgtacgtattaatgatcgtgggccttttagtgataaacgtttaattgatctttcacacgctgcggcaaaagaaattggcttaatttcccgcggcatagggcaggtaagaattgaggcgttgcacgttgctaaaaatgggaatttatcaggtgcagccacaaaaacactggctaaacaagcaaaaactcaggaagctgccgatcgtttagtattaaaatctaacacgctttttgataacgcatctaagtcaataaatgctctaaaaggaaccgaattttactgtttgaaaatgcttgaattaacctctcatagccaagcaaataaattaattacgcagcttgcgttagcgaatattcagactgaagtaaatcgctcaggaaataaatatgaaatttatattgggccttttgatgacaaaacaaaaatggcacaagtgagaactaaattacaaaaaatggcaaataataagccattaattgtttatacgtataaaaat

SEQ ID NO: 3926 - protein, 184 aa, Haemophilus influenzae
  Name: NTH2186
LPINSYALVTNLHNNRKVIVRINDRGPFSDKRLIDLSHAAAKEIGLISRGIGQVRIEALHVAKNGNLSGAATKTLAKQAKTQEAADRLVLKSNTLFDNASKSINALKGTEFYCLKMLELTSHSQANKLITQLALANIQTEVNRSGNKYEIYIGPFDDKTKMAQVRTKLQKMANNKPLIVYTYKN

SEQ ID NO: 3927 - DNA, 1179 bp, Haemophilus influenzae
  n 117: n is any nucleotide
  Name: NTH2187
atgttgaaaagaacaacaaaaatcgcatttttatcaagttttgtggcacttagtgctttttcggtatctgcagaggatatgcagtttggcgtaactccaccacaaattacggctcanacgtatgtattgatggattataattcaggtgcaattttgaccgcacttaatccagatcaacgtcaatatccagcatcactgactaaaatgatgacaagttatgtagttggtgtcgcattaaaacaaggcaaaatccataataccgatatggttaccattggtgaaagtgcgtgggggcgtaatttccctgattcatcaaaaatgtttttagatttaaatacacaagtatctgtagcagatttaaatcgaggtgtgattgttgtttctggtaatgatgcgactgttgcattagctgaacatatttctggcaatgtaccgaactttgtagaaacaatgaataaatatgttcaacaatttggtttgaaaaatacaaatttcaccacgccccatggtttagacgatccaaatcaatattcttccgcgcgtgatatggcaattattggtgcgcatattattcgtgatttacctgaagaatataaaatttactccgaaaaagactttacatttaataaaatcaaacaagctaaccgtaatggactattatgggataaaactatcaatgttgatggaatgaagacagggcatactagccaagcaggatataacttagtcgcttcagcgactacatcaaacaatatgcgtttaatttctgtagtaatgggtgtgccaacttacaaaggtcgtgaagtagaaagtaagaaacttttacaatggggttttgctaatttcgaaacatttaaaactttagaggctggtaaagaaatttcagaacaaagggtttattatggcgataaaaattcagtaaaacttggtgctttaatggatcactttattacgatacctaaaggtaaacaaagtgaggttaaagctcgttatgaattagcagataaaaatttacaagcaccattagcaaaaggtcaagtgattggtaaagtggtttatcaactggatggtaaggatattgcaagtgccaatttacaagtgatgaatgatgtgggagaagcgggtatttttggtaaactatgggattggttagtattgactgtgaaagggttattctca

SEQ ID NO: 3928 - protein, 393 aa, Haemophilus influenzae
  Xaa 39: Xaa is any amino acid
  Name: NTH2187
MLKRTTKIAFLSSFVALSAFSVSAEDMQFGVTPPQITAXTYVLMDYNSGAILTALNPDQRQYPASLTKMMTSYVVGVALKQGKIHNTDMVTIGESAWGRNFPDSSKMFLDLNTQVSVADLNRGVIVVSGNDATVALAEHISGNVPNFVETMNKYVQQFGLKNTNFTTPHGLDDPNQYSSARDMAIIGAHIIRDLPEEYKIYSEKDFTFNKIKQANRNGLLWDKTINVDGMKTGHTSQAGYNLVASATTSNNMRLISVVMGVPTYKGREVESKKLLQWGFANFETFKTLEAGKEISEQRVYYGDKNSVKLGALMDHFITIPKGKQSEVKARYELADKNLQAPLAKGQVIGKVVYQLDGKDIASANLQVMNDVGEAGIFGKLWDWLVLTVKGLFS

SEQ ID NO: 3929 - DNA, 276 bp, Haemophilus influenzae
  Name: NTH2188
atgacaatagaaaacgattatgcaaaactcaaggaattaatggaatttccagcaaaaatgacttttaaagttgcgggaattaatcgagaagggttagcacaagatcttatacaagtggtgcaaaaatatattaaaggcgattatattccaaaagaaaagcgcagtagtaaaggcacttataattcagtttcaattgatattattgctgaaaactttgatcaggtagaaacactctataaagaactggctaaagttgaaggcgtgaaaatggttatt

SEQ ID NO: 3930 - protein, 92 aa, Haemophilus influenzae
  Name: NTH2188
MTIENDYAKLKELMEFPAKMTFKVAGINREGLAQDLIQVVQKYIKGDYIPKEKRSSKGTYNSVSIDIIAENFDQVETLYKELAKVEGVKMVI

SEQ ID NO: 3931 - DNA, 636 bp, Haemophilus influenzae
  Name: NTH2189
atgaacaattcccttatcgttcgtcagttaggattgcaagattatcaagaaatttggcacaaaatgcaggattttactgatactcgaaatgctgaaacgcaagacgaaatttggttagtacaacattatcctgtttttacccaagggcaagcaggtaaaccagagcatcttttacaacgtagtgaaatccctgtggtgcaatcggatcgtggtgggcaaattacctatcacgcacccggtcagcaagtgatgtatgtgcttattgacattaaacgccataaaaacttaaatgtgcgtcaattagttaccgcacttgaacaaacggtggttaaaactttggctgaatatggcattgaaagctatccaaagcctgatgcgccaggtgtttatgtggatggaaaaaagatttgttctcttggattacgtattcgtcgtggttgctcttttcacgggttggcattgaatattaatatggatcttaatcctttccattatattaatccttgtgggtatgcagggcttgaaatgtgtcagttagcggattttgttaatcaagatgaagctgattgcgataatgtttcagcaaaattaattaaacacttcgccgatcttttaggctataatataacaacttta

SEQ ID NO: 3932 - protein, 212 aa, Haemophilus influenzae
  Name: NTH2189
MNNSLIVRQLGLQDYQEIWHKMQDFTDTRNAETQDEIWLVQHYPVFTQGQAGKPEHLLQRSEIPVVQSDRGGQITYHAPGQQVMYVLIDIKRHKNLNVRQLVTALEQTVVKTLAEYGIESYPKPDAPGVYVDGKKICSLGLRIRRGCSFHGLALNINMDLNPFHYINPCGYAGLEMCQLADFVNQDEADCDNVSAKLIKHFADLLGYNITTL

SEQ ID NO: 3933 - DNA, 960 bp, Haemophilus influenzae
  Name: NTH2190
atgtctacgcctttcaaaatggaacgcggtgtaaaatatcgcgatgcggcaaaaacctcaattattcccgtaaaaaatatcgatcctaatcaagagttattaaaaaaaccagaatggatgaaaattaaacttccagcaagttcagctaaaattgaaagcattaaaaatggaatgcgccgtcacggattacattctgtttgtgaggaagcgtcttgtccaaatttacacgaatgttttaatcatggcacagccacttttatgattttaggtgcaatttgtacgcgccgttgcccattctgtgatgtggctcacggtaaaccattaccgcctgatcctgaagagccacaaaaattggcagaaacgattcaagatatgaaacttaaatatgtggtaatcacatcggtggatcgtgatgacttgcctgatcgtggtgctggtcatttttctgaatgtgtaaaagctgtgcgcgagcttaatcctaacattaagattgaaattttagtgcctgattttcgtggtcgcattacacaggctttagagaaattaaaagataatccgccagatgtctttaaccataatttagaaaacgtaccgcgcttatataaagaaattcgtccaggtgcggattacgaatggtcacttaaattattgcgtgaattcaaagaaatattcccaaatatcccaaccaaatctggtttaatggttgggttaggcgaaaccaacgaggaaattttgcaagtgatgcaagatttacgtgataacggtgtgactatgctcacgttgggtcaatatcttcaacctagccgccatcatttgcctgttgcccgttatgtgccgccaactgaatttgatgaattccgtgataaagccaatgaaatgggctttgaacatgcggcttgtgggccatttgttcgttcttcttatcacgctgatttacaagccagtggcggattagtgaaa

SEQ ID NO: 3934 - protein, 320 aa, Haemophilus influenzae
  Name: NTH2190
MSTPFKMERGVKYRDAAKTSIIPVKNIDPNQELLKKPEWMKIKLPASSAKIESIKNGMRRHGLHSVCEEASCPNLHECFNHGTATFMILGAICTRRCPFCDVAHGKPLPPDPEEPQKLAETIQDMKLKYVVITSVDRDDLPDRGAGHFSECVKAVRELNPNIKIEILVPDFRGRITQALEKLKDNPPDVFNHNLENVPRLYKEIRPGADYEWSLKLLREFKEIFPNIPTKSGLMVGLGETNEEILQVMQDLRDNGVTMLTLGQYLQPSRHHLPVARYVPPTEFDEFRDKANEMGFEHAACGPFVRSSYHADLQASGGLVK

SEQ ID NO: 3935 - DNA, 1005 bp, Haemophilus influenzae
  Name: NTH2191
atgcaatttgagcgaatttctactgaacaaaaaaaactttccctcattcagacatttttacatcaaaatgcgcttaaattagatgaacaaatcgagtattttgttgttggctataatgataacgaacaaatcgttgtctgtggcggtttagcaggcaatatcataaaatgtgttgcgattgatgagtctttgcgtggtagcggtgttgccttgcaattaattactgaattggttgatttagcttacacgctaaaacgcccacacctttttatttatacaaaacccgaatatgcaacgttgttcaaatcttgtggtttttatatcatctctgatgccaatccttatgtagtattgttagaaaatagtgctacgcgtttacaaaaacaatgctcattatgggagaaaatgcgtgtggatggtaatcgaattggctcgattgtaatgaacgcgaatccatttaccttaggtcatcgttatttaattgagcaagcattacaacaatgtgatcatctgcatttatttattgtcggtgaagacgcatcgcaattttcttacactgaacgatttgaaatgattcaacaaggtattttcgatttatccaatatcactcttcattctggctctgactatattatttctcgtgcaacatttccaaattatttcctaaaagatcaattaattacagatgaaagttattttgagattgatctgaagttattccgtttacatattgctcaagctttgggaataacacatcgctttgttggtactgagctaaattgtcccatcactgccgaatataatcgccaaatgcattattggttaatggatgccgaaatgaatgcaccaaaaataaatgttatcgagatacctagaaaaacagcaagcaaccacattatttctgcttctacagtacgaaagcatttggctgaaaaaaattgggctcaactcgcagagtttgtgcctatgactacgttaaattatttacaaaagtgcggtcgtttt

SEQ ID NO: 3936 - protein, 335 aa, Haemophilus influenzae
  Name: NTH2191
MQFERISTEQKKLSLIQTFLHQNALKLDEQIEYFVVGYNDNEQIVVCGGLAGNIIKCVAIDESLRGSGVALQLITELVDLAYTLKRPHLFIYTKPEYATLFKSCGFYIISDANPYVVLLENSATRLQKQCSLWEKMRVDGNRIGSIVMNANPFTLGHRYLIEQALQQCDHLHLFIVGEDASQFSYTERFEMIQQGIFDLSNITLHSGSDYIISRATFPNYFLKDQLITDESYFEIDLKLFRLHIAQALGITHRFVGTELNCPITAEYNRQMHYWLMDAEMNAPKINVIEIPRKTASNHIISASTVRKHLAEKNWAQLAEFVPMTTLNYLQKCGRF

SEQ ID NO: 3937 - DNA, 285 bp, Haemophilus influenzae
  Name: NTH2192
atgaaaataacaaaagtagccgttgcagggacactggaatccagtgatgttcaagtacgggttcaaccttttgattcactcgatattgaaatcaatagctcagtagcaaaacaatttggtgaacaaattgaagcgacagttcgtgaagtattagcaaaactaggcattacagcagcacaagtcattgtagaagacaaaggggcgttagattgcgtgttacaagctcgagtaaaagctgctgcaatgcgtgcaactgatgaaacgattaactgggaggctgtgcta

SEQ ID NO: 3938 - protein, 95 aa, Haemophilus influenzae
  Name: NTH2192
MKITKVAVAGTLESSDVQVRVQPFDSLDIEINSSVAKQFGEQIEATVREVLAKLGITAAQVIVEDKGALDCVLQARVKAAAMRATDETINWEAVL

SEQ ID NO: 3939 - DNA, 873 bp, Haemophilus influenzae
  Name: NTH2193
atgaaattaagaagaagtatgttatttgtgccgggctcaaatgccgccatgttgagtaatagctttatttataaaccagattccattatgtttgacttagaagatgcggttgcgctcaaagaaaaagattctgctcgtttattagtcgctcatgcacttcaacatccgctttataaagaaattgagaccgtagttcgtgttaatccgctagattctgaatttggtttattggatttgaattcggtagtgcgtgcgggtgtggatgtggtacgtatgccaaaaactgaaagcgcgcaagatgtgttggatatggatcacgccattactgagattgagaaagcctgcggtcgagaagcaggttcgactaaaatgctagcagccatcgaatcgccattaggtatcactcaagccaaccaaatcgctttcgcttctaaacgtttaattggtatcgcattgggtgcagaggattacgtacgtaacttaaaaaccgagcgttcaccagaggggattgaactgctttttgctcgttgttctattttacaagcggcacgtgcggctggcattcaggcttttgataccgtatattctaacgcgaacaatgaagaaggcttcttaaaagaggctgcgttaattaaacagcttggttttgacggtaaatccttaatcaacccacgccaaattgaattgttacacaacttatttgcaccgacacaaaaagacgtggagcaggcaaaacgcattattgaagcggcagcagaagctgaacgacaaggggctggtgttgtttcgttaaacggtaaaatgattgacgcaccgattattgatcgcgcaaaacttgtattagaacgtgcgaaatcaggtattcgtgaagag

SEQ ID NO: 3940 - protein, 291 aa, Haemophilus influenzae
  Name: NTH2193
MKLRRSMLFVPGSNAAMLSNSFIYKPDSIMFDLEDAVALKEKDSARLLVAHALQHPLYKEIETVVRVNPLDSEFGLLDLNSVVRAGVDVVRMPKTESAQDVLDMDHAITEIEKACGREAGSTKMLAAIESPLGITQANQIAFASKRLIGIALGAEDYVRNLKTERSPEGIELLFARCSILQAARAAGIQAFDTVYSNANNEEGFLKEAALIKQLGFDGKSLINPRQIELLHNLFAPTQKDVEQAKRIIEAAAEAERQGAGVVSLNGKMIDAPIIDRAKLVLERAKSGIREE

SEQ ID NO: 3941 - DNA, 1500 bp, Haemophilus influenzae
  Name: NTH2195
atgacaacaagagaacaacgtattgaaaaatatcacgctgatcgctcagtctatcaggcggtgcctaaatctgaatccctttctcgtacagcgaaagatcgcaaactttgtacctctctagaagaagcgattaaacgctctggcttaaaagatggtatgactgtttcatttcatcatgcttttcggggcggagattttgtggtgaatatggtgatgaataaaattgccgaaatgggtttcaaaaatctgacccttgcatcttcatctttaattgatagccacttcccgattgtcgaatatatcaaaaatggcgtggtcaccaaaatctattcttctggtttacgcggtgaacttgcagagcaaatctctcgtggtttattgaatgaacctgtaaatattcattctcatggtggacgtgttcacttagtaaaatctggcgaattaaaaattgacgttgcttttttaggcgtgccttgctgtgacacattcggtaatgccaatggatttactggaaaaagtaaatgcggctctctaggctatgcgcgtgtcgatgctgaatatgctgaccaagttgtgttgctcacagaggaatttgttgaatacccgcactacccaatcagcatagctcaagatcaagtagatttaatcgtgcaagttgaagcagtcggtgacccgaaaaaaattggtggtggtgcaacccgaatgactaccaatccacgcgaattactcattgcgcgtaaatgtgcagaagtaatttttgccagtggttattttaaagatggcttctcattacaaactggttctgggggggcagcattagctgttacacgctttctagaagaaaaaatgcgtcgtgaaaatatcactgcagatttcgcacttggcggaattactgcaagtatggtggcattacatgagactggtcttattaaaaaattattagatgtacaaagctttgattctgttgcagctgaatcacttgcccgtaacccaaatcatattgaagtctccgctaaccaatatgcgaattacagttccaaaggcgcatctgttgaacgtttagatatggtgattctttctgctttagaaatcgacactaaatttaacgtgaatgtattgactggctctgacggtgtgattcgcggtgcatctggtggtcattgtgataccgcagcttctgcacaagtagcaatcattgtggcaccattagttcgtggtcgtattccaaccgtggtggaaaacgtgattacctgtgtaacacctggtgaaaacgtcgatattctcgttaccgatcatggtgtagcagtaaatcctaaacgtccagatttgattgaagctttaagcaaaacagacattccattgtttactattgaacaactttgtgaacgtgcttacagcattactggtaaaccaaaagaaattgagtttactaataaacctgtggctgttgttcgttatcgtgatggttcggtgattgatacggtgtatcaagttaaagac

SEQ ID NO: 3942 - protein, 500 aa, Haemophilus influenzae
  Name: NTH2195
MTTREQRIEKYHADRSVYQAVPKSESLSRTAKDRKLCTSLEEAIKRSGLKDGMTVSFHHAFRGGDFVVNMVMNKIAEMGFKNLTLASSSLIDSHFPIVEYIKNGVVTKIYSSGLRGELAEQISRGLLNEPVNIHSHGGRVHLVKSGELKIDVAFLGVPCCDTFGNANGFTGKSKCGSLGYARVDAEYADQVVLLTEEFVEYPHYPISIAQDQVDLIVQVEAVGDPKKIGGGATRMTTNPRELLIARKCAEVIFASGYFKDGFSLQTGSGGAALAVTRFLEEKMRRENITADFALGGITASMVALHETGLIKKLLDVQSFDSVAAESLARNPNHIEVSANQYANYSSKGASVERLDMVILSALEIDTKFNVNVLTGSDGVIRGASGGHCDTAASAQVAIIVAPLVRGRIPTVVENVITCVTPGENVDILVTDHGVAVNPKRPDLIEALSKTDIPLFTIEQLCERAYSITGKPKEIEFTNKPVAVVRYRDGSVIDTVYQVKD

SEQ ID NO: 3943 - DNA, 1248 bp, Haemophilus influenzae
  n 1239, 1240, 1241, 1242, 1243: n is any nucleotide
  Name: NTH2196
ttgcagcatttttttacgacattctctacaaagggttcagaaatttcacttgaagcattacttaatgctcgagaggaacgtgcaattttacaacaacagcttataacacaatatggacaaaccttactttgcatcactttaactgctgtgggtggagtaaaaaaaaatgctttgttggattatgtttttagaaaagctctagaaaatctgaccgcactttttactcagttaaacattacagcagtaaaagaaataatccgtccgttagaaacggggcatgaagcctattttgtattaccgatagatgctcgtacgctaaaagtgctgatgattgaattggaagaaagcattcctcttgctcgtttgtgggatttagatgtgtttaatgctaaaggcaatctactgagtcgtacagattttgatctttctccaagaacttgtttagtgtgcggagaaaatgcaaaaatctgtgcgagaacccgcaagcacgagattgatgagattgtagataaaattcaatctctcgcacagaagcatgatttcgcagaacatattggtgaacaagtttatctggcattaatacaagaggctcgcttatcgccaaaacctggtttagtggatgccatcaataacggttcgcacaaagatatgaacctacatacttttgagcaaagtgcgattagtttaaaacctttttttacgcagtttgttctcaaaggcatgatgaccgcgcatttgtctgaaaatcaaattctcgctgaaattcgtcctttaggtttattagcagaaaaagcaatgtttaaagttactgatggcgtaaacacccacaaaggtgctattttttcttttggtttagtgtgtacggcaattggacgattattggcacaaaaaagtttggttcaaagtgcggtagattttgatgttaaattaatctgctcacttgttgcacaatttactcaaggtttaacggatgaactgaaaaattatcctgaacacttgcctagtacggctggagtgcgtttattccaaaaatatggcttaacaggtgtccgtggcgaagcagaaaatggttttaatctcattcaaacgttgttgccacaatttgatgagtaccatcagttagaatgggaacatcgtttactgattttgttgttgaatttaatggcaattaactccgacactaacgtggttctcgagtggttagcgggatactttctagggacgagccgaatcgaacannnnnttaat

SEQ ID NO: 3944 - protein, 416 aa, Haemophilus influenzae
  Xaa 413, 414, 415: Xaa is any amino acid
  Name: NTH2196
LQHFFTTFSTKGSEISLEALLNAREERAILQQQLITQYGQTLLCITLTAVGGVKKNALLDYVFRKALENLTALFTQLNITAVKEIIRPLETGHEAYFVLPIDARTLKVLMIELEESIPLARLWDLDVFNAKGNLLSRTDFDLSPRTCLVCGENAKICARTRKHEIDEIVDKIQSLAQKHDFAEHIGEQVYLALIQEARLSPKPGLVDAINNGSHKDMNLHTFEQSAISLKPFFTQFVLKGMMTAHLSENQILAEIRPLGLLAEKAMFKVTDGVNTHKGAIFSFGLVCTAIGRLLAQKSLVQSAVDFDVKLICSLVAQFTQGLTDELKNYPEHLPSTAGVRLFQKYGLTGVRGEAENGFNLIQTLLPQFDEYHQLEWEHRLLILLLNLMAINSDTNVVLEWLAGYFLGTSRIEXXXN

SEQ ID NO: 3945 - DNA, 468 bp, Haemophilus influenzae
  n 459, 460, 461, 462, 463: n is any nucleotide
  Name: NTH2197
gtggagacgtcggggcattacttatccattgacagcaatgcaattgttaaaacaaaagagtggctactggaccctgataatgtaacaattgaagctcctagcctttctcgcgctgacactgacattagttcagaatttccaatcggtgacggtactgaaaacagccctaaaaaaaacgccgacaaaacaatactgaccaatgaaaccatttcaaattttctgcaaaatgccaaagtgatgaacataacggcaaagagaaaacttaccgttaatagctcaatcagtatcggaagtagatcccacttaattctccatagtgaaggtcagggggacggaggcgttcagattgatggagatattacttctgaaggcggaaatttaaccattaactccggcggatgggttgacgttcataaaaatattacgcttggtacgggttttttaaatattaccgctggnnnnnttaat

SEQ ID NO: 3946 - protein, 156 aa, Haemophilus influenzae
  Xaa 154, 155: Xaa is any amino acid
  Name: NTH2197
VETSGHYLSIDSNAIVKTKEWLLDPDNVTIEAPSLSRADTDISSEFPIGDGTENSPKKNADKTILTNETISNFLQNAKVMNITAKRKLTVNSSISIGSRSHLILHSEGQGDGGVQIDGDITSEGGNLTINSGGWVDVHKNITLGTGFLNITAGXXN

SEQ ID NO: 3947 - DNA, 162 bp, Haemophilus influenzae
  Name: NTH2198
gtgatttccgctcaaaatcagcaagccaaaggtggtaagttgatgattacaggcgataaagttacattaaaaacgggtgcagttatcgaccttcaggtaaaggagggggagagacctatcttggcggcgacgagcgcggcgaaggtaaaaacggcattcaat

SEQ ID NO: 3948 - protein, 54 aa, Haemophilus influenzae
  Name: NTH2198
VISAQNQQAKGGKLMITGDKVTLKTGAVIDLQVKEGERPILAATSAAKVKTAFN

SEQ ID NO: 3949 - DNA, 237 bp, Haemophilus influenzae
  Name: NTH2199
ttgctgattttgagcggaaatcacaccgctaatttctgcttcaccctctttggcggaaagaataatgttgccgcttttatctttgcttacagaatcggcagaaagtttacctttattgcgaatagtggcggcgcggacattgatgttaccacctttggcaaaaatatcgcccagattgattgcttcattttcaggggcagcaatgctgtaagtaatgggttgggtttattatgtcgc

SEQ ID NO: 3950 - protein, 79 aa, Haemophilus influenzae
  Name: NTH2199
LLILSGNHTANFCFTLFGGKNNVAAFIFAYRIGRKFTFIANSGGADIDVTTFGKNIAQIDCFIFRGSNAVSNGLGLLCR

SEQ ID NO: 3951 - DNA, 768 bp, Haemophilus influenzae
  Name: NTH2200
atgaacaagatatatcgtctcaaattcagcaaacgcctgaatgctttggttgctgtgtctgaattgacacggggttgtgaccattccacagaaaaaggcagtgaaaaacctgttcgtacaaaagtacgccacttagcgttaaagccactttccgctatattgctatctttgggcatggcatccattccgcaatctgttttagcgagcggtttacagggaatgagcgtcgtacacggtacagcaaccatgcaagtagacggcaataaaaccaccatccgcaatagtgtcaatgctatcattaattggaaacaatttaacattgaccaaaatgaaatggtgcagtttttacaagaaaacaacaactccgccgtattcaaccgtgttacatctgaccagatttcccaattaaaagggattttagattctaacggacaggtctttttaatcaacccaaatggtatcacaataggtaaagaagcaattattaacactaatggctttactgcttctacgctagacatttctaacgaaaacatcaaggcgcgtaatttcacccttgaacaaaccaaggataaagcactcgctgaaatcgtgaatcacggtttaattaccgttggtaaagacggtagcgtaaaccttattggcggcaaagtaaaaaatgagggtgtaattagcgtaaatggcggtagcatttctttacttgcagggcaaaaaataaccatcagcgacataataaacccaacccattacttacagcattgctgcccc

SEQ ID NO: 3952 - protein, 256 aa, Haemophilus influenzae
  Name: NTH2200
MNKIYRLKFSKRLNALVAVSELTRGCDHSTEKGSEKPVRTKVRHLALKPLSAILLSLGMASIPQSVLASGLQGMSVVHGTATMQVDGNKTTIRNSVNAIINWKQFNIDQNEMVQFLQENNNSAVFNRVTSDQISQLKGILDSNGQVFLINPNGITIGKEAIINTNGFTASTLDISNENIKARNFTLEQTKDKALAEIVNHGLITVGKDGSVNLIGGKVKNEGVISVNGGSISLLAGQKITISDIINPTHYLQHCCP

SEQ ID NO: 3953 - DNA, 1044 bp, Haemophilus influenzae
  Name: NTH2201
atgctacaagaaattgaattaaaattggcgatttcgccacaaataggtattgaattgccacaatatcttgcaaaatttacgattttagaacatcaaaatttatttttgggtaacacctattatgattatcccgatcattttcttgctaaacaaaaaatgggattacgtattcgccaagaagagcaagaacttacattaacgcttaaaaccaacggtaaagttgttggtggattgcatagtcgtccagaatataatttactattaaccgaaaaagaaacgccaaccaatgcccaattaagagagctttatccttttgaacaattacctcgttcttcactacaacctattttctccacagattttaaccgcactttttggttagttgaatttcaacaatccaaaattgaagtggcgttcgatcaaggcaaaattattgcaggcgaatctgagcaaccgatttgtgaaattgagtttgaattgaaatctggcaacgtgcaggatctttttgattttgtagaaaccttgccttttgaaagggatatttattttaatagtggaagtaaagcgaagcgaggttatttgctgggctcaaaacaatttttaacagattggttaaataaatggcgtgatttcttaaaagaagaacgagaagaaagtgcggtagatttttgtgtaaaatttaattccgtgttgaaaatggaacagaaacttttggaagaaaccttatccttttctcccgcactttttagccaagattttatgaaaacagtagagcgagttggggtattttttaatctttatcattattatgatgaaaatggaaaaatcctagaagcggtggcaacagagaaacaaaaagaaacgctattgctagctttgttagaaagcaatcagaaaatctttgctgaaattcgtgacttgattcgttttcatagtgaaaccaaagacaatgaaaaaactattgaaaaattgaccgcacttttgaaaagtcgagtttattttaagcgaatgatcaaattaatggaattatcttatgacctaggg

SEQ ID NO: 3954 - protein, 348 aa, Haemophilus influenzae
  Name: NTH2201
MLQEIELKLAISPQIGIELPQYLAKFTILEHQNLFLGNTYYDYPDHFLAKQKMGLRIRQEEQELTLTLKTNGKVVGGLHSRPEYNLLLTEKETPTNAQLRELYPFEQLPRSSLQPIFSTDFNRTFWLVEFQQSKIEVAFDQGKIIAGESEQPICEIEFELKSGNVQDLFDFVETLPFERDIYFNSGSKAKRGYLLGSKQFLTDWLNKWRDFLKEEREESAVDFCVKFNSVLKMEQKLLEETLSFSPALFSQDFMKTVERVGVFFNLYHYYDENGKILEAVATEKQKETLLLALLESNQKIFAEIRDLIRFHSETKDNEKTIEKLTALLKSRVYFKRMIKLMELSYDLG

SEQ ID NO: 3955 - DNA, 1374 bp, Haemophilus influenzae
  Name: NTH2202
atggctaaagccccgaaaacagcttatgtatgtaacgattgtggtgcagagttttctcgttggcaagggcaatgttcggcttgtaaagcgtggaatacaatcacggaagtgcggttaatttccacggcaaaatcaaaaaatgatcgttttagtggctatgcgggggaaactcaggcaaaaattcaaaccctttctgaaattagtttgcaagaaacaccacgtttttccagtggctttaatgaattagatcgggtattgggcggcgggatcgtaccgggcagtgcgattttaattggtgggcatcctggtgcagggaaaagtaccttgttattacaagttatgtgtggtttggcgaaaaatatgaccgcactttatgtgacgggagaggaatcgttacaacaggttgcgatgcgtgctagtcgattgggattgccaaacgatcaattaaaaatgttgtcagaaacctctgtggaacagatttgtaatttgtcggatcagttaaaaccgcaaattatcgtggtggattctatccaagtaatgcatttggcagatattcaatcatcgccaggcagtgtagctcaagtgcgtgaatgtgcttctttcctcactcgttatgcgaaaactcgccaagtggcgattattatggttggacacgttacgaaagacggaacccttgcagggcctaaagtgttagagcatgccattgactgttcattattattagaaggcgaagccgattctcgttatcgtactttgcgtagccataaaaaccgttttggtgcagtcaatgaattaggtgtatttggaatgacagagcagggtttgcgcgaagtgaaaaatccatcggcgatttttttaagtcgcggagatgaaattacgtcaggcagttctgttatggtactttgggagggtactcgtcctcttttagtggaaattcaagccttggtggatcattcaatgctggcaaatcctcgccgtgttgcggtgggattagagcaaaatcgtttgtcgttgttattggcggttttacatagacacggaggtttgcaaatggcggatcaagatgtctttgtaaatgtcgttggtggtgtaaaagttagtgaaacaagtgcggatttagccttattgcttgcgttaatttctagtttccgtaatcgccctttgccacaagatttagtgatctttggtgaggttggattagcgggagaaattcgtccagtaccaagtggacaggaacgtattagcgaggctgcaaaacacggttttaaacgcgccatagttcctttcggcaataagccgaaaagtgcggtcgaaaatatgcaggtttttactgtgaaaaaactcacagatgcgctcgctgtgttagataattta

SEQ ID NO: 3956 - protein, 458 aa, Haemophilus influenzae
  Name: NTH2202
MAKAPKTAYVCNDCGAEFSRWQGQCSACKAWNTITEVRLISTAKSKNDRFSGYAGETQAKIQTLSEISLQETPRFSSGFNELDRVLGGGIVPGSAILIGGHPGAGKSTLLLQVMCGLAKNMTALYVTGEESLQQVAMRASRLGLPNDQLKMLSETSVEQICNLSDQLKPQIIVVDSIQVMHLADIQSSPGSVAQVRECASFLTRYAKTRQVAIIMVGHVTKDGTLAGPKVLEHAIDCSLLLEGEADSRYRTLRSHKNRFGAVNELGVFGMTEQGLREVKNPSAIFLSRGDEITSGSSVMVLWEGTRPLLVEIQALVDHSMLANPRRVAVGLEQNRLSLLLAVLHRHGGLQMADQDVFVNVVGGVKVSETSADLALLLALISSFRNRPLPQDLVIFGEVGLAGEIRPVPSGQERISEAAKHGFKRAIVPFGNKPKSAVENMQVFTVKKLTDALAVLDNL

SEQ ID NO: 3957 - DNA, 498 bp, Haemophilus influenzae
  Name: NTH2204
atgtgcaaagaaataaagaaaatggaaaaaaaacgaaataaagcattggatgcgatagatataaaaattctgaatgaattacaacgcaacggtaaaatttccaatatcgatttgtcgagaaaagtggggctttcgccaacgccttgtttagaacgcgttaaacgtttggaaaaacaaggtgtgattatggggtatcgcgcactgttaaatccagaattattggatgcaccattgctagtaattgttgaaattacattagtacgaggtaagcccgatgtgtttgaagaatttaatgcggcgattcaagagttagatgaaattcaagaatgccatttggtatcgggcgattttgattatttattaaaaactcgtgtggcagatatggctgaataccgaaaattgctggggacgacattattgcgtttaccaggtgtaaatgacactcgcacttatgttgtgatggaagaagtaaaacaaaccaatttccttgtattgaaa

SEQ ID NO: 3958 - protein, 166 aa, Haemophilus influenzae
  Name: NTH2204
MCKEIKKMEKKRNKALDAIDIKILNELQRNGKISNIDLSRKVGLSPTPCLERVKRLEKQGVIMGYRALLNPELLDAPLLVIVEITLVRGKPDVFEEFNAAIQELDEIQECHLVSGDFDYLLKTRVADMAEYRKLLGTTLLRLPGVNDTRTYVVMEEVKQTNFLVLK

SEQ ID NO: 3959 - DNA, 1662 bp, Haemophilus influenzae
  n 1637, 1649, 1650, 1651, 1652, 1653: n is any nucleotide
  Name: NTH2205
atgattaaacaaattacagaacgatttacgccaagacagtatttagctgaatttttgctaggattgaccgcactttttggattttatttgattgttgcttggtcaagttatacgccccttgataattcttgggctacagccagcgcgtatggaaacacaattaataaagtggggacatttggagcgtggataatcgatcttttttttgttttttttggctatgtcgcccatattattcctttcaccgcttttctcgtgcctatttatttattgaaaacaaaagcagttaaacagctttcctgtactcgaattattttacgtagttttggctttaccatgctgattattgggctttgtgtagtgagtatgttgcttttatcaagtaatactttttatttgagtggcggcgtattgggcggatcgcttgttgtaaattggttttatcctgtattaggtaaatttggttcaattttaattggttttgtgcttgctttaattggttttattttttgttctggcgcatcattaattcgattaattgttgcattttatcattggctaacaatgaaaaatgagcaatcagaaaatgctgagcaagaaaaatcaacggaagaattagagcaaattgtgattgtaaaatcagatcgttcagaaacagaaaatctagatcaaaatcatctcaatgtagaacaaaatagtgagattgaaactcaaaaatcatctttagaggcagaagaaagctcagttgagcaaccttcgcatttaattaatattcatggtttaaatccagaggtttctataaaatcagaatatgaactcgctaacgaagatagtgaaaaaccgcaattttcttttgggtttgattctgaaagcttgcctagtgtgaatttatcgagtgattcagatgaacaaagagtgagtaaaaatgattttgtagtagtttggaataagcctgtaaaaacagttgttcaagaagatctagcaattaatcaaagtgcggatgattttacgcaagtttctttgctgacaaatgatgaaatgccaacagtttcattaaaatcaacctctgatactgaaatggcagataatcattttgctgctcaagttgatgaaaaggtagatttagaaaaagatgaagtgaaatttagcgtatctttacagaataatgtgggcgtaattgaattagacaaaaatcaagagcctaattataaaggttacagtggtagtttgattcatcctgcatttcaacagcaaacaacaaaacgtgaaaaaccgagtacaccattacctagtttggatttgcttttaaaatatccgccaaatgaacaacgtattacaccagatgaaataatggaaacctcacagcgtattgaacaacaattacgcaattttaatgtgaaagccagcgtaaaagatgtgcttgttggccctgttgttacgcgttatgaattagaattacagcccggtgtgaaagcatcaaaagttacgagcatcgataccgatttagcaagagcattgatgtttcgttctattcgcgtggcagaggttattccaggtaaaccttatattggtattgaaaccccaaatcttcatcgtcaaatggtgccattacgtgatgtattagatagcaatgaatnccgtgatagcannnnnttaattaat

SEQ ID NO: 3960 - protein, 554 aa, Haemophilus influenzae
  Xaa 546, 550, 551: Xaa is any amino acid
  Name: NTH2205
MIKQITERFTPRQYLAEFLLGLTALFGFYLIVAWSSYTPLDNSWATASAYGNTINKVGTFGAWIIDLFFVFFGYVAHIIPFTAFLVPIYLLKTKAVKQLSCTRIILRSFGFTMLIIGLCVVSMLLLSSNTFYLSGGVLGGSLVVNWFYPVLGKFGSILIGFVLALIGFIFCSGASLIRLIVAFYHWLTMKNEQSENAEQEKSTEELEQIVIVKSDRSETENLDQNHLNVEQNSEIETQKSSLEAEESSVEQPSHLINIHGLNPEVSIKSEYELANEDSEKPQFSFGFDSESLPSVNLSSDSDEQRVSKNDFVVVWNKPVKTVVQEDLAINQSADDFTQVSLLTNDEMPTVSLKSTSDTEMADNHFAAQVDEKVDLEKDEVKFSVSLQNNVGVIELDKNQEPNYKGYSGSLIHPAFQQQTTKREKPSTPLPSLDLLLKYPPNEQRITPDEIMETSQRIEQQLRNFNVKASVKDVLVGPVVTRYELELQPGVKASKVTSIDTDLARALMFRSIRVAEVIPGKPYIGIETPNLHRQMVPLRDVLDSNEXRDSXXLIN

SEQ ID NO: 3961 - DNA, 99 bp, Haemophilus influenzae
  Name: NTH2206
atggatcaattctcttattctacagatctcagtgcacaaatgcgtgataaatcatctattacggcaacacgaaatccaaatggagggggaatttatgag

SEQ ID NO: 3962 - protein, 33 aa, Haemophilus influenzae
  Name: NTH2206
MDQFSYSTDLSAQMRDKSSITATRNPNGGGIYE

SEQ ID NO: 3963 - DNA, 435 bp, Haemophilus influenzae
  Name: NTH2207
atggagggggaatttatgagtaatttctttaattctttattttctgataaaggagaaattaaaggtattgataatcaatattctgtatctgaaatcgtagatattcttaaggaagaaggttattctattaatgtaatacaagataattttttggtgtttagattacaaggtacgaatgttgtagttgttccccatgatggaggtgatattcaattttttatcatgtatgacgatgatgagaaccgcttttcattaagaaaagtgaataaaataaatattgattatagactcggaaaattttatttaacagatgatgataaattaggaatcgagcttcttttgcgcaatgatggtaatggtgtaactaagtctcaaattattcaaggactatcagatatttctttattaaatggattagctaagaaagaattttgg

SEQ ID NO: 3964 - protein, 145 aa, Haemophilus influenzae
  Name: NTH2207
MEGEFMSNFFNSLFSDKGEIKGIDNQYSVSEIVDILKEEGYSINVIQDNFLVFRLQGTNVVVVPHDGGDIQFFIMYDDDENRFSLRKVNKINIDYRLGKFYLTDDDKLGIELLLRNDGNGVTKSQIIQGLSDISLLNGLAKKEFW

SEQ ID NO: 3965 - DNA, 507 bp, Haemophilus influenzae
  Name: NTH2208
atgaccgcacttaatgtattaatttatcctgatgatcacttaaaggttgtctgtgagcctgttactgaagttaatgatgcaattcgtaaaattgttgatgatatgtttgatacgatgtatcaagagaaaggtattggtttagctgcacctcaggtggatattttgcaacgtattattactattgatgttgaaggcgataaacagaatcagtttgttttgattaaccctgaaattttggcttcagaaggcgaaacgggaattgaagaggggtgtttatccattccagggttccgtgcgttggttcctcgtaaagaaaaagtgacagtgagagcgttagatcgtgatggtaaagaatttactttagatgcggatggtttgcttgcgatctgtattcagcacgagatcgatcatcttaatggaattttatttgttgattatctttctccacttaaacgccaacgtattaaagaaaagttgattaaatacaagaagcagattgcgaaaagc

SEQ ID NO: 3966 - protein, 169 aa, Haemophilus influenzae
  Name: NTH2208
MTALNVLIYPDDHLKVVCEPVTEVNDAIRKIVDDMFDTMYQEKGIGLAAPQVDILQRIITIDVEGDKQNQFVLINPEILASEGETGIEEGCLSIPGFRALVPRKEKVTVRALDRDGKEFTLDADGLLAICIQHEIDHLNGILFVDYLSPLKRQRIKEKLIKYKKQIAKS

SEQ ID NO: 3967 - DNA, 954 bp, Haemophilus influenzae
  Name: NTH2209
atgaaatcacttaatattatttttgcgggtacgccagattttgctgcacagcatttacaagccattctaaattctcaacataacgtgatcgctgtttatacgcaatctgataaaccagctggtcgcggtaagaaattgcaagcaagtcctgtcaagcaacttgctgagcaaaataacattcccgtttatcaacctaaatccttacgtaaagaagaagcacagtctgaattaaaagcgttaaatgcagatgtaatggttgttgtcgcttatggattaattttaccgaaagctgtattagatgcccctcgtttaggttgtttgaatgtgcatggttctattcttccacgttggcgaggtgcagcaccaattcagcgttcaatttgggctggcgatgtacaaacgggtgtaaccattatgcaaatggatgaaggtttagatacaggcgatatgttacataaagtctattgtgatattttaccgactgaaacttcaacgagtctttataacaaactggcagagcttgctccatcagtattaatcgatgttttagataatcttgaaaacagtaaatttatagcggaaaaacaagatggcagccaaagtaattatgcagaaaaactttccaaagaagaggcacaattagattggtcacttcctgcaatgcaacttgagcgtaatatccgcgcttttaatccttggccaattgcctatttttcaacagaagacaaggatggcaatgcacaaactttaaaagtgtatcaagcggaagtgttgcctcatcaagataaaccagcgggaactattttaagtgcggataaaaatggcattcaaattgcgactgtcgatggcgtcttaaacttattgcaattacaacctgcaggtaaaaagcctatgtctgcacaagatttattaaatggccgtgcagaatggtttactattggtaaggtgcttgca

SEQ ID NO: 3968 - protein, 318 aa, Haemophilus influenzae
  Name: NTH2209
MKSLNIIFAGTPDFAAQHLQAILNSQHNVIAVYTQSDKPAGRGKKLQASPVKQLAEQNNIPVYQPKSLRKEEAQSELKALNADVMVVVAYGLILPKAVLDAPRLGCLNVHGSILPRWRGAAPIQRSIWAGDVQTGVTIMQMDEGLDTGDMLHKVYCDILPTETSTSLYNKLAELAPSVLIDVLDNLENSKFIAEKQDGSQSNYAEKLSKEEAQLDWSLPAMQLERNIRAFNPWPIAYFSTEDKDGNAQTLKVYQAEVLPHQDKPAGTILSADKNGIQIATVDGVLNLLQLQPAGKKPMSAQDLLNGRAEWFTIGKVLA

SEQ ID NO: 3969 - DNA, 1350 bp, Haemophilus influenzae
  Name: NTH2211
atgaaaaaattttcttctaaaactatcaaagtaaaaaattcagtaaaaatgaccgcactttcgaccagggctattgcagcaaacttaattttgcaagcattggatgaaggtaaatccttgtcggcgttaattccagaagtgcaactttctgtaaaagcccaagatttgcccttgctacaagaaatttgttttggcgtgtgtcgagtattgcctcgcttagagcaaattatcaaacgtcttgtggataagccgcttaaaggtaaaactcgcattgttcattgcctgttacttgtagggttataccaattgctttatatgcgagtgcctgctcatgcggcagttgatgaagttgtgaacgcaacaaaatcattaaaatctgatagttttagaggattagtgaatgcggttttgcgtagatttttacgtgaacaagatgaaattttggcaattatcgataaaaattggcaaacgcttcatcctgaatggttcgtgaataaattaaaaaaagcctatccgaattggcgtgagatcattgaggcgaacaatcagaaaccaccaatgtggctacgtgtgaattcacaaaaaaatgccctcgaaacttaccgcactttacttgaggaacaaggtatttctgcaaaaacaagtcaccatcctaatgcgctatgtttagatataccgattgcggtgcaaaaattaccgcactttgaagaaggtgctgtaacggtacaagatttgagtgcgcaatgggcggcaatgttgcttgagcctaaaaatgaggaatggatccttgatgcttgcgctgcacccggtggtaagacgacccatattttagaactggcacctcaagctaatgtgattgcattagatgtagaatctcatcgcttaaaacgagtagaagaaaatcttgcacgtttaaatcagcaagcgatagtggtttgcggcgatgcgagtaaacctgacgaatggttagctgaaattggtaaaagtgcggtgaaatttgaccgaattttacttgatgcaccttgttctgctacaggggtaattcgacgccaccccgatataaaatggttacgcaaagaaaccgatatcgctcagcttgtcgaattacagaagaaaatcctgagtgcactttgggaaaaactgaagccaaacggtgttttgctttatgcgacttgttctgtattgccagaagaaaattgcgaacaaatccaagcatttttaaatgctcacgcagatgcggagttattgccattacctgttagtgatgataaaagtgcggtgggttttcaattcattccgcaaccaaatagtggcgatgggttctattatgctaaattgcttaaacgagca

SEQ ID NO: 3970 - protein, 450 aa, Haemophilus influenzae
  Name: NTH2211
MKKFSSKTIKVKNSVKMTALSTRAIAANLILQALDEGKSLSALIPEVQLSVKAQDLPLLQEICFGVCRVLPRLEQIIKRLVDKPLKGKTRIVHCLLLVGLYQLLYMRVPAHAAVDEVVNATKSLKSDSFRGLVNAVLRRFLREQDEILAIIDKNWQTLHPEWFVNKLKKAYPNWREIIEANNQKPPMWLRVNSQKNALETYRTLLEEQGISAKTSHHPNALCLDIPIAVQKLPHFEEGAVTVQDLSAQWAAMLLEPKNEEWILDACAAPGGKTTHILELAPQANVIALDVESHRLKRVEENLARLNQQAIVVCGDASKPDEWLAEIGKSAVKFDRILLDAPCSATGVIRRHPDIKWLRKETDIAQLVELQKKILSALWEKLKPNGVLLYATCSVLPEENCEQIQAFLNAHADAELLPLPVSDDKSAVGFQFIPQPNSGDGFYYAKLLKRA

SEQ ID NO: 3971 - DNA, 1374 bp, Haemophilus influenzae
  Name: NTH2212
atgaaaatcatcattttgggtgcaggtcaggtaggaacgacgcttgcagaaaacttagtcagtgaagataacgatattaccttagtggataatgaatctcctcagttacaaacattgcaagaaaagcacgatttgcgtgtggtacaaggctctccatcatctccaaaagtgcttcgtgacgcaggcgcggcagatgccgatttaatggttgccgtgacagcctccgatgaaatcaatatggtcgcttgccaaatgggctatacattatttaatacgccaacgcgaattgcacgtatccgtaattcagaatatttacgtgaaaaagacaagttgttcaacaatgaaaatatacctattgatcatttaatttcgcctgaaaatcttgtcactgatgaaattacgcgtttaattgcttatccaggcgcattacaagttgcccattttgccaataatcgtattagtattgttgtagtgaaagcttattatgggggggctttggttggatatgcactttccgcatttcgcgaacatatgccacatattgattgtcgtattatgtctattttacgtaatggcaaaccgattcgtccacaaggctcaaccattgtagaagctggcgatgaaatcacgtttatttgcgctactgaacatattaaggcggtaatgggagagttacaacgtttggagaaaccttataagcgagtaatgattgttggtggaggaaatgttgcttttggcgtagcaaaacgtttggaaaattcttgtactgtaaagcttattgaacgagattcaaacagagcgcaagccttagcagaaaagttgccaaaaacgttagtatttaatggagatgcctcagaccaaaacttgctttttgaagaacatattgaaagtgtggatgtatttctttcattaagtagcgacgatgaagcgaatattatgtcagctttgttagccaagcgtttaggtgcgaaaaaagcaatggtactgattcaacggattgcttatattaatcttattcagggaggcacgattgatattgcggtttctccacaacaagtaacgatttctgctttgttaggtcacgtgcgtaaaggcgatgtaaaaaatgtggcaacattacgacatggcattgccgaagccattgaaattgttgcacacggtaatgtgaatacttcaaatatagtagggcgaaaaattggtgagttgcgtttgccgatgggaaccattattggtgctttattacgagggaatgatgtaattattgctcgtcgtcaagtgattattgaagaaggcgatcatatagtgatttatttaagtgataagaaaaatgtgccagaaattgagaaattattccaaccaagcgcattctttatt

SEQ ID NO: 3972 - protein, 458 aa, Haemophilus influenzae
  Name: NTH2212
MKIIILGAGQVGTTLAENLVSEDNDITLVDNESPQLQTLQEKHDLRVVQGSPSSPKVLRDAGAADADLMVAVTASDEINMVACQMGYTLFNTPTRIARIRNSEYLREKDKLFNNENIPIDHLISPENLVTDEITRLIAYPGALQVAHFANNRISIVVVKAYYGGALVGYALSAFREHMPHIDCRIMSILRNGKPIRPQGSTIVEAGDEITFICATEHIKAVMGELQRLEKPYKRVMIVGGGNVAFGVAKRLENSCTVKLIERDSNRAQALAEKLPKTLVFNGDASDQNLLFEEHIESVDVFLSLSSDDEANIMSALLAKRLGAKKAMVLIQRIAYINLIQGGTIDIAVSPQQVTISALLGHVRKGDVKNVATLRHGIAEAIEIVAHGNVNTSNIVGRKIGELRLPMGTIIGALLRGNDVIIARRQVIIEEGDHIVIYLSDKKNVPEIEKLFQPSAFFI

SEQ ID NO: 3973 - DNA, 402 bp, Haemophilus influenzae
  Name: NTH2213
ttgaaggggaacattattatgaattttattaaagaatttcgcgaatttgcaatgcgtggcaatgtcgtagatatggctatcggtgtgattattggtagcgcatttggcaagatcgtaagttcacttgttagtgatatttttacgcccgtgttggggattttaactggtggtattgatttcaaagacatgaaatttgtattagcacaagcacaaggcgatgttcctgctgttactttaaattatggtttgtttattcaaaatgtgattgattttattattattgcttttgcaatctttatgatgatcaaagtaatcaataaggtaagaaaaccagaggagaaaaaaactgcaccaaaggcagaaacattgcttactgaaatccgtgatttattaaagaataaa

SEQ ID NO: 3974 - protein, 134 aa, Haemophilus influenzae
  Name: NTH2213
LKGNIIMNFIKEFREFAMRGNVVDMAIGVIIGSAFGKIVSSLVSDIFTPVLGILTGGIDFKDMKFVLAQAQGDVPAVTLNYGLFIQNVIDFIIIAFAIFMMIKVINKVRKPEEKKTAPKAETLLTEIRDLLKNK

SEQ ID NO: 3975 - DNA, 255 bp, Haemophilus influenzae
  Name: NTH2214
atggaaaaatataataaacttcgcattgaatgggattgtcgccgaggaatgttagagttagataaaatcataatgcctttttatttgaagcattttgatgaattaacagatgacaaaaaagatatatttattcgtttattagcaagtacagatctgcagctgttttcttggttttttaatcgtggtaaatcatcagattcagaaattcaatctatggtagagtatatccaaaacgtacaaaaaatcacaactaat

SEQ ID NO: 3976 - protein, 85 aa, Haemophilus influenzae
  Name: NTH2214
MEKYNKLRIEWDCRRGMLELDKIIMPFYLKHFDELTDDKKDIFIRLLASTDLQLFSWFFNRGKSSDSEIQSMVEYIQNVQKITTN

SEQ ID NO: 3977 - DNA, 120 bp, Haemophilus influenzae
  n 103, 107, 108, 109, 110, 111: n is any nucleotide
  Name: NTH2215
atggctgaacagctaacagatcaggctttggtagaaagagtgcagcaaggggataagaaagccttcaatttgttggtttcgcgttatcagaataaaggggatncctnnnnnttaattaat

SEQ ID NO: 3978 - protein, 40 aa, Haemophilus influenzae
  Xaa 35, 36, 37: Xaa is any amino acid
  Name: NTH2215
MAEQLTDQALVERVQQGDKKAFNLLVSRYQNKGDXXXLIN

SEQ ID NO: 3979 - DNA, 207 bp, Haemophilus influenzae
  Name: NTH2216
ttgctcgcacgaaaccagagggaatgtggaaaagaagggcggataagggggggggaaataaaaatgtggggattggcggacgggactcaggcgaaatacgggccagaaaaactgaagaaacaatttggcactcgtctcgttaaagcaaatgcaacacttcttttccggaccccgaaatgggcaatttccgaagaaggggccttaaga

SEQ ID NO: 3980 - protein, 69 aa, Haemophilus influenzae
  Name: NTH2216
LLARNQRECGKEGRIRGGEIKMWGLADGTQAKYGPEKLKKQFGTRLVKANATLLFRTPKWAISEEGALR

SEQ ID NO: 3981 - DNA, 1572 bp, Haemophilus influenzae
  Name: NTH2217
ttgacgctgattttggtttcctccccctacgttaacgcagaccacattctcaataaatataatatcaacccagattccgaaggtggctttcatttagcaacagacaactcttctattgctaaattctgtattttttacttgcccgaatccaatatcaatatgagtttagatgcgttatgggcagggaatcaacaactttgtgcttcattgtgttttgcgttgcaatcttcacgttttattggtaccgcatctgcgtttcataaaagagcggtggttttacagtggtttcctaaaaaactcgccgaaattgctgatttaaatgaattgcctgcaaacatccttcatgatgtatatatgcactgcagttatgatttagcaaaaaacaagcacgatgttaagcgtccattaaacgaacttgtccgtaaacatatcctcacgcaaggatggcaagaccgctacctttataccttaggtaaaaaggacggcaaacctgtaatgatggtactgcttgaacattttaattcggggcattcgatttatcgcacacactcaacttcaatgattgcggctcgagaaaaattctatttagttggcttaggctctgagagtgtcgatgaaataggtcgagaagtgtttgacgagttttttgaaatcagtagcaataatataatggagagactgttttttatccgtaaacagtgcgaaactttccagcccgcagttttctatatgccaagcattggcatggatattaccacgatttttgtgagcaacactcggcttgcccctattcaagctgtagccttgggtcatcctgccactacgcactctgaatttattgattatgtcatcgtagaagatgattatgtgggcagtgaagattgtttcagcgaaacccttttacgcttacccaaagatgccctaccttatgtaccatctgcactcgccccacaaaaagtggattatgtactaagagaaaaccctgaagtagtcaatatcggtattgccgctaccacaatgaaattaaaccctgaatttttggtaacattgcaagaaatcagagataaagctaaagtcaaaatacattttcatttcgcacttggacaatcaacaggcttgacacacccttatgtcaaatggtttattgaaagctatttaggtgacgatgccactgcacatccccacgcaccttatcacgattatctggcaatattgcgtgattgcgatatgctactaaatccgtttcctttcggtaatacaaacggcataattgatatggttacattaggtttagttggtgtatgcaaaacgggggatgaagtacatgaacatattgatgaaggtctgtttaaacgcttaggactaccagaatggctgatagccgatactcgcgaaacatacattgaatgtgctttacgtttggctgaaaaccaccaagaacgccttgaactccgtcgttacatcatagaaaacaacggcttacaaaagctttttacaggcgaccctcgtccattgggtaaaatactgcttaagaaaacaaatgaatggaaacgaaagcccttgagtaaaaaa

SEQ ID NO: 3982 - protein, 524 aa, Haemophilus influenzae
  Name: NTH2217
LTLILVSSPYVNADHILNKYNINPDSEGGFHLATDNSSIAKFCIFYLPESNINMSLDALWAGNQQLCASLCFALQSSRFIGTASAFHKRAVVLQWFPKKLAEIADLNELPANILHDVYMHCSYDLAKNKHDVKRPLNELVRKHILTQGWQDRYLYTLGKKDGKPVMMVLLEHFNSGHSIYRTHSTSMIAAREKFYLVGLGSESVDEIGREVFDEFFEISSNNIMERLFFIRKQCETFQPAVFYMPSIGMDITTIFVSNTRLAPIQAVALGHPATTHSEFIDYVIVEDDYVGSEDCFSETLLRLPKDALPYVPSALAPQKVDYVLRENPEVVNIGIAATTMKLNPEFLVTLQEIRDKAKVKIHFHFALGQSTGLTHPYVKWFIESYLGDDATAHPHAPYHDYLAILRDCDMLLNPFPFGNTNGIIDMVTLGLVGVCKTGDEVHEHIDEGLFKRLGLPEWLIADTRETYIECALRLAENHQERLELRRYIIENNGLQKLFTGDPRPLGKILLKKTNEWKRKPLSKK

SEQ ID NO: 3983 - DNA, 162 bp, Haemophilus influenzae
  Name: NTH2219
ttgcaccacaaaatcaccaatacccacaaaaaaacgacttgcatcaaaccccacaccgaatcagcaaaaaaacacgcgatgatttatgttgaagatttacaggtagagaatatgtctaaatcagccaaaggcacagcggaaaaacacggcaaaaacgtgaaa

SEQ ID NO: 3984 - protein, 54 aa, Haemophilus influenzae
  Name: NTH2219
LHHKITNTHKKTTCIKPHTESAKKHAMIYVEDLQVENMSKSAKGTAEKHGKNVK

SEQ ID NO: 3985 - DNA, 114 bp, Haemophilus influenzae
  Name: NTH2220
atgcactgtagcttaaaagcggcgcttcaacctcaaaatagctttgaagctcaacagatattattcaaccaattcttacgagaatacaatgaagaacgttcacacgaaggcgtt

SEQ ID NO: 3986 - protein, 38 aa, Haemophilus influenzae
  Name: NTH2220
MHCSLKAALQPQNSFEAQQILFNQFLREYNEERSHEGV

SEQ ID NO: 3987 - DNA, 132 bp, Haemophilus influenzae
  Name: NTH2221
atgccacgccataatggatttatgactggcttatcagtgagaaacttaaacgtcctcactgggggtgccaaaaagcttttagatagctttactcagcaatcagaagttttgctattcgctaactattacgga

SEQ ID NO: 3988 - protein, 44 aa, Haemophilus influenzae
  Name: NTH2221
MPRHNGFMTGLSVRNLNVLTGGAKKLLDSFTQQSEVLLFANYYG

SEQ ID NO: 3989 - DNA, 168 bp, Haemophilus influenzae
  Name: NTH2222
ttgatgatgccttggatagagaccgatgcgatgcaacagcgtgtacttttcttaaaagcgtggctaagccaacgctatactaaaactgaactgtgtcagcagtttaatattagccgtccaacggcagataaatggattaaacgccaccaacagcttggctttgagggc

SEQ ID NO: 3990 - protein, 56 aa, Haemophilus influenzae
  Name: NTH2222
LMMPWIETDAMQQRVLFLKAWLSQRYTKTELCQQFNISRPTADKWIKRHQQLGFEG

SEQ ID NO: 3991 - DNA, 114 bp, Haemophilus influenzae
  Name: NTH2223
atgaaatctgtttatgtttttcggattatttttttatttaaaagtcgcaatattttaatcacaataaataaaaatttgtttgtagataaagccatccaacataactctcacgca

SEQ ID NO: 3992 - protein, 38 aa, Haemophilus influenzae
  Name: NTH2223
MKSVYVFRIIFLFKSRNILITINKNLFVDKAIQHNSHA

SEQ ID NO: 3993 - DNA, 714 bp, Haemophilus influenzae
  Name: NTH2224
atgcagcctaagtcatcattgaaagaaactcagcaagcattggcaaatgctattcggttaggtaatgcagatcctttaaatggttatgctgaaagccgtttagcggtatatacacgtttagttcgtaataatgcttttggttttattgatcgttgttttgttgaagcaccattgcatattgagctagagtattggaaaaatgctaaagaaaattttgtgcaaaatggtaatgcccattctccttatttccaagatattgcaggagaatttctcttgttttgtcaagaaaaagagatatttgatacaaatatattggcattgatggattttgaaaatacacaattactcgcagaagtttctttagccaaagtgcctgaaaaatttgagtggaatagacatagcgtaatgcaattatctggtgcagcttatttaaaaagttatgaagttgattttttatcaagtgactttaaacaatttgatgatacgccaattcaagttattatatggcgtgatagtgattttaggattcagcaacaaatcctttcagagttagattactggttgttaagttatctacaagaacaaccaaattcattagaaaatgttttgtctgctcttaatacaatggttgaagatagtacgtcaataatcccattattagagcaagtatggatgaaatgggttacatctgaagtaatttaccccgaacaaaga

SEQ ID NO: 3994 - protein, 238 aa, Haemophilus influenzae
  Name: NTH2224
MQPKSSLKETQQALANAIRLGNADPLNGYAESRLAVYTRLVRNNAFGFIDRCFVEAPLHIELEYWKNAKENFVQNGNAHSPYFQDIAGEFLLFCQEKEIFDTNILALMDFENTQLLAEVSLAKVPEKFEWNRHSVMQLSGAAYLKSYEVDFLSSDFKQFDDTPIQVIIWRDSDFRIQQQILSELDYWLLSYLQEQPNSLENVLSALNTMVEDSTSIIPLLEQVWMKWVTSEVIYPEQR

SEQ ID NO: 3995 - DNA, 951 bp, Haemophilus influenzae
  Name: NTH2225
atgccagcttttattaaaaaggagttaattatgaaattacaaggcgctggactaggttatcgtcggaatttagctgaggattttttacaacttccctcaaataacgctattcaatttattgaagtcgcaccagaaaattggagtaaaatgggtggaatggcacgttatcaatttgatcaagcagcagaaagatttccgttagcagtacacggtctttcactttctttaggtgggcaagcaccacttgatcgcgaattactccgtaatacgaaagcattaattaatcaatataattcgtctttcttttctgaacatttaagttattgtgaatgtgaagggcatttatatgatttattacctatgccatttacagaagaagcagtaaaacacgttgcacaacgaatacgtgatgtgcaagatttcttaggattacaaatttcattagaaaatacttcttattatttgcattctcctactagcacaatgaatgaagtggaatttttaaatgctatcgcacaagaggctgattgtggcattcatttagatgtgaataatatttatgttaatggtgttaatcacggattgcttgatccttatatctttttagatcaagttgatgttaaacgtgttaattacattcatattgcagggcacgatgaagaacattctgctgcacaagttgtagagaattcagcaaatgaatcatttaataaagtaaaaggagcatatcgccatttacctgaattattaattgatacacacggagaagctgtaaaaggcactgtatgggatttactcgaatatgcctatcaacgactacctacgattcctccaacattattggagcgtgatttcaacttcccaccatttgcagaactttacgccgaagttgagcatattgcacaattacagcaaaaatacgctcacacagaggtaatgtcttatgcagcc

SEQ ID NO: 3996 - protein, 317 aa, Haemophilus influenzae
  Name: NTH2225
MPAFIKKELIMKLQGAGLGYRRNLAEDFLQLPSNNAIQFIEVAPENWSKMGGMARYQFDQAAERFPLAVHGLSLSLGGQAPLDRELLRNTKALINQYNSSFFSEHLSYCECEGHLYDLLPMPFTEEAVKHVAQRIRDVQDFLGLQISLENTSYYLHSPTSTMNEVEFLNAIAQEADCGIHLDVNNIYVNGVNHGLLDPYIFLDQVDVKRVNYIHIAGHDEEHSAAQVVENSANESFNKVKGAYRHLPELLIDTHGEAVKGTVWDLLEYAYQRLPTIPPTLLERDFNFPPFAELYAEVEHIAQLQQKYAHTEVMSYAA

SEQ ID NO: 3997 - DNA, 315 bp, Haemophilus influenzae
  Name: NTH2226
ttgttacgccagcataattattattcttatttagaaccgcatttaccttcgccacatttgccttcagcagctttcggtttgctcgcaccacatttaccctcgccacatttaccttcagcagatttagctttatctgcaccgcatttgccttcaccacacttaccttctgcggctttcgttttgacacatttatcgcctacacaaggtgttgctgtattatcagtattgcttgactttgattcagcctgtactgctgtcgctactgccatcgttaatgcacttgctaatgctgttaatgttgctaattttttcatt

SEQ ID NO: 3998 - protein, 105 aa, Haemophilus influenzae
  Name: NTH2226
LLRQHNYYSYLEPHLPSPHLPSAAFGLLAPHLPSPHLPSADLALSAPHLPSPHLPSAAFVLTHLSPTQGVAVLSVLLDFDSACTAVATAIVNALANAVNVANFFI

SEQ ID NO: 3999 - DNA, 285 bp, Haemophilus influenzae
  Name: NTH2227
atgaaaaaattagcaacattaacagcattagcaagtgcattaacgatggcagtagcgacagcagtacaggctgaatcaaagtcaagcaatactgataatacagcaacaccttgtgtaggcgataaatgtgtcaaaacgaaagccgcagaaggtaagtgtggtgaaggcaaatgcggtgcagataaagctaaatctgctgaaggtaaatgtggcgagggtaaatgtggtgcgagcaaaccgaaagctgctgaaggcaaatgtggcgaaggtaaatgcggttctaaa

SEQ ID NO: 4000 - protein, 95 aa, Haemophilus influenzae
  Name: NTH2227
MKKLATLTALASALTMAVATAVQAESKSSNTDNTATPCVGDKCVKTKAAEGKCGEGKCGADKAKSAEGKCGEGKCGASKPKAAEGKCGEGKCGSK

SEQ ID NO: 4001 - DNA, 264 bp, Haemophilus influenzae
  Name: NTH2228
atgggatcagaattaattttcccatttttgctgatatttggagtgctaacacgttttagtgcattaagtttaacgattttaatctctgtcgcgtggtatagcattcacgccgattcaggttataacgtatgtgataatggttataaattaccattaatttatgtggtgactttattaatcttaattacacagggagcggggaaactctctttagacacgcttattaagaaggtttatccaactaaaagctggttgaaatttctc

SEQ ID NO: 4002 - protein, 88 aa, Haemophilus influenzae
  Name: NTH2228
MGSELIFPFLLIFGVLTRFSALSLTILISVAWYSIHADSGYNVCDNGYKLPLIYVVTLLILITQGAGKLSLDTLIKKVYPTKSWLKFL

SEQ ID NO: 4003 - DNA, 204 bp, Haemophilus influenzae
  Name: NTH2229
atgacgcaacgcacaatttacgccaaaccaatcttccgtttgcaagaaaaagtagtgcctcgaccttttgcacttcctatcactcgttcttgtttttgccaaaattccgcttggaaaaactcggttgcttgctcaaaagtgcggtcaaaattaaagataaaatattggttatcttgttggaattggtgcattagaacgttgtta

SEQ ID NO: 4004 - protein, 68 aa, Haemophilus influenzae
  Name: NTH2229
MTQRTIYAKPIFRLQEKVVPRPFALPITRSCFCQNSAWKNSVACSKVRSKLKIKYWLSCWNWCIRTLL

SEQ ID NO: 4005 - DNA, 204 bp, Haemophilus influenzae
  Name: NTH2230
atgaccccattttctattcataacaacgttctaatgcaccaattccaacaagataaccaatattttatctttaattttgaccgcacttttgagcaagcaaccgagtttttccaagcggaattttggcaaaaacaagaacgagtgataggaagtgcaaaaggtcgaggcactactttttcttgcaaacggaagattggtttggcg

SEQ ID NO: 4006 - protein, 68 aa, Haemophilus influenzae
  Name: NTH2230
MTPFSIHNNVLMHQFQQDNQYFIFNFDRTFEQATEFFQAEFWQKQERVIGSAKGRGTTFSCKRKIGLA

SEQ ID NO: 4007 - DNA, 1041 bp, Haemophilus influenzae
  Name: NTH2231
atgccattttttaccgaagctccaaaatctctttgtattctccgattgtctgctgtaggcgatgtttgccacgccttagcggtggttcagcacattcaggcatattatccacaaacagaaatgacttggattgtaggcaaaactgaaatgggtttgctttcgggcattcctaatatcacgctcattccttacgataaaaaagcgggatggaaaggcgttttattattctggaaacaattaaaaaataaacaatttgatgcactattaaatatgcaaacagcatttcgtgcatcaatcctttctttaggaattaaagcaaaattcaaaattggatttggagaaaaacgttctcgcgaaggacaatggttatttgtaaatcgtcgtattacagatcctttttcccctcacgtattggatggatttatggctttcgctgaatatatcggcgtaccaaaatcagaaccgaaatgggaattagctatctcacaagatgatgataaatttgccgatcaatttattgatttttctcgtaaaaatttattgatttccccttgttctagcaaagcagaaaaagattggctaattgaacgttatgcagaaattgccaatattgcccatcagcataatatcaatgtgattttctgcagttcgccagcgaaacgtgaattagaaatagtcgaaaaaattaccgcactttgccatttcacgccaaccaatattgcaggaaaaacaaacctaaaacagcttaccgctttaatttctaaggtcgatctggtactttcgccagattctggccctgcccatattgcgacaacacaaggtacacccgttattggcttgtatgcctatcacaatcctttgcgtactgcaccttataataatttagataacgtggtatcagtatatgaagaaaatgcccaaaaagaatttggcaaaccgtcttctgaactaccttgggcaaccaaactaaaagggaaaaatttgatggcagagattcaagtcgaacccgtcattgaacaaatgaaaaaattgggattattt

SEQ ID NO: 4008 - protein, 347 aa, Haemophilus influenzae
  Name: NTH2231
MPFFTEAPKSLCILRLSAVGDVCHALAVVQHIQAYYPQTEMTWIVGKTEMGLLSGIPNITLIPYDKKAGWKGVLLFWKQLKNKQFDALLNMQTAFRASILSLGIKAKFKIGFGEKRSREGQWLFVNRRITDPFSPHVLDGFMAFAEYIGVPKSEPKWELAISQDDDKFADQFIDFSRKNLLISPCSSKAEKDWLIERYAEIANIAHQHNINVIFCSSPAKRELEIVEKITALCHFTPTNIAGKTNLKQLTALISKVDLVLSPDSGPAHIATTQGTPVIGLYAYHNPLRTAPYNNLDNVVSVYEENAQKEFGKPSSELPWATKLKGKNLMAEIQVEPVIEQMKKLGLF

SEQ ID NO: 4009 - DNA, 1617 bp, Haemophilus influenzae
  Name: NTH2232
atgcgattttctaaactttcccttgcaattacaacaaccttagtgacagcaaatgcactagcgcaatccgttgaattagactctatcaacgttattgcgacacgagatccaagtaggtttacttatacgccacaaaaacaatctaaagatagtcttctttccaaacaagctactagtgttgcagctgcgttggaagacattccaaatgttgatgttagaggcggttcgagaagcattgctcaaaaacctaatatccgagggttaagtgataatcgtgttgtgcaagtcattgatggcgtaagacaaaattttgatttagcacatagaggttcttattttcttccaatgtcactcatccaagaaattgaagtaatcaaagggccaagtagctccttatggggtagtggtgcattgggtggtgttgtggcaatgcgtacgccaaatgctttagacttattgaaaaataatgacaaattcggagttaaaattcgccaaggttatcaaactgctaataatttatcggaaaaggatgtttctgtatttgcggcaaatgacaaattcgatgttcttattagtggtttctataataatgcggataatttacgcattggtaaaggcaacaagctgaataatacagcctataaacagtttgggggcttagcaaaatttggttggcaaatcaatgatgcgaaccgtgtggaattatcccaccgcgaaactcgttttaaacaaacagcaccaggcaataatgaggcgaaaaacgaacttactaatgaacaaattatagaaaaaatcaatgagtaccacaacccactcaacaattttccaccgaaagccaaaccatcactagaagagttttactctggagtaagagcacgtcttggcggtgttagttatttaagtgatcaacaaattcctgatcaaagcacggtatttaactattatttaacgcctgataatccttatctaaatacgcatattgcgctatacaacaataagactattgagaaagaacagcgtaaagtcagtggagtgaaagatcagactaaattgactacccgaggtataaatttacgtaactcttccgaattatctcacatttcctttgtttatggggtggattatatgcgagataaaatcagtactgaacgaggcacaaacgataaagatgcgaagtttcgagcggaaccctataatgcaaattcaaacactacaggcgtttatttaattgcccatattccactatttggggaaaaattgctactttcgccaagtgtacgttatgaccactacgatacctcaagtaaaaccgtaaaatataaggataatcatttatcgcctgcaacaaaattaacttggaaagtgaccaattggttagattttactgccaaatataatgaagccttccgagctccatctatgcaagaacggtttgtaagcggcgctcactttggtacaagtactcgggtaggagatattatcaatagctttgtggcaaacccaaatttacgccctgaacagcgaaaaataaagaaattaccgcaaatctacattttgatagcctgtttaaacaaggcgataaattcaaaattgaagcgacttatttccgcaatgatg

SEQ ID NO: 4010 - protein, 539 aa, Haemophilus influenzae
  Name: NTH2232
MRFSKLSLAITTTLVTANALAQSVELDSINVIATRDPSRFTYTPQKQSKDSLLSKQATSVAAALEDIPNVDVRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSEKDVSVFAANDKFDVLISGFYNNADNLRIGKGNKLNNTAYKQFGGLAKFGWQINDANRVELSHRETRFKQTAPGNNEAKNELTNEQIIEKINEYHNPLNNFPPKAKPSLEEFYSGVRARLGGVSYLSDQQIPDQSTVFNYYLTPDNPYLNTHIALYNNKTIEKEQRKVSGVKDQTKLTTRGINLRNSSELSHISFVYGVDYMRDKISTERGTNDKDAKFRAEPYNANSNTTGVYLIAHIPLFGEKLLLSPSVRYDHYDTSSKTVKYKDNHLSPATKLTWKVTNWLDFTAKYNEAFRAPSMQERFVSGAHFGTSTRVGDIINSFVANPNLRPEQRKIKKLPQIYILIACLNKAINSKLKRLISAMM

SEQ ID NO: 4011 - DNA, 510 bp, Haemophilus influenzae
  Name: NTH2233
gtgaaagatttaattaacttaaagagacttgatgatccaaatgcaaatggagcattgtcacgaacaaattcccagtatcaaaacatagctaatgcccgtttaagcggtattgaattgcaagcccaataccaaacagaacgtttaacgctatttactaactatggcagcaccaaaggtagagataaagatagcggcgaagctttatcaaacattgccgcaagcaaaatcggcgtaggggcagattatgctttagtaaaagacaaattcacggtgggagcgacaataacccattacgctgcccaacatcgagtgcctaaagatcacgctgttacctacccaagttatatactgaccgatcttcgtgctacctatgcgccattaaaaggcgaatggaaaaacctgcgtttagattttgcactggaaaacttgtttgatagaaaatatcaaccagcatttagtttaatggaaggcactggtcgtaatgcgaaaattagtgcggtttatagcttc

SEQ ID NO: 4012 - protein, 170 aa, Haemophilus influenzae
  Name: NTH2233
VKDLINLKRLDDPNANGALSRTNSQYQNIANARLSGIELQAQYQTERLTLFTNYGSTKGRDKDSGEALSNIAASKIGVGADYALVKDKFTVGATITHYAAQHRVPKDHAVTYPSYILTDLRATYAPLKGEWKNLRLDFALENLFDRKYQPAFSLMEGTGRNAKISAVYSF

SEQ ID NO: 4013 - DNA, 1695 bp, Haemophilus influenzae
  Name: NTH2234
atgaaaatgagacctcgttattctgttattgcaagtgcggtcagtttaggctttgttttgagtaaatcagtgatggcattaggtcagccagatactggatcattgaaccgtgaactagaacaacgtcgaattcaaccagaagccaaacctagtggcgaattatttaatcaagcagcaaaatcgccttataccgcacagtataaacaagagctaaaatttccacttacgcaagtacagattttagatcgaaacaatcaggaagtagtcacagacgagcttgcacatattttaaaaaattatgtaggaaaagaagtatcgctgtcagatttaagtaatttggcaaatgagatcagcgaattttatcgtaataataattatttagtggcaaaagcgattttaccaccgcaggaaattgagcaaggtacggtaaaaattctgttactcaaaggtaatgtgggcgaaatacgcttgcaaaatcacagtgcattaagcaataaatttgtatcccgtctctctaatacaacagtgaatacgtccgagtttattttgaaagatgagttagaaaaatttgctttaacaataaatgatgttccaggggtaaatgcaggcttgcaactctccgcaggcaaaaaagtcggcgaagcgaatttactgattaagattaacgatgcaaaacgtttttctagttatgtttcagtagataaccaaggcaacaagtatacggggcgttaccgtttggctgctgggacaaaggtaaataatttgactggctggggcgatgaattgaaattggatttactgagttctaatcaggctaatttaaaaaatgctcgtatagattattcctctttaattgatggttattctacccgttttggtgtaactgctaactatctccactacaaattaggtggtaattttaaatcattgcaatctcaagggcattcccataacttaggggcttatttgttgcatccaacaatccgtacgccaaattttcgtttaagtactaaagtgagctttaatcatcaaaaccttacggatgaacaacaagcggttacagtgaaacaaaaacggaaaataaatagtttaactgtagggattgacggttcttggaatcttattaaagatgggacaacttatttttcattgtctaccttgttcggtaatttagcgaatcaaactaatgaaaaaaaacataatgcaaaagaggattttcaaccacaatcgcattttacggtatataactaccgcttgtctcacgagcaaattttaccaaaatcttttgctttcaatattggtataaacggtcagtttgccgataaaacccttgaaagctcacagaaaatgttgcttggtggtttgtctggagtacgtggacatcaagctggtgcggcttctgtggatgaagggcatttgatacaaacagaattcaaacattatttaccagtcttttcccaaagtgtgctagttagttcattgttctatgactatggtttcgggaaatattataaaaatagccaatctctcgcacaaagcgtgaaaaatagcgtgaaattacaaagcgttggtgcaggactttctttttcagatgctggcagctatgccatcaacgtcagtgtcgccaaaccgcttgataacaatattgataatgccgataaacaccaattttggctttctatgattaaaactttc

SEQ ID NO: 4014 - protein, 565 aa, Haemophilus influenzae
  Name: NTH2234
MKMRPRYSVIASAVSLGFVLSKSVMALGQPDTGSLNRELEQRRIQPEAKPSGELFNQAAKSPYTAQYKQELKFPLTQVQILDRNNQEVVTDELAHILKNYVGKEVSLSDLSNLANEISEFYRNNNYLVAKAILPPQEIEQGTVKILLLKGNVGEIRLQNHSALSNKFVSRLSNTTVNTSEFILKDELEKFALTINDVPGVNAGLQLSAGKKVGEANLLIKINDAKRFSSYVSVDNQGNKYTGRYRLAAGTKVNNLTGWGDELKLDLLSSNQANLKNARIDYSSLIDGYSTRFGVTANYLHYKLGGNFKSLQSQGHSHNLGAYLLHPTIRTPNFRLSTKVSFNHQNLTDEQQAVTVKQKRKINSLTVGIDGSWNLIKDGTTYFSLSTLFGNLANQTNEKKHNAKEDFQPQSHFTVYNYRLSHEQILPKSFAFNIGINGQFADKTLESSQKMLLGGLSGVRGHQAGAASVDEGHLIQTEFKHYLPVFSQSVLVSSLFYDYGFGKYYKNSQSLAQSVKNSVKLQSVGAGLSFSDAGSYAINVSVAKPLDNNIDNADKHQFWLSMIKTF

SEQ ID NO: 4015 - DNA, 2274 bp, Haemophilus influenzae
  n 2265, 2266, 2267, 2268, 2269: n is any nucleotide
  Name: NTH2235
atgtataaattaaatgtaatttctcttatcattttgaccacttacactggtgcgacatatgcctctacacagggtttgccacaagagggtttgccacaagaggatacagtcgtttttgggaatgtcactattgataaaactactgcagataaaatgacgattactcaaagtagccctacaactcaaataaattggaagagttttgacatcggtcaaaataaagaagtggaatttaaacagcctagcccaaacgctgtggcatataaccgtgtaactggcggcaatgctagtcaaattcaagggaaattgacggcaaacggtaaagtttatttagcaaaccctaatggggttattattaccaaaggggcagaaattaatgtagctggtttacttgcaacaactaaagatttagagcaaatcagtgaaaatggcaatggcaatggcaatagctatcaatttacccgtaaaacaaaagatggtcaggagctaaaagaaggtaaagttctcaatgaagggaaaattaaggcgaaagatttcgtggtacttaatggcgatgaagttatcaataaagaggaaattaacgttacaaatggcaaagtatatttatcctcaggcgataattttacatttaccttattaccagatagcggtataagtgtggcattagaagataatgcagtacggggtattgttaaaaatgaagggattattaaagcagaggacattacgctaaatgcaaaagggcgtaaagaagcattagatagcttggttatgaataatggtgtgttagaagcaactaaagttagcaataaaaacggcaaggttgtgttatctgctgatgaaattaagttagatgataaaagtaatattaaaggggatatggttagttttgtggctgatgttacctcaaataaggaacttaaagacaatataaaaatcacttctcaaactggctcaaaagttacctcgcctaaaatcgattttaaaggcaaaagtgttaatatcaatggtaactttgggcgtgacgatagtaaagcacactataacgatgagcataaaacattaaaaacagaagttaatattgacgtgccagacgatgaaaatattcgtattgcgaatattgaagatgaagataaagatagtacgggttcatttatacaaacagatgcgttaagttcattactagctaataatggaaaagtaactcttaaaggaaataacgttaatatttcaggacgtattcatatagattcctttagaggctcagattcgctattaaagctaactaacaaaggtcatattaagatcaataatgcggatattcattcaaaaggtcgtttattttttataaccagtttgcagaatgaggaagattttaaatcaaatattaccattactgacagcaaaataaatcttggtaacggagctatgggattggggcgtagtgtcaatgaaagcgactacgataacaaatatcagaaaacggaaggatcacaacgcaaaaagtttaatgttaagatgagtaacgtagaatttaatcaggttgatgatgtgattttagcaggtggatttgaaaaagttaatttagataaaatcgttgccacaggacaaacgaatttttacattgatgggggggtatcccgtaatagaacaaatggtgagccttggaaatatgaatacggtgtgttagatttagacaaacgtacgcagttatcggagttagatcaaggcagacgccgttggggatattactatgatttagagttagatatgaatagagcctatttgtatcgttttgatctgtttgccgctaaaaatacaaggcgatcaactattaaaggcacagaaattaatatttctaacagtaatattaatctgaaaaatggatttgtacatttactggcagaaaaaattaaattagataatagcaagattgatattacttttgataaagataattcacaagatactttagctcaaacaaaccgtttaggaatgaatggtaaagtgtcaatgataaactcacatattaaaatcgtaggcgatgagaaaagtggtatatctccaactgggacttatgctacgatgtttttaatcggggaattaataggggaaaaaagttctatttttgtgaaatctcatcagggttacacctttaaaactgatggcgatacaaaaattgcaggtaaaaacagcaaagaggacttgaaaattaccgcattaacacggtggaagagggtaccgaggctgatattcgtataccannnnnttaat

SEQ ID NO: 4016 - protein, 758 aa, Haemophilus influenzae
  Xaa 755, 756, 757: Xaa is any amino acid
  Name: NTH2235
MYKLNVISLIILTTYTGATYASTQGLPQEGLPQEDTVVFGNVTIDKTTADKMTITQSSPTTQINWKSFDIGQNKEVEFKQPSPNAVAYNRVTGGNASQIQGKLTANGKVYLANPNGVIITKGAEINVAGLLATTKDLEQISENGNGNGNSYQFTRKTKDGQELKEGKVLNEGKIKAKDFVVLNGDEVINKEEINVTNGKVYLSSGDNFTFTLLPDSGISVALEDNAVRGIVKNEGIIKAEDITLNAKGRKEALDSLVMNNGVLEATKVSNKNGKVVLSADEIKLDDKSNIKGDMVSFVADVTSNKELKDNIKITSQTGSKVTSPKIDFKGKSVNINGNFGRDDSKAHYNDEHKTLKTEVNIDVPDDENIRIANIEDEDKDSTGSFIQTDALSSLLANNGKVTLKGNNVNISGRIHIDSFRGSDSLLKLTNKGHIKINNADIHSKGRLFFITSLQNEEDFKSNITITDSKINLGNGAMGLGRSVNESDYDNKYQKTEGSQRKKFNVKMSNVEFNQVDDVILAGGFEKVNLDKIVATGQTNFYIDGGVSRNRTNGEPWKYEYGVLDLDKRTQLSELDQGRRRWGYYYDLELDMNRAYLYRFDLFAAKNTRRSTIKGTEINISNSNINLKNGFVHLLAEKIKLDNSKIDITFDKDNSQDTLAQTNRLGMNGKVSMINSHIKIVGDEKSGISPTGTYATMFLIGELIGEKSSIFVKSHQGYTFKTDGDTKIAGKNSKEDLKITALTRWKRVPRLIFVYXXXN

SEQ ID NO: 4017 - DNA, 693 bp, Haemophilus influenzae
  Name: NTH2236
atgtctgaaaagttagatggcgtacgcggttattggaatggaaagcaattattaacccgacaagggcaacctttatcgccgccagcttatttcattaaggattttccgccttttgcgattgatggcgaattatttagtgagcgaaatcattttgaggaaatttcatcaatcacaaaatctttcaaaggtgatggttgggcaaaactgaaattgtatgtttttgatgtgcctgatgcagagggcaatttatttgagcgtttagctaaattgaaagcctatttacttgaatatcctacaacttatattgaaattattgagcaaattcctgttaaagataaaacccatttatatcaatttcttgcacaagtcgaaaatttgcaaggcgagggcgttgttgtacgtaaccctaatgcaccttatgaacgtaagcgaagctcacaaattttaaaattgaaaacagcacgagatgaagaatgtacggttattgcacaccataaaggcaaaggacaatttgaaaatgtgatgggggctttaacttgtaaaaatcatcggggagaatttaaaatcggttcgggttttaatttaaacgaacgagaaaatccccctccgataggatctgtgattacttataaatatcgaggcattacgaatagtggaaaacctcgatttgcaacctattggcgagagaaaaaa

SEQ ID NO: 4018 - protein, 231 aa, Haemophilus influenzae
  Name: NTH2236
MSEKLDGVRGYWNGKQLLTRQGQPLSPPAYFIKDFPPFAIDGELFSERNHFEEISSITKSFKGDGWAKLKLYVFDVPDAEGNLFERLAKLKAYLLEYPTTYIEIIEQIPVKDKTHLYQFLAQVENLQGEGVVVRNPNAPYERKRSSQILKLKTARDEECTVIAHHKGKGQFENVMGALTCKNHRGEFKIGSGFNLNERENPPPIGSVITYKYRGITNSGKPRFATYWREKK

SEQ ID NO: 4019 - DNA, 981 bp, Haemophilus influenzae
  Name: NTH2238
atgacgaatgaagtaaaagaaaatacgccattattaaatgccattggcttaaaaaaatattaccctgtaaaaaaaggcttgtttgcaaaaccacagcaagtaaaagcgttggatggtgtctcttttcagcttgaacgaggtaaaactttagcagtcgtgggtgaatcaggttgtggaaaatcaacgctaggtcgtttattgacaatgattgaagaaccaaccaaaggcgaactttattacaaagggcataattttttagaaaatgattctgaaacaaaagcactacgtcgtaaaaaaattcaaatagtttttcaaaatccttacgcatcgttaaatccacgcaaaaagattggttcaattttggaagaaccattaatcatcaatacaaaactttccgccaaagaacggcgagaaaaagttttatcgatgatggaaaaagtgggcttgcgcgctgaattttatgatcgttatccccacatgttctcaggcggacaacgccaacgtattgccatcgctcgtggtttaatgttagatcccgatgtcgttgttgccgatgagcctgtttctgcattggatgtttccgtgcgtgcacaagtactgaatttaatgatggatttacaagatgaactaggattgtcttacgtgttcatttcacacgatctttctgtggtagaacatatcgctgatgaagtgatggtaatgtatctaggtcgttgtattgaaaaagggacgacagaacaaattttctctaatcctcagcatccttataccaaagcgttactttcagcgacaccacgtttgtcgccaaacttgcgccgtgagcgtattaagctgacaggcgaattgccaagcccaattaatccgccaaaaggctgtgcatttaatcctcgttgttggaaagcgacagaaaaatgtcgtgaaaatcaaccgcacttggaacaatatactgatggaaaattaatcgcttgtttccatattgat

SEQ ID NO: 4020 - protein, 327 aa, Haemophilus influenzae
  Name: NTH2238
MTNEVKENTPLLNAIGLKKYYPVKKGLFAKPQQVKALDGVSFQLERGKTLAVVGESGCGKSTLGRLLTMIEEPTKGELYYKGHNFLENDSETKALRRKKIQIVFQNPYASLNPRKKIGSILEEPLIINTKLSAKERREKVLSMMEKVGLRAEFYDRYPHMFSGGQRQRIAIARGLMLDPDVVVADEPVSALDVSVRAQVLNLMMDLQDELGLSYVFISHDLSVVEHIADEVMVMYLGRCIEKGTTEQIFSNPQHPYTKALLSATPRLSPNLRRERIKLTGELPSPINPPKGCAFNPRCWKATEKCRENQPHLEQYTDGKLIACFHID

SEQ ID NO: 4021 - DNA, 990 bp, Haemophilus influenzae
  Name: NTH2241
atggcattattagacgtaaaagaactttctgttcactttggcgataaaaaaacgccatttaaagcagtggatcgcattagctatcaagtcgcacaaggcgaagtgcttggcattgtgggagaatcaggttcgggtaaatctgtgagttctctcgcaattatgggattaattgatcatcctggacgtgtatctgctgaatccttgcaatttgaaaatactgatttactcactttagagagtaaagctaaacgccagcttattggtgctgatgtagcaatgattttccaagatccgatgacaagtttgaatcctgcttatactgtgggtttccaaattatggaagcgttgaaaactcacgaaggcggcacaaaaaaggcaagaaaagaccgcactttagagcttttaaaattggtcggtattcctgatcctgaatctcggattgatgtttatccccatcagctgtctggtggaatgagccagcgcgtgatgattgcgatggcaattgcttgcagacctaaattattgattgctgacgaaccaaccacggcattggacgtgactatccaagctcaaattatggaactcttacttgaattgcaaaagaaagaatgcatgtccctaattttgattactcacgatctagcacttgtggctgaagcggcagagcgaattatcgtgatgtatgctggacaaatcgttgaagaaggcaccgcaaaagatattttccgcgagccaaaacacccttacacacaagccttgttacgttcattacctgaatttgcagagggaaaatctcgcttagaatcattacaaggggtcgtccctggaaaatacgatcgcccaacaggctgtttattaaatcctcgctgcccttatgccaccgaatattgtcgccaagttgaacctcaattgcatcatatcggttcgcataaagtaaaatgccatactccgctgaacgagcaaggcaatccagttgaatatcaaggagct

SEQ ID NO: 4022 - protein, 330 aa, Haemophilus influenzae
  Name: NTH2241
MALLDVKELSVHFGDKKTPFKAVDRISYQVAQGEVLGIVGESGSGKSVSSLAIMGLIDHPGRVSAESLQFENTDLLTLESKAKRQLIGADVAMIFQDPMTSLNPAYTVGFQIMEALKTHEGGTKKARKDRTLELLKLVGIPDPESRIDVYPHQLSGGMSQRVMIAMAIACRPKLLIADEPTTALDVTIQAQIMELLLELQKKECMSLILITHDLALVAEAAERIIVMYAGQIVEEGTAKDIFREPKHPYTQALLRSLPEFAEGKSRLESLQGVVPGKYDRPTGCLLNPRCPYATEYCRQVEPQLHHIGSHKVKCHTPLNEQGNPVEYQGA

SEQ ID NO: 4023 - DNA, 885 bp, Haemophilus influenzae
  Name: NTH2242
atgtctgacacgcctttaacttttgcgccaaaaacacccttacaagaattttggttttactttaaacaaaatcgtggtgcgctaattggtttaatttttattttgattgttgccttaatcagcattctcgcaccttatattgcaccttttgatccaacagaacaaaatcgtaccgcacttttactgccacccgcttggtatgagggcggtaatcctgcttatttactcggcacagacgatattgggcgagatattctttcgcgtattatttatggaacgcgaatttccgtctttgcgggatttatcatcgtattactatcttgcgcctttggtaccagccttggcttgatttctggttattatggcggcgtgctagatacaattatcattcgcctaattgatattatgctcgcaattccaaacttacttttgacgattgttgtcgtctctattttagagccatcactcgccaatgccactttagcgatcgccgtggtatcgattcctagctatgtgcgtttaactcgagcagcgatgatgaatgaaaaaaatcgtgattatgtgacttcatctaaagtggcaggggcaggtattttacgcctcatgtttattgtgattttaccaaactgtttagcccctttaattgtgcaaatgactatgggaatatccaatgctatcttagaactcgcgacacttggtttcttaggcattggtgcaaaaccaccaacaccagaacttggcacaatgctttccgaagctcgtggttttatgcaagcggcaaactggttagttacaattcctggcttagtgattttatctttggtattagctttcaacttaatgggcgatggcttgcgtgatgcccttgatccaaaactcaaacaa

SEQ ID NO: 4024 - protein, 295 aa, Haemophilus influenzae
  Name: NTH2242
MSDTPLTFAPKTPLQEFWFYFKQNRGALIGLIFILIVALISILAPYIAPFDPTEQNRTALLLPPAWYEGGNPAYLLGTDDIGRDILSRIIYGTRISVFAGFIIVLLSCAFGTSLGLISGYYGGVLDTIIIRLIDIMLAIPNLLLTIVVVSILEPSLANATLAIAVVSIPSYVRLTRAAMMNEKNRDYVTSSKVAGAGILRLMFIVILPNCLAPLIVQMTMGISNAILELATLGFLGIGAKPPTPELGTMLSEARGFMQAANWLVTIPGLVILSLVLAFNLMGDGLRDALDPKLKQ

SEQ ID NO: 4025 - DNA, 999 bp, Haemophilus influenzae
  Name: NTH2243
atgtttaaatttgtattcaaacgaatcttaatggtgatccctacttttattgccattactcttattacctttgcccttgtgcattttattcccggtgatcctgtggaaattctgatgggggaacgtggcttaacggcagaagtacatcaacaaatgatgcaccaattgggtttagatttacctctttatcagcaatatttccactatattggcaatgtaattcaaggggatttcggtgcatcgttccgcactcaacaacctgtccttactgaattttttacgctttttcctgctaccgctgaattagctttttttgcgttattttggtcattattaggtggaataattttaggcacgattgccgcagtaaaaaaagacagttggatttctcacaccgttacagctgcatcgctcacaggttattctatgccgattttctggtggggtttaattttaattttatatgtttcgccacaactcggtttgccacaaggtggacgtttagataatgaattttggatcgatacaccaacaggatttatgcttattgacagctggctttctggtatgccaggtgccttcgaaaatgcggtgaaatccttaattcttcctgcaatagtcctaggcacagttcctctcgccattattacgcgtatgacacgatctgcgatgttggaagtattaggcgaagattacattcgcacggcaaaagcaaaaggtttaagctatactcgaattgttattgttcacgcattgcgtaatgcgttaattcctgttgtcactgtggtcgggttaattgtaggtcaattgctttctggtgcagttctcacagaaactattttctcttggccggggattggaaaatggattattgatgccattcaagcccgtgattatcctgtgttgcaaggttctgtactgattattgcgacgattattattgtggtaaatttaaccgtcgatttactttacggcgtggtcaatccgcgtatccgtcat

SEQ ID NO: 4026 - protein, 333 aa, Haemophilus influenzae
  Name: NTH2243
MFKFVFKRILMVIPTFIAITLITFALVHFIPGDPVEILMGERGLTAEVHQQMMHQLGLDLPLYQQYFHYIGNVIQGDFGASFRTQQPVLTEFFTLFPATAELAFFALFWSLLGGIILGTIAAVKKDSWISHTVTAASLTGYSMPIFWWGLILILYVSPQLGLPQGGRLDNEFWIDTPTGFMLIDSWLSGMPGAFENAVKSLILPAIVLGTVPLAIITRMTRSAMLEVLGEDYIRTAKAKGLSYTRIVIVHALRNALIPVVTVVGLIVGQLLSGAVLTETIFSWPGIGKWIIDAIQARDYPVLQGSVLIIATIIIVVNLTVDLLYGVVNPRIRH

SEQ ID NO: 4027 - DNA, 117 bp, Haemophilus influenzae
  Name: NTH2245
ttgcgcatttggcaaaattggaaaaagtgcggtagaattcaagagtattatattttttaccgattaatttctttgaaaagtgcggtgaatttttaccgcacttttattatctacgag

SEQ ID NO: 4028 - protein, 39 aa, Haemophilus influenzae
  Name: NTH2245
LRIWQNWKKCGRIQEYYIFYRLISLKSAVNFYRTFIIYE

SEQ ID NO: 4029 - DNA, 2181 bp, Haemophilus influenzae
  n 1751: n is any nucleotide
  Name: NTH2246
atgatggatatttctgaattacttgacgggcttaacgataaacaacgcaaagccgtagctgctcctcttggtaatcacctagtgctagctggtgcaggatcgggcaaaacgcgtgtattgacgcaccgtattgcttggttaattgcggtcgaaaatatttctgaaggcagcattatggcggtgacctttaccaataaagccgcagcagaaatgcgtcatcgtattcaatctacccttgccaaacacgcacaacatcaattagttggtatgtggattggcacctttcacagcattgcccatcgtttattacgagctcatcatttagatgtgggattgccacaagatttccaaattttagattcagaagatcaacttcgtttaattaaacgattattaaaattacataattttgatgaaaaagcttttccgcctaaacaggcttgttggtacatcaataacaaaaaagatgaaggcttgcgaccaaatgatattgaagattttaatgatcgccaagaacgtgaatggattaaaatttatcagatctatcaagacacttgcgatcgcgcagggttggtcgattttgctgaattattaattcgggtctatgaattatttgagaaaaaaccattaattttgcaacgttatcaacaacgttttcagcatattttggtggatgaatttcaagacaccaataaaatccaatataaatggatcaaaattctttctggaaaaacaggcaaagtcatgattgtgggcgatgatgatcaatctatatacggttggcgtggtgcacaaatagaaaatatccaaaaattcttgaaagatttcaaagccgaaacaattcgccttgaacaaaactatcgttctaccgccaatatcctaaacagcgcaaatgaattaattgcaaacaatagtgatcgtcttggtaaaaatttatggacagagggtgaaaaaggcgatcctgtgggcatctatgctgcctttaatgaattagacgaagcaaaatttgtcgcctcacaaattcaggattgggtggaacatggcggaaaacttgatgattgcgctgtactttatcgtagtaatagccaatcacgggttattgaagaagctttaattcgttgtcaaattccataccgtatttatggcggtatgcgtttcttcgaacgtcaagaaattaaagatgcgttagcctatcttcgtttgattaataatcgtcaagatgatgcggcttttgagcgtgtaattaatacgccaacccgtggcattggcgaccgcactttagatatattgcgtaacttaacacgtgaacgccaaattaccttatggcaagcagtacaagtcgcaacacaagaaaatatgttggcagggcgagcctcaacagccttattacgtttccaagaattaattaattcactacaacttgataccgcagaaatgccgcttttcgcacaaactgattttgtgattaaacattcgggcttatatgaaatgtatcaacaagaaaaaggcgaaaaaggcgaagtgcgtattgaaaatttggaagaattagttaccgcaacccgtgaatttatcaaacctgataatgcggaagatatgaccgaactcactgcctttttaacgcacgcttccttagaagctggcgaagaacaagcctcgccgcatcaatcttgtgtagaaatgatgacgttgcactctgcgaaaggcttagaatttcctcgtgtatttatggtgggcgtagaagaaggattatntcccagttttcgttcttttgaagaacccggacgtttagaagaagagcgtcgtttagcttatgtcggtattactcgtgcgcagaaaaaactgaccatctcttatgcggaaagccgtcgattatatgccaaagaagaacgccatttgccatcacggtttatcgcagaattaccgagagaatgtatccaagaaattcgtttacgagggacagtcacgcgtgcgatgaacctagcaaaagtcggttcattgtcgaataccagtgcggtcgaaaatgaatggaaaatgggtcaaaaagttaaacacgaaaaatttggtttcggcacagtgattaatgtggaaggatctgaaaataacacacgtttacaaatagcgttccaagctcaaggcattaaatggttgattgcgcatttggcaaaattggaaaaagtgcgg

SEQ ID NO: 4030 - protein, 727 aa, Haemophilus influenzae
  Xaa 584: Xaa is any amino acid
  Name: NTH2246
MMDISELLDGLNDKQRKAVAAPLGNHLVLAGAGSGKTRVLTHRIAWLIAVENISEGSIMAVTFTNKAAAEMRHRIQSTLAKHAQHQLVGMWIGTFHSIAHRLLRAHHLDVGLPQDFQILDSEDQLRLIKRLLKLHNFDEKAFPPKQACWYINNKKDEGLRPNDIEDFNDRQEREWIKIYQIYQDTCDRAGLVDFAELLIRVYELFEKKPLILQRYQQRFQHILVDEFQDTNKIQYKWIKILSGKTGKVMIVGDDDQSIYGWRGAQIENIQKFLKDFKAETIRLEQNYRSTANILNSANELIANNSDRLGKNLWTEGEKGDPVGIYAAFNELDEAKFVASQIQDWVEHGGKLDDCAVLYRSNSQSRVIEEALIRCQIPYRIYGGMRFFERQEIKDALAYLRLINNRQDDAAFERVINTPTRGIGDRTLDILRNLTRERQITLWQAVQVATQENMLAGRASTALLRFQELINSLQLDTAEMPLFAQTDFVIKHSGLYEMYQQEKGEKGEVRIENLEELVTATREFIKPDNAEDMTELTAFLTHASLEAGEEQASPHQSCVEMMTLHSAKGLEFPRVFMVGVEEGLXPSFRSFEEPGRLEEERRLAYVGITRAQKKLTISYAESRRLYAKEERHLPSRFIAELPRECIQEIRLRGTVTRAMNLAKVGSLSNTSAVENEWKMGQKVKHEKFGFGTVINVEGSENNTRLQIAFQAQGIKWLIAHLAKLEKVR

SEQ ID NO: 4031 - DNA, 375 bp, Haemophilus influenzae
  Name: NTH2247
gtgcaagtagaaggaaaagcaaatgtttataaaatcattacaggaatcctagcaaatcaagtattgattaagtcattaaacaacattcctatactattacatcatgggtatttttggaaaaatgagaaaccttgcattttaggaatgagaggtaaacgaattaaaaatttgtttatagatagtataaaaatagctttcaaagcatatggttttgatgttgagtttaaggatataggagaatcccgcttaatattattcttaaaatgttctaccctacttttgatatactcacaaatcttattgtttcacaagatagatgagactataataactgtaaatttaaacagattaaagatagtttatgatggatatttc

SEQ ID NO: 4032 - protein, 125 aa, Haemophilus influenzae
  Name: NTH2247
VQVEGKANVYKIITGILANQVLIKSLNNIPILLHHGYFWKNEKPCILGMRGKRIKNLFIDSIKIAFKAYGFDVEFKDIGESRLILFLKCSTLLLIYSQILLFHKIDETIITVNLNRLKIVYDGYF

SEQ ID NO: 4033 - DNA, 633 bp, Haemophilus influenzae
  Name: NTH2248
atgttgatggaaaaatatcatgattttgaaccgaactttaacatagtcgaaatttttgaaagtctgcaaggggagggcttcaatacgggaatgccaagtgtttttgtacgatttggtaaatgcaatctagactgtccttggtgtgatacaccttataataattttaaacgctggtctgtatcacaaattctagaaaaagtgcggtcattttcgtcaaagaatattatcatcacaggtggtgagccaacaattgtaccaaaaattgaatacttacttgagcaatttaaatcagatggctattttcttgcaattgaaaccaatggtctaaaagcaattcctgcacaaatagattatattgcgacgagtcctaagagcctttatgctcataagtatgaaaagcgttgcattccatttgcaaatgaagtacgtattgtaatggacagtaatatgccatcattttgtgaattgatcgagcaaaaaataaaagcaaagaattactatctttcaccttgtgaaattgatgggaaaatgaatttacttgagactatcactttacttggtcaattgaatcaacgttcaaataaacctaaatggcagctaagtttacaaacacataaattgattggtattgag

SEQ ID NO: 4034 - protein, 211 aa, Haemophilus influenzae
  Name: NTH2248
MLMEKYHDFEPNFNIVEIFESLQGEGFNTGMPSVFVRFGKCNLDCPWCDTPYNNFKRWSVSQILEKVRSFSSKNIIITGGEPTIVPKIEYLLEQFKSDGYFLAIETNGLKAIPAQIDYIATSPKSLYAHKYEKRCIPFANEVRIVMDSNMPSFCELIEQKIKAKNYYLSPCEIDGKMNLLETITLLGQLNQRSNKPKWQLSLQTHKLIGIE

SEQ ID NO: 4035 - DNA, 423 bp, Haemophilus influenzae
  Name: NTH2249
atgtttaaaatttccaaagaatttagctttgacatggcacatttattagatggacatgatgggaaatgtcaaaatttacatggacacacatataaattacaagttgaaatttcgggtgacttatatgaatcaggtgcaaaaaaagcaatggtcattgatttttcagatctaaagtctattgtgaaaaaagttattttagatccgatggatcacgcctttatttatgatcaaaccaatgagcgagaaagccaaattgccactctattgcaaaagttaaactcaaaaacttttggtgttccctttagaactacggcagaagaaatagctcgttttatttttaatcgtttaaaacatgatgaacaactgtccatatcatccattcgtttatgggaaaccccagcttcattttgcgagtatcaggag

SEQ ID NO: 4036 - protein, 141 aa, Haemophilus influenzae
  Name: NTH2249
MFKISKEFSFDMAHLLDGHDGKCQNLHGHTYKLQVEISGDLYESGAKKAMVIDFSDLKSIVKKVILDPMDHAFIYDQTNERESQIATLLQKLNSKTFGVPFRTTAEEIARFIFNRLKHDEQLSISSIRLWETPASFCEYQE

SEQ ID NO: 4037 - DNA, 681 bp, Haemophilus influenzae
  Name: NTH2250
atgaatattttcaatccaaaccacgatcgtaaagcgattgtcatcttttcaggtggacaagactccacgacttgtttattccaagctattgctgaatacggcaaagaaaacatagaagccattacctttcaatatgggcagcgtcatgctattgaattagaaaaggcgcgcgccattgtgcaagatctcggcattaaacaaaccttgattgatacatctgttatgaaagctatcacacataatgcattaatggatgaacaggcgcatattgagcaaaaagagaatgaattgccaaacacttttgttgatggtcgcaatgccctatttttactttatgcagcgatttatgcgaaaggccaaggcattcaagatattatcactggcgtatgtgaaacagatttcagcggttatccagattgccgagatgtgtttatcaagtcaatgaatgtcacattaaatttagctatggattatcaattcaatatcaaaacaccattaatgtatctcactaaagcccaaacttggcagcttgctgatgaattaggcgtattagattatgtacaaaaacatactcacacttgctatgaaggcatcgaaggtggatgcggaaaatgcccaagctgtattttacgcaataaaggtctaaagaaatatttgactcaaaaaggtagaaaaaatgtt

SEQ ID NO: 4038 - protein, 227 aa, Haemophilus influenzae
  Name: NTH2250
MNIFNPNHDRKAIVIFSGGQDSTTCLFQAIAEYGKENIEAITFQYGQRHAIELEKARAIVQDLGIKQTLIDTSVMKAITHNALMDEQAHIEQKENELPNTFVDGRNALFLLYAAIYAKGQGIQDIITGVCETDFSGYPDCRDVFIKSMNVTLNLAMDYQFNIKTPLMYLTKAQTWQLADELGVLDYVQKHTHTCYEGIEGGCGKCPSCILRNKGLKKYLTQKGRKNV

SEQ ID NO: 4039 - DNA, 141 bp, Haemophilus influenzae
  Name: NTH2251
atgaaaaaatggttgttgattatcgcaggcgcgttgattatttcagcttgcgcaaataaggatgtgtattttaacggtgcagaaggttcgcattcaggtgttaaatttgataaagattctcgccaatggggattgaatcaa

SEQ ID NO: 4040 - protein, 47 aa, Haemophilus influenzae
  Name: NTH2251
MKKWLLIIAGALIISACANKDVYFNGAEGSHSGVKFDKDSRQWGLNQ

SEQ ID NO: 4041 - DNA, 552 bp, Haemophilus influenzae
  Name: NTH2252
ttggctccatcaaactttatcacgactgattatgaccgtgctgcaccaatgggcactggtggtgtgaaagtgggtgggaactacgcagcaagcttacttccacacgaattagccgcagaacaaggtacgccagaacgtaaatttgcggatgcaatctatttagatccaaaaactcacactaaaattgaagaagtcggtgcggcaaacttctttgggatcacaaaagacaataaattcatcacaccaaaatcagaatctattttaccaagtatcactaaatactctcttttacatatcgcaaaagagcgtttaggtatggaagctattgaaggcgatgtgtatatcgatcaactcgatcaattcgtagaagctggtgcgtgcggtacagcggcggtgattactccagtgggcggcattcaacacaacggaaaattccacgtattctattcagaaactgaagtaggccctgttacccgtcgtctttatgatgaattaacaggcatccaattcggtgatatcgaagcacctgaaggctggattgtgaaagtagaa

SEQ ID NO: 4042 - protein, 184 aa, Haemophilus influenzae
  Name: NTH2252
LAPSNFITTDYDRAAPMGTGGVKVGGNYAASLLPHELAAEQGTPERKFADAIYLDPKTHTKIEEVGAANFFGITKDNKFITPKSESILPSITKYSLLHIAKERLGMEAIEGDVYIDQLDQFVEAGACGTAAVITPVGGIQHNGKFHVFYSETEVGPVTRRLYDELTGIQFGDIEAPEGWIVKVE

SEQ ID NO: 4043 - DNA, 624 bp, Haemophilus influenzae
  Name: NTH2253
atggtttttataattttcagaaaaactttgcgatatagatcgcaaaaatcaacatcaagtgatttttctacccattatttatggttaaagtgcggtagaaaattggagcgttttatgcagaaaggtgtgacattagtggaattattgattggattagcaatcatcagcattgtgctgagttttgtcgtgccattatggcaaaccgattcacctaaaacgattttagccaaagagcaacatcgcttgtatttatttctacgacaaattcaggttcgtgcagaaaattcatcggaagtgtggtttttacttatcaatcggaaccttgcgacacaacaatggtgcttaacggcacaagtaaaaaataaccaaacttgtgattgtttaaatccgataaattgcccgaaagaggtttatgcgcatttttactatccttattttcctaataaaacgatgattcaaagccatcatatttatccaaaagaaatcacgagatttgatggcattcgtaatactatcgttactcgttgctttattttgcaagcagaaaatgaacgtacgttatttttatttttcaatgttggcagtattcgtttaaaaaccaatcaatttgatagtgcttgtaat

SEQ ID NO: 4044 - protein, 208 aa, Haemophilus influenzae
  Name: NTH2253
MVFIIFRKTLRYRSQKSTSSDFSTHYLWLKCGRKLERFMQKGVTLVELLIGLAIISIVLSFVVPLWQTDSPKTILAKEQHRLYLFLRQIQVRAENSSEVWFLLINRNLATQQWCLTAQVKNNQTCDCLNPINCPKEVYAHFYYPYFPNKTMIQSHHIYPKEITRFDGIRNTIVTRCFILQAENERTLFLFFNVGSIRLKTNQFDSACN

SEQ ID NO: 4045 - DNA, 717 bp, Haemophilus influenzae
  Name: NTH2256
atgatgaaaacattattaaaagggcaaaccctattagcactgatgatttcactggctttgtcttctttattgctgctaagcatttcgcatttttatgtgcaaatacaaacacaaaaccaacaaatgttattacatttaaaattacaagctgaattacaacgaatattacagttaataggcaaagatcttcgccgattaggatttcgagcattaaatgcaaaactgacggaaagcaatttatttttatttgaattagatgaacaaggcacagccatttttattagccaagaagataatgcgccacctaatagctgcgtgttgttcttttatgatttaaataaaaatgggtgtattggtaaaggttcgccgaaaacctgtatgaaaaatgggaaaaatacatctaaaagtagtactgaagaattatttggctataaagtgagtaacaaaatgataaaaaccaaactgacttatcaaagtgttattcctactaattgcacggcagaaacgtgtaaacgtgcttttcaacaaaccgcttgcaacgctgggggaggttgggcagatttattagataacaacgaatatgaaattactaggctacaatttaattggttaattgaaggcaaaggattagaaatcaagttaaaaggaaatttaaaacaaaccccaaatatcagttatgaaacctcccttgtcgttgctctttggaatcaaaaacaa

SEQ ID NO: 4046 - protein, 239 aa, Haemophilus influenzae
  Name: NTH2256
MMKTLLKGQTLLALMISLALSSLLLLSISHFYVQIQTQNQQMLLHLKLQAELQRILQLIGKDLRRLGFRALNAKLTESNLFLFELDEQGTAIFISQEDNAPPNSCVLFFYDLNKNGCIGKGSPKTCMKNGKNTSKSSTEELFGYKVSNKMIKTKLTYQSVIPTNCTAETCKRAFQQTACNAGGGWADLLDNNEYEITRLQFNWLIEGKGLEIKLKGNLKQTPNISYETSLVVALWNQKQ

SEQ ID NO: 4047 - DNA, 681 bp, Haemophilus influenzae
  Name: NTH2257
atgacaatacaaaaaggtattattacgctgactattctgatttttatttcaggcttattaagcgtaatcttattgttagatgatagcaatttaagtttttttcgggcgcaacaaaatcaacgaaaactgtatgtggaaagaacattacaattacaaagaataacagccttgaaaaaacaaactgcctgccttgatttatcattaaataatgatgaaagtgtaaagcaaatcagcattacgcttgatggtgccacagattcaattcaatattttctttggtgtgaaagaatgagcctatttaaaaaatcgcctaaaaagggagataatcaaggcgcattgaaagattttgtgagtggcgaaaaacttgcctattttcgaccgcacttttcttctccgcccagaattttaaacgcgaataaaacgcctaaactttattggttttcagattcacaagcagaggttgaaattaatggcacggtgtctgccgtattaattgcagagggcgatttaaaattgactggcaaagggaggattagtggcgcagtgattaccaacgggaatttaactttagatggcgtaactttagcttatgggaaaaagacggtggtcgctttagtgcaacaatatagtcagtggaagttagcagaaaaaagttggagtgattttaatgttcaggatgaa

SEQ ID NO: 4048 - protein, 227 aa, Haemophilus influenzae
  Name: NTH2257
MTIQKGIITLTILIFISGLLSVILLLDDSNLSFFRAQQNQRKLYVERTLQLQRITALKKQTACLDLSLNNDESVKQISITLDGATDSIQYFLWCERMSLFKKSPKKGDNQGALKDFVSGEKLAYFRPHFSSPPRILNANKTPKLYWFSDSQAEVEINGTVSAVLIAEGDLKLTGKGRISGAVITNGNLTLDGVTLAYGKKTVVALVQQYSQWKLAEKSWSDFNVQDE

SEQ ID NO: 4049 - DNA, 303 bp, Haemophilus influenzae
  Name: NTH2258
gtgattttaatgttcaggatgaataaaggaatgtctcttattacattgttattttctttagctttatttagcgttttatttcttgtttttaatcaatggacggcagaacagcgaaaaagtgcggtaaaaatttatcaagattttcaggcaacacaaattgcagagaatcaagctcaacgccaatttttagggttagcttgtgaacaattgatacaacaaaatggcttaacttttcgtattcgatgtgaaaatgaacgcattattgtgcgttatcctacgagtgaaattttgataaaaactcag

SEQ ID NO: 4050 - protein, 101 aa, Haemophilus influenzae
  Name: NTH2258
VILMFRMNKGMSLITLLFSLALFSVLFLVFNQWTAEQRKSAVKIYQDFQATQIAENQAQRQFLGLACEQLIQQNGLTFRIRCENERIIVRYPTSEILIKTQ

SEQ ID NO: 4051 - DNA, 2694 bp, Haemophilus influenzae
  Name: NTH2259
gtgttcattatttattattccaatcagcttgaaaaacaaaaagaaattctttcttctttattcaaatctttaccacctgaagatccttttcaacaagatattattttggtgcaaagccctaatatggcacaatggctacaaattgaactcgccaaagaaacaggcatttcagcgaacctaaaatttcctatgccagcaagttttatttggcagctttatgctcaaaatttacccgcaacggcattggaaaacccttttgataaagattcaatgatgtggcgtttaatacgcttaatcccgacttttctcgagaaagaaaattttttgcctttacgaaattatttagcatcttcgccacattctgaacaatacaaactttatcaacttagcagtaaaatagccgacttatttgaccaatatttagtttaccgagctgaatggatttttgcttgggaaaaaggcgaagatgaacaaatcactgcgcaaatacgaaagcaacaacctaacctaaacgatacgttgtttgagcaaattcaaggcaatataaaatggcaaggggagctatggcgtgcgttggtcgtcgatgttaaatcagatgttgatgatgctacacatcgagcggctttgcataatcagttcttagccttgcttgcggataaaaaagcaccgaaaaaattaccttcacgcatatttatttttggtattccagcgcttccaactgcttatctcaatattttgcaagcgatatcctctgaagtggatattcatttattttttaataatccttgccaagaatattggggggatattagtgatctacgccttgattatttgcgttctcgtcagcgttatcaattcaataaacaaaatgaaaatcaaccgctcttttctgaggaacaactttctcaactagaaaacgctcagtttgacgtcacttatcaaaatgaaaaccttcaagtaggcaatccattgctggcggcttgggggaaaatgggacgagattttctctataccttagtgcgagatgaagaacatattccaacttatcccgtcaatgcttatcaagaaattaaatcgaacagtttacttggacaattgcaatctcaaattctgcatttagaaaataaaccgttaaatatcgcaaaaaatgaccgcactttaactctacattcttgccacagtgctatgcgggaagtggaagtcttgcacgattatttactcgatttattcaatcaagatcctaaccttacgccaaaagatgtagttgttatggtggcagatataaatcaatacacgccttatattcaggccgttttcgggcaaaaaaatagaaatgctccacaaattccattttcactttcagataataaactttcagaaagcgatgtgttggtctcaagttacttaactttattacgcttaaaagaaagcaattttagtgcggaagatgtgttagcgttgttggatattcctgcgacgcgagaacgatttaatatttctcttgctgatttaccattagtgcgagaatgggtggcggattcagggattcgtttcggtttgcaaaaaaatcaagatggcatcaattttaattcttggcaagctggattagaaagaatgattttaggctatgcgatgcgtgaagagcagggtatttggcaagatagtttggggttaaacagcagctatggcttaaaaggtgaacttgctggaaatttatcgtactttttcaccgcactttccttgctgcatgaaaccctgcaacaagcacattccatcgaaaaatggcaagaaattttaaccgcacttttatcagatttcttcgtacaaaatgaagacactagcgacacgattttctatattcaagagaaaattaatgaattagctgagcatctaaaaatgctccattttactgaaaaattacaagcagatgtgattgccgatgtcatcacaatgaaattggaagatgcgccaaatagcctcaaattccttgcagggaaagtaaacttctgcaccttattaccaatgcgttcagtgccattcaaagtggtttgtttacttggaatgaatgatgccgattacccaagaacacaaacaccaaacagttttgacttaatgcaatatcattatcaaaaaggcgaccgtgttcgccgtgatgatgatcgttatttgttcttagaggccttattagccgcacgtaattattgctatatcagctatattgggcgttccattaccgataatcaaccgaaagaaccctccgtattggtaagccaactcgtggattatattaatcaagggcaaaaggaaaatgtccttactgtcattgaacatccaatgaccgcatttagcccagataatttcaaatataacgagaaatttacccgctcttttgcgacaaaatggttgccaatggctcaatttgacgcaagtgcaagtaattcggaatttgccgtcactatgacagaaaacccagaaaaaatcgaagaagttgaactggattctttagtcagctttgtggaaaatccagtgaaatttttctttgaaaaacaacttggtgtttatttccgcgataaagatgaacgcattgctgacagtgaaaacttcactttaagtgggttagataattattctctcaataatgacttaatttaccttgatgaacaaaatttgctgattattttagacaagcagaag

SEQ ID NO: 4052 - protein, 898 aa, Haemophilus influenzae
  Name: NTH2259
VFIIYYSNQLEKQKEILSSLFKSLPPEDPFQQDIILVQSPNMAQWLQIELAKETGISANLKFPMPASFIWQLYAQNLPATALENPFDKDSMMWRLIRLIPTFLEKENFLPLRNYLASSPHSEQYKLYQLSSKIADLFDQYLVYRAEWIFAWEKGEDEQITAQIRKQQPNLNDTLFEQIQGNIKWQGELWRALVVDVKSDVDDATHRAALHNQFLALLADKKAPKKLPSRIFIFGIPALPTAYLNILQAISSEVDIHLFFNNPCQEYWGDISDLRLDYLRSRQRYQFNKQNENQPLFSEEQLSQLENAQFDVTYQNENLQVGNPLLAAWGKMGRDFLYTLVRDEEHIPTYPVNAYQEIKSNSLLGQLQSQILHLENKPLNIAKNDRTLTLHSCHSAMREVEVLHDYLLDLFNQDPNLTPKDVVVMVADINQYTPYIQAVFGQKNRNAPQIPFSLSDNKLSESDVLVSSYLTLLRLKESNFSAEDVLALLDIPATRERFNISLADLPLVREWVADSGIRFGLQKNQDGINFNSWQAGLERMILGYAMREEQGIWQDSLGLNSSYGLKGELAGNLSYFFTALSLLHETLQQAHSIEKWQEILTALLSDFFVQNEDTSDTIFYIQEKINELAEHLKMLHFTEKLQADVIADVITMKLEDAPNSLKFLAGKVNFCTLLPMRSVPFKVVCLLGMNDADYPRTQTPNSFDLMQYHYQKGDRVRRDDDRYLFLEALLAARNYCYISYIGRSITDNQPKEPSVLVSQLVDYINQGQKENVLTVIEHPMTAFSPDNFKYNEKFTRSFATKWLPMAQFDASASNSEFAVTMTENPEKIEEVELDSLVSFVENPVKFFFEKQLGVYFRDKDERIADSENFTLSGLDNYSLNNDLIYLDEQNLLIILDKQK

SEQ ID NO: 4053 - DNA, 489 bp, Haemophilus influenzae
  Name: NTH2260
atggaggctttatttggcgataattcacaagtcattcactggcattttgcgaaatacaaagatcgttattgtattcgtccttggatttattatttaattcaatgtgttacacaagaaaatgcggtaccagcaaaattaattacgcaagataaggttctcgaattaccgcctattgagcgtgaagttgcgcttgctcaattacaaatttacgtaaaagattatttacaaagccaaatagaaatacaattggtgccaacagtaagaaatataagtgattttattgtaagtgatgaaaattccgtttctgaaaaacttcaggaattaactgaaagtaatggtttcgggtcaaaagccgatccatattggtcacgagtattagcgcagacctcaagatttaaacaacctgaaaatattgcgaaattattaaaacaaacaaaagcttggtttggcttattattcgcacaaaagaagacaagaaaggcacaaagc

SEQ ID NO: 4054 - protein, 163 aa, Haemophilus influenzae
  Name: NTH2260
MEALFGDNSQVIHWHFAKYKDRYCIRPWIYYLIQCVTQENAVPAKLITQDKVLELPPIEREVALAQLQIYVKDYLQSQIEIQLVPTVRNISDFIVSDENSVSEKLQELTESNGFGSKADPYWSRVLAQTSRFKQPENIAKLLKQTKAWFGLLFAQKKTRKAQS

SEQ ID NO: 4055 - DNA, 447 bp, Haemophilus influenzae
  Name: NTH2261
atgcactgtccattttgtgatacagaagaaactaaagtcattgatagccgtttagtatctgatggttatcaagttcgccgccgccgtgagtgcggtcattgtcacgaacgttttactacttttgaaatggcagaattaatcataccgaaaattatcaaaactgatggtacacgtgagccattcaatgaagataaattgcgcagcggtattcaacacgccttagaaaaacgtcctgtaagtgcagatgatgtagaaaaagcaattaatcacataattcttcaactgcgtgcaactggagaacgtgaagtgccaagtaagttagtgggtaaacttgcgatgaatgaattaaaaaaactcgataaagtggcttatattcgttttgcatcagtctatttaagttttgatgatattgatcaattcactatcgaaattgaaaaattaaaggat

SEQ ID NO: 4056 - protein, 149 aa, Haemophilus influenzae
  Name: NTH2261
MHCPFCDTEETKVIDSRLVSDGYQVRRRRECGHCHERFTTFEMAELIIPKIIKTDGTREPFNEDKLRSGIQHALEKRPVSADDVEKAINHIILQLRATGEREVPSKLVGKLAMNELKKLDKVAYIRFASVYLSFDDIDQFTIEIEKLKD

SEQ ID NO: 4057 - DNA, 1116 bp, Haemophilus influenzae
  Name: NTH2262
atgcttgaattctcctcacaagattgcgtatttatgcaacgtgccttagatttagccgccaaaggtcaatataccactacaccgaacccatcggtgggatgcgtattggttaaaaatggtgaaattgtgggggagggctttcattttaaggcaggacaacctcatgctgaacgcgttgctttagctcaagctggtgaaaatgctaaaggagcaaccgcttacgtcaccttagagccttgttctcactatgggagaacaccaccttgtgcattaggattaattgaggcgggcgtagtgaaagtcattgcggctatgcaagatccgaatcctcaagtcgcaggaaaaggtttgaaaatgttgtctgatgctggtatcgaaagtgcagtgaatctattaaacgatcaagcggaaaaaataaataaaggctttttaaaacgaatgcgtcaaggtatgccttttgttcaactaaaacttgccatgagtttagatggacgaactgcaatggcaagtggagaaagtaaatggattacgggcccagatgctcgttcggacgtacaaaaaatgcgagcaaaatcatccgcacttttatctacttctgcgacagtacttgcagatgatccaagccttaatgtacgctgggacgaatttcctgaaaatcttaaaacagaatataaaaaagaatggcttcgccagcctgtgcgagtcattttagattcacaacatcgcattcagccgactcataaactttttttaacccattctcccgtttggttagtctctagtgaaacacgagatttaacaggctttcctgatttttgtgaacaaattattcttccgaaagaaaatttactaaaagaattaatgcgagagctgggaaaacgacaaatcaataccctttgggtagaagctggagcaaatttagcgggcagtttaattgatgcgaaattagtggatgaattgattatttacattgcgccaaaattacttggagacaatgctcgtggtctatgccaattaccgaatttaactaaacttgccgatgcaccattatggcaactcaatgaattagaacaaatcggtgacgatataaaattaacttacacaccgaaaggagtc

SEQ ID NO: 4058 - protein, 372 aa, Haemophilus influenzae
  Name: NTH2262
MLEFSSQDCVFMQRALDLAAKGQYTTTPNPSVGCVLVKNGEIVGEGFHFKAGQPHAERVALAQAGENAKGATAYVTLEPCSHYGRTPPCALGLIEAGVVKVIAAMQDPNPQVAGKGLKMLSDAGIESAVNLLNDQAEKINKGFLKRMRQGMPFVQLKLAMSLDGRTAMASGESKWITGPDARSDVQKMRAKSSALLSTSATVLADDPSLNVRWDEFPENLKTEYKKEWLRQPVRVILDSQHRIQPTHKLFLTHSPVWLVSSETRDLTGFPDFCEQIILPKENLLKELMRELGKRQINTLWVEAGANLAGSLIDAKLVDELIIYIAPKLLGDNARGLCQLPNLTKLADAPLWQLNELEQIGDDIKLTYTPKGV

SEQ ID NO: 4059 - DNA, 1071 bp, Haemophilus influenzae
  n 1012, 1034, 1062, 1063, 1064, 1065, 1066: n is any nucleotide
  Name: NTH2263
atgcttaaaaaacttttccattccgcactttggggcttggctgctgcgggcgtgattttgtttgcggttccaagactgaataacagcaatatcttcacttcagacgatattatatcgttcaaaaatgccgtgcgtattgcctctccagcagtagtgaatgtttataaccgctctttttcttccgccagcattaatgataatgatcagctacaagtgaataacttaggttctggtgtgattatgagtaaagatggctatattctgacgaataaacacgtcatccaaaatgcagatcaaattgtagtagcgttgcaaaacggaaatatttttgaggccagtcttgttggttcagatgatctcactgatctcgctgttcttaaaattcgtgcagataatctttcaactattccacaaaattcagcgcgtcaagctcacgtcggcgatgtggtattagcaatcggtaatccctacaacttaggacaaagcgtgtctcaaggaatcattagcgcaatcggtcgtaatgcggtaggcgattcggtgggcagacaaaattttattcaaactgatgcttcaattaaccgcggcaactcaggtggcgcattaattaattctgctggggaattggttggaattagcacgctaagtattggcaaaaccgccaatgaaatcgcagaaggactaaattttgccattccaatagatattgcaaatgatgtactacgtaaaattatgcgtgatggacgtgtgattcgaggttattttggtgtacaaagtgatattagttcaagtagtgaagaaggcatagttatcacagacgtaagcccgaacagcccagctgcgaaatcaggtattcaagttggcgatgtgattttgaaattaaataatcaggaggggatttcagccagagaaatgatgcaaattatcgcaaatacaaaacctaattcaaaagttctcgtcaccattctacgattaggcaaaatcttacaaattccagttgttattgaagaatttnccagtaaattaaaaatagcggncgggtaccgagtccgaattcgataccannnnnttaat

SEQ ID NO: 4060 - protein, 357 aa, Haemophilus influenzae
  Xaa 338, 345, 354, 355, 356: Xaa is any amino acid
  Name: NTH2263
MLKKLFHSALWGLAAAGVILFAVPRLNNSNIFTSDDIISFKNAVRIASPAVVNVYNRSFSSASINDNDQLQVNNLGSGVIMSKDGYILTNKHVIQNADQIVVALQNGNIFEASLVGSDDLTDLAVLKIRADNLSTIPQNSARQAHVGDVVLAIGNPYNLGQSVSQGIISAIGRNAVGDSVGRQNFIQTDASINRGNSGGALINSAGELVGISTLSIGKTANEIAEGLNFAIPIDIANDVLRKIMRDGRVIRGYFGVQSDISSSSEEGIVITDVSPNSPAAKSGIQVGDVILKLNNQEGISAREMMQIIANTKPNSKVLVTILRLGKILQIPVVIEEFXSKLKIAXGYRVRIRYXXXN

SEQ ID NO: 4061 - DNA, 249 bp, Haemophilus influenzae
  n 236, 237, 238, 239, 240: n is any nucleotide
  Name: NTH2264
gtgacaaaaatgagtattaccgttaatcaaattgttttgcatcagttagtcaaaaatgtggatggcgacagtataaaaatggaaagcgtattacgcgacgagttgctgtccattacaccagaagtagaacaaatgatgttgcaattgcatcaaggctatcaaaataaagctaaggcttttggcgtgttcaggaaaagtctatatttgcacaactttaatgggtacgagtcgaatcnnnnnttaattaat

SEQ ID NO: 4062 - protein, 83 aa, Haemophilus influenzae
  Xaa 79, 80: Xaa is any amino acid
  Name: NTH2264
VTKMSITVNQIVLHQLVKNVDGDSIKMESVLRDELLSITPEVEQMMLQLHQGYQNKAKAFGVFRKSLYLHNFNGYESNXXLIN

SEQ ID NO: 4063 - DNA, 216 bp, Haemophilus influenzae
  Name: NTH2265
atggctcaacattctaaatattctgatgctcaattaagtgcgattgtaaacgatatgatcgcagtattagaaaaacataaagcccctgtagatctatccttaatcgcattgggtaacatggcaagtaatttattaaccaccagcgtgccacaaactcaacgtgaggcattagctcaagcattttcgaattccttaattaatgcggtaaaaacacgt

SEQ ID NO: 4064 - protein, 72 aa, Haemophilus influenzae
  Name: NTH2265
MAQHSKYSDAQLSAIVNDMIAVLEKHKAPVDLSLIALGNMASNLLTTSVPQTQREALAQAFSNSLINAVKTR

SEQ ID NO: 4065 - DNA, 522 bp, Haemophilus influenzae
  Name: NTH2266
atgaaatggattaaaaaaggcaccttcagcggcaaacaataccgcgatgacgtttcacgaaaaatttcgtggggccattggtttgccttttttaatatcattgttgctattcttattggcgcacgttatgcctttatcattgactggccagatactctcgcaggaaaactttatttctttgtgagtttgctcgggcatttcagtttcaacgtttttgcgttgtacttactcgtggtctttccactgagttttattgttaaaaatcaccgcacttttcgcggattaaccgtaattttttccaccatttgcacaaccttattattatttgataccgccgttttcaatcgttttaatctgcatttatcctctgttgtatggaatttgctggtcaatccagaaaatggtgaaatgtcacgcgattggcaaattttctttgcaccaatgccaataattttactggcacaaatgttattttctcgctggagttgggaaaattacgtagtcttgaacgccaaaaatggc

SEQ ID NO: 4066 - protein, 174 aa, Haemophilus influenzae
  Name: NTH2266
MKWIKKGTFSGKQYRDDVSRKISWGHWFAFFNIIVAILIGARYAFIIDWPDTLAGKLYFFVSLLGHFSFNVFALYLLVVFPLSFIVKNHRTFRGLTVIFSTICTTLLLFDTAVFNRFNLHLSSVVWNLLVNPENGEMSRDWQIFFAPMPIILLAQMLFSRWSWENYVVLNAKNG

SEQ ID NO: 4067 - DNA, 618 bp, Haemophilus influenzae
  Name: NTH2269
atggctaaaaggcactggtatattcttaccacaacattcatcgcgacgcatttaatttatgcttgggcagatgcttatttgtatcgtccgatcactatgcaacgctctaatttccctttatcttatccaatgacagctcgttcttttttagaaaaacacggtttcttggatggggaagaatatacgcaaaaattggcgcaagaaggtcgtttagatgccttaaaaattgattatccgaaaaaagaactcacttatgcaccaattacgcacaaacctaatattctgctcgtaacggtttcgggtttacgccatgatgcgatttctaatgaaaagatgccaaaacttgctaaatttgcaacaagctcaacggaatttactaatcattacagcacaggcaatagtaataacgcaggcttaattgggttattttacgggctaaatgcaaattacaccgatagcattttaagcaatcatacccaatctgttttaatcgaaaaattacgtgctgaaaattatcaattgggtttattttctgctacgaatttcaaagatagcatcttccgccaagcattatttcgtgaaataaaactttcatcgaataaaaccaacaaacccaaa

SEQ ID NO: 4068 - protein, 206 aa, Haemophilus influenzae
  Name: NTH2269
MAKRHWYILTTTFIATHLIYAWADAYLYRPITMQRSNFPLSYPMTARSFLEKHGFLDGEEYTQKLAQEGRLDALKIDYPKKELTYAPITHKPNILLVTVSGLRHDAISNEKMPKLAKFATSSTEFTNHYSTGNSNNAGLIGLFYGLNANYTDSILSNHTQSVLIEKLRAENYQLGLFSATNFKDSIFRQALFREIKLSSNKTNKPK

SEQ ID NO: 4069 - DNA, 546 bp, Haemophilus influenzae
  Name: NTH2271
ttggatttagccttggatgctaaaaacccatcagattatgaccgcactttgcaagacattgattctcttttaacaaaagcgttagaaagtacaccgcttgaaaatacattagtcataatcacgtcagagcatggtttaacctttaatgaaatgaatcaaaaagagcgagaaaactactttgggcgtgatgaaattcaagtgccattgcttgtatattggaaagatttaccagtaggtaaacagaatggattaagtaatcatgcggatattttctctgcattaatgcagacagtattccgtgtagaaaacccgttgatggattatagtcagggacgcaatctctttgatcttaaaggagatgactgggtacttgcctcgaatttccgctggaatgtggtgattcaacctgatggaacacaatatcacattgatcgcaaagggaattacaaaaaattcgataaagattatattgagcaatcttcagacagaccgccacttggaatttttttagaagccttccaattacaaaatttcttctttgaaaaa

SEQ ID NO: 4070 - protein, 182 aa, Haemophilus influenzae
  Name: NTH2271
LDLALDAKNPSDYDRTLQDIDSLLTKALESTPLENTLVIITSEHGLTFNEMNQKERENYFGRDEIQVPLLVYWKDLPVGKQNGLSNHADIFSALMQTVFRVENPLMDYSQGRNLFDLKGDDWVLASNFRWNVVIQPDGTQYHIDRKGNYKKFDKDYIEQSSDRPPLGIFLEAFQLQNFFFEK

SEQ ID NO: 4071 - DNA, 990 bp, Haemophilus influenzae
  Name: NTH2272
atgaaaagccatgttcgtagttttaaaacctatattcgcgatgaaattatcaaaaaaggcgggtgggtaaatgcccatgctcatgctgaccgcgcttttacgatgacgccagagaaaattgggatttatcatagtagtaatttgcaacaaaaatgggatttagtggatgaagtaaaacgcacttccagtgttgatgattattacgcacgtttttgccaatctattgaattaatgatatcccaaggtgtaaccgcatttggtacttttgtcgatatagacccaatttgtgaagatcgtgcaattattgccgcacacaaagcccgcgaagtgtataaacatgacattattttaaaatttgccaatcaaactttaaaaggggtaatagaacccactgcgcgtaaatggtttgatattggtgcagaaatggtagatatgattggcggcttaccatatcgtgatgaattggattatggacgtggcttagaagcgatggatatcttgttagataaggccaaatctcttggaattatgtgtcatgtacatgtagaccaattcaacaatccaagtgaaaaagaaaccgagcaactttgcgacaaaaccattgaacacggaatggaggggcgagttgtaggtatccatggtatttccattggctcacattcaaaagaatatcgctacaaactttacgaaaaaatgcgtaaagccaaaatgatgatgatagcctgtcctatggcatggattgacagtaatcgcaaagaagatcttatgccattccataatgcactcacgccagcagatgaaatgattcccgaaggtatcactgttgccctaggcacagataatatttgtgattacatggttcctctatgtgaaggcgatttatggcaagaattaagcctattagctgcgggttgccgtttccctcacttagatgaaatggtcaatatcgcaagtattaacggtcgtaaagtgttaggactagagctaatt

SEQ ID NO: 4072 - protein, 330 aa, Haemophilus influenzae
  Name: NTH2272
MKSHVRSFKTYIRDEIIKKGGWVNAHAHADRAFTMTPEKIGIYHSSNLQQKWDLVDEVKRTSSVDDYYARFCQSIELMISQGVTAFGTFVDIDPICEDRAIIAAHKAREVYKHDIILKFANQTLKGVIEPTARKWFDIGAEMVDMIGGLPYRDELDYGRGLEAMDILLDKAKSLGIMCHVHVDQFNNPSEKETEQLCDKTIEHGMEGRVVGIHGISIGSHSKEYRYKLYEKMRKAKMMMIACPMAWIDSNRKEDLMPFHNALTPADEMIPEGITVALGTDNICDYMVPLCEGDLWQELSLLAAGCRFPHLDEMVNIASINGRKVLGLELI

SEQ ID NO: 4073 - DNA, 99 bp, Haemophilus influenzae
  Name: NTH2273
ttgcgtatggtgggtttaagccagctagttaccataactattttaaaacccagaaaaacgcgtaaaagtgaaagaattgattgcgatatttggtgctcg

SEQ ID NO: 4074 - protein, 33 aa, Haemophilus influenzae
  Name: NTH2273
LRMVGLSQLVTITILKPRKTRKSERIDCDIWCS

SEQ ID NO: 4075 - DNA, 576 bp, Haemophilus influenzae
  Name: NTH2274
atgacaattacaataagtgcggtaattttggcaggtggcaaagcacgcagaatgggcgggcaagataaaggattacagattttaggtaaacaatctttaattgaacatgttattaatcgcttacaaccacaaattcatcagatttcaattaacactaaccgaaatcaaacagaatatgcaaaatttggctttcctgttttctccgatgaactgcccgattttcaagggccattaagtggcatgctaacagctctagaaaagacaaaaagtgactttatcctttttacaccttgtgatacgcctttttttcctatgaatcttttagataaactcaaaagtgcggttaaaaatgaccgcactttaattgcgtatgcttgcgatgaagaacgtgaacatcccgttttttgtttaatgtccgttcagctaaaggaaaaattgcgacactatttagcatcgggtgaacgacgccttttacaatttatgaaagaaaatggcgggatttcagtaaaattcacgcaagaagaaggtaacttcgagaattttaatacgctagatgatttaaagaaaacagtcatc

SEQ ID NO: 4076 - protein, 192 aa, Haemophilus influenzae
  Name: NTH2274
MTITISAVILAGGKARRMGGQDKGLQILGKQSLIEHVINRLQPQIHQISINTNRNQTEYAKFGFPVFSDELPDFQGPLSGMLTALEKTKSDFILFTPCDTPFFPMNLLDKLKSAVKNDRTLIAYACDEEREHPVFCLMSVQLKEKLRHYLASGERRLLQFMKENGGISVKFTQEEGNFENFNTLDDLKKTVI

SEQ ID NO: 4077 - DNA, 264 bp, Haemophilus influenzae
  Name: NTH2276
atgaaatgtaagcgtttaaatgaagttttggaacttttacagttttattggtctaaagactcggatttgagtttaatggaaattttgcaaaaaattgccaatgaatcaggtttccaaaaaccattaaatgaattaactgatgaagtgattatttatcagttaaaaatggatggtacagataaatatgagccaattcctggtctcaaaaaagattacgaagaagattttaaaaccgcattgctccgtgctcgcggtatcattaaa

SEQ ID NO: 4078 - protein, 88 aa, Haemophilus influenzae
  Name: NTH2276
MKCKRLNEVLELLQFYWSKDSDLSLMEILQKIANESGFQKPLNELTDEVIIYQLKMDGTDKYEPIPGLKKDYEEDFKTALLRARGIIK

SEQ ID NO: 4079 - DNA, 648 bp, Haemophilus influenzae
  Name: NTH2277
gtgctcgcggtatcattaaataagaggaaagaaatgaaaaaagtattacttgcgttaggtttaggtgtcagcacgcttatgtctgtaaatagttttgccgcagatttacaagaaggcaaacaatatgttcaagtgagtcaacaggcttcacagcaaaaagaagtgattgagtttttctcattctattgcccgcattgttacgcctttgaaatggaatacaaaattccacaacaagtcgtagatgctttaccaaaagatgtgaaatttaaacaatatcatgtaaatttcttaggtcatcaatctgaaaacttaacacgtgcttgggcgttagcaatggcattaggtgcagaaagtaaagtaaaatcaccattatttgaagcggctcaaaaggatgccttgaaatcaatggatgatattcgagctatcttcttatcgaatggcataaccgccgagcaatttgatggtggcattaatagttttgcagtaaatggtttagttaataaacaagtgaatgcagcagaacaatttaaagtgcgtggcgtacctgatttttatgtaaatggaaaattccgtgtaaaccctgaagggttaaattatgatgatttcgtgaaagattatgtgcaaaccgtaaaaggtttattgcaaaaa

SEQ ID NO: 4080 - protein, 216 aa, Haemophilus influenzae
  Name: NTH2277
VLAVSLNKRKEMKKVLLALGLGVSTLMSVNSFAADLQEGKQYVQVSQQASQQKEVIEFFSFYCPHCYAFEMEYKIPQQVVDALPKDVKFKQYHVNFLGHQSENLTRAWALAMALGAESKVKSPLFEAAQKDALKSMDDIRAIFLSNGITAEQFDGGINSFAVNGLVNKQVNAAEQFKVRGVPDFYVNGKFRVNPEGLNYDDFVKDYVQTVKGLLQK

SEQ ID NO: 4081 - DNA, 333 bp, Haemophilus influenzae
  Name: NTH2279
atggctgcaagttttagcgtaacgcgtcgtttctttgacgacaaaaactaccctcgtggtttttcccgtcacggtgattacacaattaaagaatcacaggtgcttgagcaatatggtcaagcgttcaaagcattagacttaggggaacgtgagccagcgactaaagaagaaaaagatttcgtcgcattttgccgtggtgagcgcgcagcagagactttctttgaaaaaacttggaataaatatcgtactcgtattaacactaaaaaacgtgtttacaccttatctagtgatgtgagtgaagctgcctctggcggtgaagattattccggcgaa

SEQ ID NO: 4082 - protein, 111 aa, Haemophilus influenzae
  Name: NTH2279
MAASFSVTRRFFDDKNYPRGFSRHGDYTIKESQVLEQYGQAFKALDLGEREPATKEEKDFVAFCRGERAAETFFEKTWNKYRTRINTKKRVYTLSSDVSEAASGGEDYSGE

SEQ ID NO: 4083 - DNA, 1089 bp, Haemophilus influenzae
  Name: NTH2280
atgcaattaccgatttctcaatacaacgaactgctacaaaaaaaacttgaaaaattaaccgcacttttacacccttttaatgcaccagatattcaagtttttgactctccaacaagtcattatcgcatgcgtgcggagtttcgtatttggcacgagcaagatgatttttaccatattatgtttgatcaagcgacgctgcagcgttatcgcgtggatgaatttccaatcgccagcatgctaattaatcgtatgatgcaaaccttattacctttgttaaaacaacaagaagtgctacacaaaaaattattccaaattgattaccttagcaccttgagtaataagattattgtgagcttgctttatcataaaacactcactgaagaatgggaaagtgcggctaaaaatttgaaagatttactcgaaaagcaagattttgatgtgcaaataatcgggcgtgcaagtaaacaaaaaatctgttttgagcaagattatgtggacgaagttttacctgtgaatggcagaaattatgtctatcgccaagtcgagaatagttttacccagccaaacgcaacggtaaactgcaaaatgcttgaatgggcaattgattgtacccaaaatagcgaaggtgatttattagagctttactgcggaaacggtaatttttctatcgcacttgcacaaaatttccgtaaggtattggcaacagaaatcgccaaaccttccgtagccgccgcacaatttaatattgctgaaaataaagtggataatttacaaattatccgtatgtcggcagaggaatttacgcaggcaatgaatggggttagagcctttaaccgcttgaaagggattgatttaaaatcttatgaatgtaataccatttttgtcgatccgcctcgtgcggggcttgatcctgatacagtgaaacttgtacaaaattacgatcgcattttgtatatttcctgtaatccacatacgctgtgtgataatcttgttgaactatcaaaaacgcaccgcattgaaaaagcggcgttatttgaccaattcccttacactgaccacatggaaagcggcctatggctcattcgcaag

SEQ ID NO: 4084 - protein, 363 aa, Haemophilus influenzae
  Name: NTH2280
MQLPISQYNELLQKKLEKLTALLHPFNAPDIQVFDSPTSHYRMRAEFRIWHEQDDFYHIMFDQATLQRYRVDEFPIASMLINRMMQTLLPLLKQQEVLHKKLFQIDYLSTLSNKIIVSLLYHKTLTEEWESAAKNLKDLLEKQDFDVQIIGRASKQKICFEQDYVDEVLPVNGRNYVYRQVENSFTQPNATVNCKMLEWAIDCTQNSEGDLLELYCGNGNFSIALAQNFRKVLATEIAKPSVAAAQFNIAENKVDNLQIIRMSAEEFTQAMNGVRAFNRLKGIDLKSYECNTIFVDPPRAGLDPDTVKLVQNYDRILYISCNPHTLCDNLVELSKTHRIEKAALFDQFPYTDHMESGLWLIRK

SEQ ID NO: 4085 - DNA, 771 bp, Haemophilus influenzae
  Name: NTH2281
atggctcattcgcaagtaggaattcagctgatttctgaatcgacagaaaaaacattagcagaattgatcgcactttgtgctgaacacaacattattcataatgaaaagagcccacttgcacttgttcaaaccgatgaccgtttagaacttcgtaaactagacgaacctaaactcggagcggtttatgttgattttgttggtggcacaatggctcaccgtcgtaaattcggtggtggacgtggagaagccgtagcgaaagcagtagggattaaaggttcggcattgccaacggttattgatgcaacagctggtctaggacgtgatgcctttgtgttagccgcaattggctgccaagttcgtttagtagaacgccatcctgttgtttttttacttctgcaagatggtttaaatcgtgcttatcaagatgaggaaatcggcgagatgttgcaacaaaatttgcacttgctgaatgttcagcatattaatgaacttgatcctaatagcgattatgccgatgtggtttatctcgatccaatgtatccgcataaacaaaaatctgcactagtaaaaaaggaaatgcgtgtattccagcatttagtcggggctgatttagatgctgatgaattgcttttacctgcactccaattagctaaaaaacgtgtggtcgtgaagcgtcctgactatgcggaatttctttgtggaaaacaaccgcactttagccgtgaaacgaaaaatcatcgctttgatatttatatgggagcatcccaatgc

SEQ ID NO: 4086 - protein, 257 aa, Haemophilus influenzae
  Name: NTH2281
MAHSQVGIQLISESTEKTLAELIALCAEHNIIHNEKSPLALVQTDDRLELRKLDEPKLGAVYVDFVGGTMAHRRKFGGGRGEAVAKAVGIKGSALPTVIDATAGLGRDAFVLAAIGCQVRLVERHPVVFLLLQDGLNRAYQDEEIGEMLQQNLHLLNVQHINELDPNSDYADVVYLDPMYPHKQKSALVKKEMRVFQHLVGADLDADELLLPALQLAKKRVVVKRPDYAEFLCGKQPHFSRETKNHRFDIYMGASQC

SEQ ID NO: 4087 - DNA, 375 bp, Haemophilus influenzae
  n 343: n is any nucleotide
  Name: NTH2282
atgctaagagaaagtgccgttgttattagctatgaaaatggcattgccaaagtgaaatgccaatcccaaagtgcctgtggccaatgtgcagctaaaaacagttgtggaacatcaagcctttccgaattaaacggtaaacgtggcgagcatatttttaatgtggaaacattaatgccattacgcgaaggtcaaattgttgaaattggattagaagaaaagtcgatgttgttgtcggcattattgatgtatgttgtaccgcttttgaccttattgattgtgactatgttgtccgattacataagcgataatgaaattctgcgtgccattttaatctatggattancccgcactttctttcatttttgtaaaatctta

SEQ ID NO: 4088 - protein, 125 aa, Haemophilus influenzae
  Xaa 115: Xaa is any amino acid
  Name: NTH2282
MLRESAVVISYENGIAKVKCQSQSACGQCAAKNSCGTSSLSELNGKRGEHIFNVETLMPLREGQIVEIGLEEKSMLLSALLMYVVPLLTLLIVTMLSDYISDNEILRAILIYGLXRTFFHFCKIL

SEQ ID NO: 4089 - DNA, 99 bp, Haemophilus influenzae
  n 9: n is any nucleotide
  Name: NTH2283
atggattancccgcactttctttcatttttgtaaaatcttatagcagaaaattagggcaacaaacagaatttcagcctgttttattgcgcatattatct

SEQ ID NO: 4090 - protein, 33 aa, Haemophilus influenzae
  Xaa 3: Xaa is any amino acid
  Name: NTH2283
MDXPALSFIFVKSYSRKLGQQTEFQPVLLRILS

SEQ ID NO: 4091 - DNA, 90 bp, Haemophilus influenzae
  Name: NTH2284
ttggtcaaacttagtgatgatgtggcaaaagttgctattctagcaatgcctgttatactctatggcgagcaaccgcttttcctaaaagga

SEQ ID NO: 4092 - protein, 30 aa, Haemophilus influenzae
  Name: NTH2284
LVKLSDDVAKVAILAMPVILYGEQPLFLKG

SEQ ID NO: 4093 - DNA, 534 bp, Haemophilus influenzae
  Name: NTH2285
gtgatttttaaggttatttttatgaacaatcagattcctttacttggaattaccggttatagcggtagtggtaaaacaacattattagaaaaacttattccagaactgatcgctcgtcacattcgcgtttcagtgattaaacatagccatcacaatatgcaagttgataaagaaggaaaagatagctggcgtatgaaagaggcgggttcttctcaagtcattgtagcgaatgatgaacgctgggcgattatgacggaaacgccaaaacctgtttcattggattatttagcgcaacaatttgaccgcactttaacggatttagtgttggtggaaggctttaaacaagagccaattccaaagattttgctccatcgtcaagaaatgacaaaacctttacccgaaattgacgaatatgtgctcgcagttgcaacgaattattcccttgaaattgaccgcactttgttggatattaaccgcattccgcaaattgccgattttattgaaaattggttgcaccattttcacggagcacga

SEQ ID NO: 4094 - protein, 178 aa, Haemophilus influenzae
  Name: NTH2285
VIFKVIFMNNQIPLLGITGYSGSGKTTLLEKLIPELIARHIRVSVIKHSHHNMQVDKEGKDSWRMKEAGSSQVIVANDERWAIMTETPKPVSLDYLAQQFDRTLTDLVLVEGFKQEPIPKILLHRQEMTKPLPEIDEYVLAVATNYSLEIDRTLLDINRIPQIADFIENWLHHFHGAR

SEQ ID NO: 4095 - DNA, 138 bp, Haemophilus influenzae
  n 133, 134, 135, 136, 137: n is any nucleotide
  Name: NTH2287
ttggttgcaccattttcacggagcacgatgactactgaatccaatgcctatcgcggtttagcttgggtagcagcaatggcacttttatgcaaagcctcgatgcgacgggtaccgagtcgatatcgtataaagnnnnnt

SEQ ID NO: 4096 - protein, 46 aa, Haemophilus influenzae
  Xaa 45, 46: Xaa is any amino acid
  Name: NTH2287
LVAPFSRSTMTTESNAYRGLAWVAAMALLCKASMRRVPSRYRIKXX

SEQ ID NO: 4097 - DNA, 876 bp, Haemophilus influenzae
  Name: NTH2288
ttggttgtattcatctgtcagtatcaagcccaacagcctgaaaatgatcatattcaacgctggttaagtgcggtggaaaataatcactttcttgatttcatacaaagtttagcgggagaaaatcatttatatcgccaaacagttcaatcattgccgatgtttattccgacttctaaagaatcaaatattgctcaaaaattggcaatgaatgcacagcgtttacgtgtgattcctgattttcataatggaatttttgtgaatattccaagctataaattacagtattatcgtgatggcgatttaattttagaatctcgggtaattgttggcacagattcgcgcaggacacctgtaatgtatagcaaattaagtaatgtggttgtaaatccaccttggaatgcgccaattcgcttaattaatgaagatttattgccaaaaatgaaagccgatccaaattatattacggagcataattattcaattttagataatcaaggcaatgttgttgatcctgcttctattgattgggaatctattggtaataaatttccttatcgagttcgacaagcggctggcgatagtgcgttaggtaattataaatttaatatgccaagttctgatgcaatttatttacacgatacgccaaatcgcggattgtttaatcgtaaaaatcgagcgttaagttctggttgtgtgcgtgttgaaaaatctgatcaattggcaagtattttattaaaagaagcaggttggacagaaactcgaaaaaatacagtattagcaagtaaaaaaaccacttctgcgccgatacgctcggataatcctgtttttttatattatgttactgcgtggattgaaaacggaaatattgtaatttac

SEQ ID NO: 4098 - protein, 292 aa, Haemophilus influenzae
  Name: NTH2288
LVVFICQYQAQQPENDHIQRWLSAVENNHFLDFIQSLAGENHLYRQTVQSLPMFIPTSKESNIAQKLAMNAQRLRVIPDFHNGIFVNIPSYKLQYYRDGDLILESRVIVGTDSRRTPVMYSKLSNVVVNPPWNAPIRLINEDLLPKMKADPNYITEHNYSILDNQGNVVDPASIDWESIGNKFPYRVRQAAGDSALGNYKFNMPSSDAIYLHDTPNRGLFNRKNRALSSGCVRVEKSDQLASILLKEAGWTETRKNTVLASKKTTSAPIRSDNPVFLYYVTAWIENGNIVIY

SEQ ID NO: 4099 - DNA, 1956 bp, Haemophilus influenzae
  n 1316: n is any nucleotide
  Name: NTH2289
atgaacattgaaaaatttacgacaaaattccaagaagcgttaagcgaagcacaatcacttgctatcggaaaagacaatcaatttattgaacccgtgcatttattgaccgcacttttaaatcaacagggcggctctattgcgccaattttgacagcaagtggcgtaaatgtggctttattgcgtaatgaattaaagacagaactaaataaattgccgcaagtgattggcaatggtggagatgtacaactttcacgccagcttattaatttacttaatctatgcgataaattcgcacagcaaaaccaagataaatttatttcgagcgaattgtttttgcttgcagctttagaagaacgaggaacgatcagcgatattttgaaaaagtgcggtgcgaaaaaagaacaaatttcgcaagctattcagcacattagagggggacaaaacgtgaacgatcaaaatgcagaagaaagcagacaagctcttgaaaaatatacgattgatttaaccgctcgtgcagaaagtggcaaacttgatcctgtaattgggcgtgatgaagaaattcgtcgagccattcaagtattacaacgtcgtaccaaaaataaccctgtgttaattggtgaaccaggtgtagggaaaacggcgattgtcgaaggcttggcacagcgtatcgtaaacggcgaagtgccagaaggtttgaaaaataaacgtgtgctttcattagatatgggcgcattgattgctggtgcaaaatatcgcggagaatttgaagaacgtttaaaagcggtgctcaatgaactttctaaagaagaaggtcgcgtgatcctctttattgatgaaattcatactatggtcggcgcgggtaaaaccgatggtgcgatggatgcgggtaacttattaaaaccaagtttagcgcgcggtgaattacattgcgtgggtgcaacaacgttagacgaatatcgtcaatatatcgaaaaagatgccgcacttgagcgccgtttccaaaaagtatttgtggacgaaccaagtgtagaagataccattgctatcttacgtggtttgaaagaacgctatgaaattcatcatcacgtggatattactgaccctgcgattgtcgctgccgcaacgctttcacatcgttatatttccgatcgtcaattgccggataaagccattgatttgatcgatgaagcggcgtctagcattcgtatggaaatagattctaaacctgaaccgcttgatcgccttgaacgtcgaattatccaattaaaattggaacaacaggcattacaaaaagaagaagacgaagcaagtcgcanacgtttagaaatgttagagaaagaattggctgaaaaagaacgtgaatacgccgaacttgaagaagtatggaaatctgaaaaagcaacgctttctggctctcaacatattaaacaagaattagatactgcaaaaaccgaactagaacaagctcgtcgcgcgggtgatttagcgaaaatgtcagagttgcaatatggacgcatccctgctcttgaaaagcaactcgagcaagctgaaaccagcgaaggaaaagaaatgacgcttttacgctatcgtgtcacggatgaagaaatcgcagaagtgctttctaaagccacaggtattcctgtatccaaaatgatggaaggcgagaaagaaaaactcttgcgcatggaagatgaactacataaacgagtgattggtcaagaagaagcagttgatgcggtagcaaacgcgattcgtcgtagtcgtgctggtctttccgatcctaatcgcccaattggttcattcttgttcctagggccaacaggtgtgggtaaaacagagctttgcaaaactttggctaaattcttgtttgatagtgaagatgcgatggtgcgcattgatatgtcagagtttatggaaaagcacagtgtctctcgtttagtgggtgcgcctccaggc

SEQ ID NO: 4100 - protein, 652 aa, Haemophilus influenzae
  Xaa 439: Xaa is any amino acid
  Name: NTH2289
MNIEKFTTKFQEALSEAQSLAIGKDNQFIEPVHLLTALLNQQGGSIAPILTASGVNVALLRNELKTELNKLPQVIGNGGDVQLSRQLINLLNLCDKFAQQNQDKFISSELFLLAALEERGTISDILKKCGAKKEQISQAIQHIRGGQNVNDQNAEESRQALEKYTIDLTARAESGKLDPVIGRDEEIRRAIQVLQRRTKNNPVLIGEPGVGKTAIVEGLAQRIVNGEVPEGLKNKRVLSLDMGALIAGAKYRGEFEERLKAVLNELSKEEGRVILFIDEIHTMVGAGKTDGAMDAGNLLKPSLARGELHCVGATTLDEYRQYIEKDAALERRFQKVFVDEPSVEDTIAILRGLKERYEIHHHVDITDPAIVAAATLSHRYISDRQLPDKAIDLIDEAASSIRMEIDSKPEPLDRLERRIIQLKLEQQALQKEEDEASRXRLEMLEKELAEKEREYAELEEVWKSEKATLSGSQHIKQELDTAKTELEQARRAGDLAKMSELQYGRIPALEKQLEQAETSEGKEMTLLRYRVTDEEIAEVLSKATGIPVSKMMEGEKEKLLRMEDELHKRVIGQEEAVDAVANAIRRSRAGLSDPNRPIGSFLFLGPTGVGKTELCKTLAKFLFDSEDAMVRIDMSEFMEKHSVSRLVGAPPG

SEQ ID NO: 4101 - DNA, 630 bp, Haemophilus influenzae
  Name: NTH2291
ttgaaccgtcgggttcaaggactactgcccgcagcggcactctgggtcctatcttctcctttcatttctatgaatactcaaaaacgccagcaaatccgcgctgaaattcgaaaaatacgcgcaaatttaaccgcacttcaacagcaacaagcagcacaatcagtgacccaacaggcgttaaatcttatcgagcaacgacaagccaaaaatattgcattatatttttcttttgatggtgaaatttcaacaaaagccttaatccaatccctggggatgcaaaataaaaatgggtatttgcctggtttacatccttttactaaacactatttattggttttacgctatttacctgatacgccaatgaaacaaaatcagtttggcatttgggagccaaagctaaatgttcaaaatgttttgccattaaatgaactggatattttatttacgccattggtggcttttgataaaaaaggaaatcgccttggtatgggcggtggattttatgatcgcacgttgcagaattggcaaaataagtcttttattccagttggtttagcgcaccaatgtcagcaagtagaaaatcttcccactgagcattgggatgtgccactgtttgatattttggtggat

SEQ ID NO: 4102 - protein, 210 aa, Haemophilus influenzae
  Name: NTH2291
LNRRVQGLLPAAALWVLSSPFISMNTQKRQQIRAEIRKIRANLTALQQQQAAQSVTQQALNLIEQRQAKNIALYFSFDGEISTKALIQSLGMQNKNGYLPGLHPFTKHYLLVLRYLPDTPMKQNQFGIWEPKLNVQNVLPLNELDILFTPLVAFDKKGNRLGMGGGFYDRTLQNWQNKSFIPVGLAHQCQQVENLPTEHWDVPLFDILVD

SEQ ID NO: 4103 - DNA, 300 bp, Haemophilus influenzae
  Name: NTH2292
atgtcgttaaaattggtcgaaattttagttttgggtcaggttttgcgtttaaatgtacccattgaacaagaagaattactgcgccaagctgcgcgtaatttagatatattggtttccgaaatgaaagaaaagacaggccttattcagcttgatcgtgtgctctctattgtggcactcaatttgagttttgaattaagccaagaaaaaaataaaacggctaaaattgaagaggtattgagaacgggtatccaacaattagatcattcattagaaaatattcgtgttacaaaagaaccgcat

SEQ ID NO: 4104 - protein, 100 aa, Haemophilus influenzae
  Name: NTH2292
MSLKLVEILVLGQVLRLNVPIEQEELLRQAARNLDILVSEMKEKTGLIQLDRVLSIVALNLSFELSQEKNKTAKIEEVLRTGIQQLDHSLENIRVTKEPH

SEQ ID NO: 4105 - DNA, 468 bp, Haemophilus influenzae
  Name: NTH2293
atggcccaaattgcaacaaatccgcttgtgctagtggatggttcttcttatttatatcgtgcatttcatgcctttccttctttaactaatgccgcaggtgagccaacaaacgcgatgtacggcgtgttaaatatgttaaaacgcctcatctcacaagtacagcccactcatatagccgttgtttttgatgcaaaagggaaaacatttcgcaatgaaatgtttgaacagtataaatctcatcgcccgccaatgcctgatgatttacgcaaacaaattcagcctttgcacgatatgattcgtgcattgggcattccgcttttagtggtggaagggattgaggcagatgatgtgatcggtactctcgcactacaagcatcaagtttgggtaaaaaagtgctcattagtactggcgataaagatatggcacagttggtggatgacaatattatgctcatcaacacccatgaa

SEQ ID NO: 4106 - protein, 156 aa, Haemophilus influenzae
  Name: NTH2293
MAQIATNPLVLVDGSSYLYRAFHAFPSLTNAAGEPTNAMYGVLNMLKRLISQVQPTHIAVVFDAKGKTFRNEMFEQYKSHRPPMPDDLRKQIQPLHDMIRALGIPLLVVEGIEADDVIGTLALQASSLGKKVLISTGDKDMAQLVDDNIMLINTHE

SEQ ID NO: 4107 - DNA, 2355 bp, Haemophilus influenzae
  Name: NTH2294
atgacaatattatgctcatcaacacccatgaataatagcctattggatcgtgagggtgtgattgaaaaatacggtattccacctgaactcattattgattatctcgcacttatgggcgatagtgcagataacattcctggcgttgctggcgtgggcgaaaaaaccgcacttggtttactacaaggcataggaagcatggctgaaatttatgccaatcttgaaaaagtagcggaactgccaattcgtggggcgaaaaaactaggtgaaaaattattggctgaaaaacccaatgccgatctttcttatacattagcaaccatcaaaacggatgttgaacttaacgtgacaacagatcaattgttgcttggagaaagccaaaaggatcaactcattgaatattttgctcgctacgaatttaaacgctggcttaatgaagtgatgaatggtgctgactccataacccaaaccactgaacagccagtgaaaatgaaccagtatcaggcgacctcacaagatcaaagtgcggtggaaaatacgcctaaaattcaaatcgatcgtacaaaatatgaaaccttactcactcaagcggatttaacgcgctggattgaaaaactcaatacagcaaaactcattgcagtggatactgaaacagatagcctcgattatatgtctgctaatttagtgggtatatcttttgctcttgaaaatggcgaagccgcttatttaccattgcaattggattatttggatgcgccaaaaacactcgaaaaatcgaccgcacttgcggctatcaaacccattttagaaaatcctgacattcacaaaattggacaaaatattaaatttgatgaaagcatttttgcccgtcatggcattgaattacaaggtgttgaatttgatacgatgttgctttcttatacgctaaatagtacgggtcgtcataatatggacgatttagccaaacgttatttaggtcatgaaactatcgcatttgaaagcatcgctggaaaaggaaaaaatcagcttacgtttaatcaaattccattagaacaagccactgaatacgcagcagaagatgcggatgtgacaatgaaattacaacaagcactgtggttgaaattgcaacaagaaccaacgcttgttgaattgtataaaacaatggaattaccattacttcatgtgctttctcgcatggaacgtacaggcgttttgattgatagtaatgccctctttatgcaatctaacgaaattgccacaagattaaccgcacttgaagaacaagcttacgaattagcaggtcagccatttaatttggcttccaccaaacaattacaagaaattttgttcgataaacttggcctacctattttacaaaaaacgccaaaaggtgcgccatcaacgaatgaagaagtattggaagaattagcctatagccacgaattacccaaaattttggtcgaacatcgtgggttgagcaaacttaaatccacttacacggataaactgcctcaaatggtcaactcacaaacgggacgagtgcatacctcttatcatcaagcggtgacagcgacaggacgtttatcatcaagtgatccaaacttacaaaatatcccgattcggaatgaagaaggtcgtcgtattcgacaagcatttatcgcacgtgaaggttattctattgtcgctgctgactattctcaaattgagctacgcattatggcacatctttctggcgatcaaggcttaattaacgccttctctcaaggcaaggatattcatcgctccacggctgctgaaatcttcggtgtatcattagatgaagtcaccagcgagcaacgtcgcaatgctaaagcgattaatttcggcttaatttatgggatgtccgcgtttggactttcacgccaacttgatatttctcgtcctgatgcaaaaaaatacatggatttatatttccaacgctatccgagtgtacagcaatttatgaccgatatccgtgaaaaagcgaaagcacaaggctatgtggaaacgttatttggtcgccgtttatatttacctgatatcaattctagcaacgcaatgcgtcgtaaaggggcagaacgcgtagcgataaatgcaccgatgcaaggcacagctgcggatattattaaacgagcgatgattaaacttgatgaagtaatctatcacgatcccgacattgaaatgattatgcaagtacacgatgaattagtgtttgaagtgcggtcagaaaaagtcgagtttttccgtgaacaaattaaacaacaaatggaagatgcatcggaattagttgttccgttgatcgtagaagtcggtgtaggtcaaaattgggatgaagcgcat

SEQ ID NO: 4108 - protein, 785 aa, Haemophilus influenzae
  Name: NTH2294
MTILCSSTPMNNSLLDREGVIEKYGIPPELIIDYLALMGDSADNIPGVAGVGEKTALGLLQGIGSMAEIYANLEKVAELPIRGAKKLGEKLLAEKPNADLSYTLATIKTDVELNVTTDQLLLGESQKDQLIEYFARYEFKRWLNEVMNGADSITQTTEQPVKMNQYQATSQDQSAVENTPKIQIDRTKYETLLTQADLTRWIEKLNTAKLIAVDTETDSLDYMSANLVGISFALENGEAAYLPLQLDYLDAPKTLEKSTALAAIKPILENPDIHKIGQNIKFDESIFARHGIELQGVEFDTMLLSYTLNSTGRHNMDDLAKRYLGHETIAFESIAGKGKNQLTFNQIPLEQATEYAAEDADVTMKLQQALWLKLQQEPTLVELYKTMELPLLHVLSRMERTGVLIDSNALFMQSNEIATRLTALEEQAYELAGQPFNLASTKQLQEILFDKLGLPILQKTPKGAPSTNEEVLEELAYSHELPKILVEHRGLSKLKSTYTDKLPQMVNSQTGRVHTSYHQAVTATGRLSSSDPNLQNIPIRNEEGRRIRQAFIAREGYSIVAADYSQIELRIMAHLSGDQGLINAFSQGKDIHRSTAAEIFGVSLDEVTSEQRRNAKAINFGLIYGMSAFGLSRQLDISRPDAKKYMDLYFQRYPSVQQFMTDIREKAKAQGYVETLFGRRLYLPDINSSNAMRRKGAERVAINAPMQGTAADIIKRAMIKLDEVIYHDPDIEMIMQVHDELVFEVRSEKVEFFREQIKQQMEDASELVVPLIVEVGVGQNWDEAH

SEQ ID NO: 4109 - DNA, 345 bp, Haemophilus influenzae
  Name: NTH2296
atgaatttagaaagacttaacgaaattgaaaaaccattactccacatcgttaaacacgatgttgtgccagccctaggctgtaccgaacccatttctcttgcactcgcatctgctacagcggcgaaatatttaggcaaaacacctgaacgcattgaagtaaaagtttcgcctaatctgatgaaaaatggattgggcgttgcagtgccaggaacaggtatggttggattgcctattgctgcggcaatgaaggtattgtcgaacacgatcttgatcgaactattgataatctctgcgctattgcatcaaaaagtatgcagcatatcgacagacaggttatcgaaatta

SEQ ID NO: 4110 - protein, 115 aa, Haemophilus influenzae
  Name: NTH2296
MNLERLNEIEKPLLHIVKHDVVPALGCTEPISLALASATAAKYLGKTPERIEVKVSPNLMKNGLGVAVPGTGMVGLPIAAAMKVLSNTILIELLIISALLHQKVCSISTDRLSKL

SEQ ID NO: 4111 - DNA, 759 bp, Haemophilus influenzae
  Name: NTH2297
atggatttcaatcgaattatcactcatatgaatgatcatcatcaagatgatatggctgccctttgtaaaaaatttggtggcgaaaaggaaatcacagatgtgacgttagttaatgtagattttgctggtttagattttaaatataatggtggcaaaacattacgtgtggaatttccacaacaagctgacgcaggttcaattaagcaagctatcatcaatctttgtgtagaaaataaaccagtagcaaattacgatcgtattaaggctaaaattgatgaatttcgtcaagagtttaaaagctgtgtgctttctactttagataaagatggcttaccgatggcgtcttatgcaccaattattttctttgatggaaaatattatatttatatcagtgccattgcagagcattatgagaatttaaaacgcaatccaaatcaagtagaagtgatgtttttagaagatgaaaacaaagcgaagtcaattattgtgcgtactcgcttacgttataaagcaagtgcacgttttattcctcgtgaagatccaattgttgaaaaagtcttagataaattagccgaaactatgaatgatgtaggcggaattaaaacaattcgtgaatttactgattttgatttagttgaacttacatttggaacaggtcgttttgtaagaggttttggccaagcttatttgattgatgctaatggggaaatttctcatattggtgtcaaaggcaatccacatgaaaaagaaagtgataaa

SEQ ID NO: 4112 - protein, 253 aa, Haemophilus influenzae
  Name: NTH2297
MDFNRIITHMNDHHQDDMAALCKKFGGEKEITDVTLVNVDFAGLDFKYNGGKTLRVEFPQQADAGSIKQAIINLCVENKPVANYDRIKAKIDEFRQEFKSCVLSTLDKDGLPMASYAPIIFFDGKYYIYISAIAEHYENLKRNPNQVEVMFLEDENKAKSIIVRTRLRYKASARFIPREDPIVEKVLDKLAETMNDVGGIKTIREFTDFDLVELTFGTGRFVRGFGQAYLIDANGEISHIGVKGNPHEKESDK

SEQ ID NO: 4113 - DNA, 453 bp, Haemophilus influenzae
  Name: NTH2298
ttggctacattagaacaaaatttacaagaaatgctacaagatgcggtaaaggatttaggctgtgaattgtggggaattgagtgtcagcgcgtgggtcgttttatgacagttcgtttatttatagataaagaaggtggtgtgacagttgatgattgtgctgatgtaagtcgtcaagtgagcgcaattttagacgtggaagatccaattgcggataaatataatctagaagtgtcgtcacccggtttagatcgtccgctatttaccttgccgcaatttgaacgctatattgggcaagatatcgctgtgcatttgcgaattccagtgatggaacgccgtaaatggcaaggtaagttagagcgtattgaaaaggatatgattactttaatcgttgatgatcaagaacaaattttagtcttcggaaacattcaaaaagcgaatgttgttgcaaaattt

SEQ ID NO: 4114 - protein, 151 aa, Haemophilus influenzae
  Name: NTH2298
LATLEQNLQEMLQDAVKDLGCELWGIECQRVGRFMTVRLFIDKEGGVTVDDCADVSRQVSAILDVEDPIADKYNLEVSSPGLDRPLFTLPQFERYIGQDIAVHLRIPVMERRKWQGKLERIEKDMITLIVDDQEQILVFGNIQKANVVAKF

SEQ ID NO: 4115 - DNA, 1521 bp, Haemophilus influenzae
  Name: NTH2299
atgttgttgcaaaattttaaaaggagaaaaagagaaatgagtaaagaaattttactggcggcggaagctgtatccaatgaaaaattattaccacgtgagaaaatttttgaagcattagagagtgcgattgcgatttctactaagaagaagtttgaatatgaaacggatattcgcgtttcaattaatcccaaaacaggagaatttgatacttttcgccgttggttagtcgtagatgaagtaaaagtaccaacgaaggaaattactttggaagcggcgcaatttgatgatccaaatttgcaacttggagagtatgtagaagatcaaattgaatctattgcatttgaccgtattgcaatgcaaacggcacgtcaagttattagcactaaaattcgtgaagccgaacgtgcaaaagtggttgaacaatttcgtgaagaagaaggaaaaattgtaacaggcactgtaaaaaaagtaagtcgagacagtattattttagatcttggcaataaagcggaagcgatgattgcacgtgaagatatgttaccacgtgaaaacttccgtccgggagatcgtgttcgtggggtgctttataaagtaaatcctgaaggcaaaactgcacaattatttgtgacacgttctaaaccagaaatgttgatcgaattattccgtattgaagtgcctgaaattggcgaagaaatgattgaaattcgtggtgcagctcgtgatgctggctctcgcgctaaaattgcagtgaaatcaaatgataagcgaattgatccagttggtgcttgcgtaggaatgcgtggtgcgcgtgttcaggcaattacgaatgaacttggtggtgagcgtgtagatatcgtgctttgggatgataatccagcacaatttgtgattaatgcgatggcacctgcggatgtttcttctattatcgttgatgaagataatcattctatggatattgctgttgaagctgataatcttgctcaagccattggtcgtaatggtcaaaacgtgcgtttagcaacacaattaacgggttggacactaaacgtaatgacgactgatgagttaaatgctaagcatcaagcagaagataataaagtgttaaatttatttattaacgcattagaacttgatgaagaatttgcacaaatccttgtagaagaaggattcacaagtttagaagaaattgcttatgtgccaatgaatgaattgacagcaattgatggtttggaagatgaagatcttgttgaagagcttcaaactcgtgctaaaaatgcgattacagccgcagcagtagctgaagaagaagcactgaaaaaagcgaatgttgaagatcgtttattgaatttagagggaatgaatcgtcacgttgcaatcaaactagcagaaaaacaaattaccacccttgaagaactcgcagaacaaggcgttgatgatttaactgatattgaagaattaaccgcagaacaggccgcagatttaattatggctgcacgtaatatttgttggtttggcgaagaa

SEQ ID NO: 4116 - protein, 507 aa, Haemophilus influenzae
  Name: NTH2299
MLLQNFKRRKREMSKEILLAAEAVSNEKLLPREKIFEALESAIAISTKKKFEYETDIRVSINPKTGEFDTFRRWLVVDEVKVPTKEITLEAAQFDDPNLQLGEYVEDQIESIAFDRIAMQTARQVISTKIREAERAKVVEQFREEEGKIVTGTVKKVSRDSIILDLGNKAEAMIAREDMLPRENFRPGDRVRGVLYKVNPEGKTAQLFVTRSKPEMLIELFRIEVPEIGEEMIEIRGAARDAGSRAKIAVKSNDKRIDPVGACVGMRGARVQAITNELGGERVDIVLWDDNPAQFVINAMAPADVSSIIVDEDNHSMDIAVEADNLAQAIGRNGQNVRLATQLTGWTLNVMTTDELNAKHQAEDNKVLNLFINALELDEEFAQILVEEGFTSLEEIAYVPMNELTAIDGLEDEDLVEELQTRAKNAITAAAVAEEEALKKANVEDRLLNLEGMNRHVAIKLAEKQITTLEELAEQGVDDLTDIEELTAEQAADLIMAARNICWFGEE

SEQ ID NO: 4117 - DNA, 2565 bp, Haemophilus influenzae
  Name: NTH2301
ttgttggtttggcgaagaataaggagagcagtaatgactgaagatgttaaggctgatgcgccaaaaaaattaagcattcaacgcagaacaaaaacaacagtgagcagcaccacaactggcggtaaaagcaaagaagtacaagtagaagtacgtaaaaaacgcacagtaaaaactgatattgctcaacaagaagaagcaaaattaaaagcacagcaagaagcggaagcgaaaaaaattgctgaacaaaaagcagcagaagaaaaagctcgtttagaagctgaaaaagcggcaactaagaaagaagctgatgaaaaatcaaaagctgaaaaagcgaaagcagaaaccgctaagccagcaaaaagtgcggtagattctaaagctaaatttgttgatcctgaaaaagagaaacgtaaagcagaagaagctgaacttcgtcgtaaagctgaagaagtggctcgtcaaaaagcagaagaacaagctcgtcgtgcagcagaagaagctaaacgttatgctgaagcagatgattcagacaatgaatcttcttcagaagactattctgattacaatttaagttcaagatatgcacttgaagcagaagatgaagaagatcgtcgtaatgaaaatcgtggtcgaggtaaaaataaagtagcaaaagcaaaaaaaggcggtcgtgacgatgaaaatagcaaaaactcgaaaaacgagcgcgaatctaatcgtaaaaatcaaaaagatgctaagtttggtaaaggtaaaaatggaaaaaaaggcaccgcacttcaacaagcctttactaaaccagttcaagtagtaaaagcagatgttgtgattggcgaaaccattaccgttgcagaacttgcgaacaaaatgtcggtgaaagcgacagaaatcattaaagtgatgatgaaaatgggtgaaatggtcaccatcaaccaagttatcgatcaagaaaccgctcaattagtagcggaagaacttggtcataaagtaattcttcgcaatgaaaatgagcttgaagaagcggtattaggtgatcgcgatgtaaacgcggaaaaagtaacgcgtgcgccagttgtaactattatgggacacgttgatcacggtaaaacttctttacttgactatattcgtaaagcgaaagttgctgcaggcgaagcgggtggtattactcaacatatcggtgcgtatcacgtagaaatggatgatggcaaaatgatcaccttcttggatactccaggacacgcagcgtttacttctatgcgtgcacgtggcgcaaaagcaacagatatcgttgttcttgttgttgcggccgatgatggtgtgatgcctcaaactatcgaagcgattcaacacgcaaaagcagcgggtgcacctttagtggttgcagtaaataaaattgataaaccagaagcaaatccagatcgtgttgagcaagaattattacaacatgatgtcatttctgagaaattcggtggtgatgtgcaattcgttccagtatcggcgaagaaaggtactggggttgatgatttattagatgcaatcttacttcaatctgaagtgcttgaattgactgctgtaaaagacggcatggcaagtggtgtagtcattgaatcttacttggataaaggtcgtggccctgtggcaactatcttggttcaatcaggtacactacgtaaaggtgacatcgtactttgtggttttgaatatggccgtgcgcgcgcaatgcgtgatgaaaacgggaaagaagtggatgaagcaggtccttcaattccagttgaattattaggtctttcaggtgtgcctgcagcgggtgatgaagcaaccgttgtacgtgatgagaaaaaagcacgtgaagtggcattatatcgtcaaggtaaattccgtgaagtgaaattagctcgtcagcaaaaagctaaacttgaaaatatgtttagcaatatgtctgaaggcgatgtggctgaattgaacgttattgtgaaagcggatgtacaaggctctgtagaggcgattgttcaagcgttaaatgaactttctaccaatgaagtaaaagttaaagttgttggttcaggtgtaggtggtattactgaaactgatgcaactttagctaccgcatctaatgccatcattgttggctttaatgttcgagcggatgcaacagctcgtcgtgtcattgaagctgaaaacattgatttacgttactactcaatcatctatgaattgttgaatgaaattaaagcagcaatgagcggtatgttagagcctgaatttaaacaagaaattattggtttagctgaagttcgtgatgtattccgtcatccgaaatttggtgcaatcgcaggctgtatggtaactgagggtgtagtgaaacgtaacaacccaatccgtgtattacgtgacaacgtcgttatctttgaaggggaattagaatctcttcgccgtttcaaagatgatgtatctgaagttcgtaacggtatggaatgtggtatcggcgtgaaaaactacaacgatgtaaaagttggcgaccaaatcgaggtgtttgaagtggttgaggttaagcgttcaatc

SEQ ID NO: 4118 - protein, 855 aa, Haemophilus influenzae
  Name: NTH2301
LLVWRRIRRAVMTEDVKADAPKKLSIQRRTKTTVSSTTTGGKSKEVQVEVRKKRTVKTDIAQQEEAKLKAQQEAEAKKIAEQKAAEEKARLEAEKAATKKEADEKSKAEKAKAETAKPAKSAVDSKAKFVDPEKEKRKAEEAELRRKAEEVARQKAEEQARRAAEEAKRYAEADDSDNESSSEDYSDYNLSSRYALEAEDEEDRRNENRGRGKNKVAKAKKGGRDDENSKNSKNERESNRKNQKDAKFGKGKNGKKGTALQQAFTKPVQVVKADVVIGETITVAELANKMSVKATEIIKVMMKMGEMVTINQVIDQETAQLVAEELGHKVILRNENELEEAVLGDRDVNAEKVTRAPVVTIMGHVDHGKTSLLDYIRKAKVAAGEAGGITQHIGAYHVEMDDGKMITFLDTPGHAAFTSMRARGAKATDIVVLVVAADDGVMPQTIEAIQHAKAAGAPLVVAVNKIDKPEANPDRVEQELLQHDVISEKFGGDVQFVPVSAKKGTGVDDLLDAILLQSEVLELTAVKDGMASGVVIESYLDKGRGPVATILVQSGTLRKGDIVLCGFEYGRARAMRDENGKEVDEAGPSIPVELLGLSGVPAAGDEATVVRDEKKAREVALYRQGKFREVKLARQQKAKLENMFSNMSEGDVAELNVIVKADVQGSVEAIVQALNELSTNEVKVKVVGSGVGGITETDATLATASNAIIVGFNVRADATARRVIEAENIDLRYYSIIYELLNEIKAAMSGMLEPEFKQEIIGLAEVRDVFRHPKFGAIAGCMVTEGVVKRNNPIRVLRDNVVIFEGELESLRRFKDDVSEVRNGMECGIGVKNYNDVKVGDQIEVFEVVEVKRSI

SEQ ID NO: 4119 - DNA, 1398 bp, Haemophilus influenzae
  Name: NTH2303
atgacaggttctgcttccgatgcgtctgaaatgcagaaacacgtttacagtaaacaggaaaagcaaacgttagaacgtcgttttaaagacccgaacgatccgctgaaagtggtgattgtgcgtgatatgtggctgacaggctttgatgcaccgtgctgtaacactatgtatcttgataagccaatgaaagggcataacctaatgcaagccatcgcacgagtaaaccgtgtattccgcaataaaagccgagaaaatggcggcttgattgtggattatgtaggcattgctgacgagctcgaaaaagccactcggcaatatacaaactcacaaggcaagggcaaactggctgatagcgtgattgatgtattctttaaaatgaaagagcatttagaagttatccgcagcctgtttgcaacgccagttgaggggaaaacctttgatgttcaggctgccttagaaaaagataatccgaatgatcttttgatggcgattcgttttgccgccaaccatattttaagccttgatcaattatcgtttgatggcaaagcgcacgagcagcattggtttaataaaaaagaaaccgagccacgcaaaaaagcctttttgaaaacggcaggcttggtaaaaaaaggctatatgctgtgcggcacattggctgaagttgagccgtataaccaagaaatcgccttttatgatgccgtacgggcaattttaactaaacgtgaacaaaaaggcacaggcacaaatgaaagacagattttattgaaaaaattggtcaatcaaactgtgtattctgaaggcgtgattgatttattcgatctgctagaaaaaccacaaccacaaatcagtttgctttccgaggaatttttacaaactgtaaaaaatagcccaactaaaaatttatgggttagcgcgatggagcgttatttggcaagtgaaattaaagttaaatcaggcacaaacttaaccttgcaaaaagattttgaacggcgtttgaaggaagcattgaatcaataccacaatcacaatttgactgtggtagagattttggacgaactctttaaaatgagccaagatttccaagaacgtttagcattagggaaaaaactaggattaaccaaggaagaactagccttctatgaagctctatctcaaaatcaaagtgcaaaagatttgatgggtgatgaagtgctttctaaactggcgaaagaaatcacggaaacacttagaaaatcggtcacaatcgactggcagtacaaagaagcggtgcgggcaagaattagattactcgttcgacgtgccttacaaaaatataaatacccgcctgataaacaggaagaagcggtaacttatgtgattaaacaagctgaagaaattgctgaggatttaactggttta

SEQ ID NO: 4120 - protein, 466 aa, Haemophilus influenzae
  Name: NTH2303
MTGSASDASEMQKHVYSKQEKQTLERRFKDPNDPLKVVIVRDMWLTGFDAPCCNTMYLDKPMKGHNLMQAIARVNRVFRNKSRENGGLIVDYVGIADELEKATRQYTNSQGKGKLADSVIDVFFKMKEHLEVIRSLFATPVEGKTFDVQAALEKDNPNDLLMAIRFAANHILSLDQLSFDGKAHEQHWFNKKETEPRKKAFLKTAGLVKKGYMLCGTLAEVEPYNQEIAFYDAVRAILTKREQKGTGTNERQILLKKLVNQTVYSEGVIDLFDLLEKPQPQISLLSEEFLQTVKNSPTKNLWVSAMERYLASEIKVKSGTNLTLQKDFERRLKEALNQYHNHNLTVVEILDELFKMSQDFQERLALGKKLGLTKEELAFYEALSQNQSAKDLMGDEVLSKLAKEITETLRKSVTIDWQYKEAVRARIRLLVRRALQKYKYPPDKQEEAVTYVIKQAEEIAEDLTGL

SEQ ID NO: 4121 - DNA, 855 bp, Haemophilus influenzae
  Name: NTH2304
gtgatgtggcacacgcagggttcgggtaagtcgatttcgatgctgttttatgcaggcaaactgcttgcacagcctgaattgaaaaatcctaccattgtagtggttaccgaccgcaacgatttagatggtcagcttttccaaactttttcttcaggcaaagatttaatcaaacaaacaccgcagcaagtagaagaccgtgatcaactgcgccaactgctcgcacaaaatgaagtcggcggcgtgttttttactacgattcagaaattcgccctaaatgaggaagaaagccgcttccctattttaaatgagcgcaacaatattattgtgatcagcgatgaggctcaccgcagccaatatggctttacgcaaaagctgcataacggcaagtttcagacaggttatgctcgccatttgcgtgatgctttacctaatgcctcgtttattggttttacaggtacgccaattagccttgaagataaggacacgcaagatgtgttcggtcgttatgtgtccatttatgacttgcaagatgcggtggaagatggcgcaaccgtgccgattgtgtatgaagcacgccaaatcaagctagcggagaatgctaatcacgatgaattatttgcagaaattgatgaactgctggaaggcgaagaaaacccgaaattacgcttgcgagaaaaattgctcggctcagaagctcgattgcatgatttagcgatcgattttgtgcaacattttgcaaaacgcaatgaagtggtggacagcaaagcgatgatgggtggtttccagccgtcagatttgcgtgggatttgtataatcagatcatcgctctgcaccctgaatggcattcggacaata

SEQ ID NO: 4122 - protein, 285 aa, Haemophilus influenzae
  Name: NTH2304
VMWHTQGSGKSISMLFYAGKLLAQPELKNPTIVVVTDRNDLDGQLFQTFSSGKDLIKQTPQQVEDRDQLRQLLAQNEVGGVFFTTIQKFALNEEESRFPILNERNNIIVISDEAHRSQYGFTQKLHNGKFQTGYARHLRDALPNASFIGFTGTPISLEDKDTQDVFGRYVSIYDLQDAVEDGATVPIVYEARQIKLAENANHDELFAEIDELLEGEENPKLRLREKLLGSEARLHDLAIDFVQHFAKRNEVVDSKAMMGGFQPSDLRGICIIRSSLCTLNGIRTI

SEQ ID NO: 4123 - DNA, 114 bp, Haemophilus influenzae
  n 101, 102, 103, 104, 105: n is any nucleotide
  Name: NTH2305
ttgatggtatgccgcgatttttttaatggttttgccaacggaatcccgttcaaacaagacgaaatagcggagggtaccgagtctgatattcgtataccagnnnnnttaattaat

SEQ ID NO: 4124 - protein, 38 aa, Haemophilus influenzae
  Xaa 34, 35: Xaa is any amino acid
  Name: NTH2305
LMVCRDFFNGFANGIPFKQDEIAEGTESDIRIPXXLIN

SEQ ID NO: 4125 - DNA, 99 bp, Haemophilus influenzae
  Name: NTH2306
ttgtcagatgaagataacaataatatttctgcaaaaatattagaagtgataaatcagcaaaatatagaatattatggaggtcgcccttgggcaaaggaa

SEQ ID NO: 4126 - protein, 33 aa, Haemophilus influenzae
  Name: NTH2306
LSDEDNNNISAKILEVINQQNIEYYGGRPWAKE

SEQ ID NO: 4127 - DNA, 1554 bp, Haemophilus influenzae
  Name: NTH2307
atgaacattcaaactcaagcctttattgcggtgacagctcaatcaattccctattatgctgataccaccgctatttttaatacactttgccaacctaattcaaattctcttctactcgactctgccgaaatagggagtaaaaatagtttacaaagtcttattttagttaatgctgcggttaaaataacgtgcttaggtcacaacgtcacatttaaagctttaaataagaatggaaaacaagttttaaaagaaattcatccaaaattaaccgcacttggaaaaataagtgcggtcaattttgaagacgaattttctgtacaattttcgccacttgataatcaactcgatgaagataataaattacagtctgctactatttttgatgggttgcgtgttgtttctactctttatcaacatagccaaacgcctatttttttaggcggattatttgcttacgatctcgtcgcaaatttcattccaatggatggcattacattaaaaaatgatggtatcaactgccctgattacagtttctatcttgccgaacacttaattactatcgaccatcaaaatcaacaagcgacacttaaaagtttctgttttgctcaagaagaacaagtcaatattgcgaaaacctcgctttctatcgcacaaaaactaaaaaatattgatcacgttctttctattaaatcggcaagtgatgaagttaaaacaaactttgacgatcctgaatttactggtatcgtaaaagccttaaaacaccatattaatattggagatgttttccaaattgtgccttctcgtcgtttttcccttgcttgccctaatacattagccagttatgctcaactcaaacaaaataatccaagcccttatatgttctatatgaatgatgaagactttattttgtttggtgcatcgccagaaagtgcgctgaaatatgcgccagaaaatcgtcagttagaaatttacccaatcgcaggttcacgccctcgtggttttgatgctcacggcaacattgatcctgaattagatgcacgtttagaactggaacttcgtcttgatcataaagaacaagcggaacatttaatgttagttgatttagcgcgtaacgacattgctcgagtttgccaaaatggtacccgtaaagtggcagaattaatgcaagtggatcgctattctcacattatgcatttagtgtctcgtgtggtgggtaaattacgccctgaattagatgcacttcacgcctatcaagcctgtatgaatatgggcacattaactggtgcaccaaaaattaaagcgatgcagcttatttatcaatttgagcaacaaaaacgccatagttacggtggtgcggtgggttatctcacgtctgatggacattttgatacctgtatcgtgattcgttctgctttcgtacaaaatgggatagcccatgtacaagcaggttgcggtgaagtattggattctgatccacaaatggaagccgatgaaacacgccataaagcagcggctgtcttaaaagcaattcgtcaagttaatacacaagcaaaa

SEQ ID NO: 4128 - protein, 518 aa, Haemophilus influenzae
  Name: NTH2307
MNIQTQAFIAVTAQSIPYYADTTAIFNTLCQPNSNSLLLDSAEIGSKNSLQSLILVNAAVKITCLGHNVTFKALNKNGKQVLKEIHPKLTALGKISAVNFEDEFSVQFSPLDNQLDEDNKLQSATIFDGLRVVSTLYQHSQTPIFLGGLFAYDLVANFIPMDGITLKNDGINCPDYSFYLAEHLITIDHQNQQATLKSFCFAQEEQVNIAKTSLSIAQKLKNIDHVLSIKSASDEVKTNFDDPEFTGIVKALKHHINIGDVFQIVPSRRFSLACPNTLASYAQLKQNNPSPYMFYMNDEDFILFGASPESALKYAPENRQLEIYPIAGSRPRGFDAHGNIDPELDARLELELRLDHKEQAEHLMLVDLARNDIARVCQNGTRKVAELMQVDRYSHIMHLVSRVVGKLRPELDALHAYQACMNMGTLTGAPKIKAMQLIYQFEQQKRHSYGGAVGYLTSDGHFDTCIVIRSAFVQNGIAHVQAGCGEVLDSDPQMEADETRHKAAAVLKAIRQVNTQAK

SEQ ID NO: 4129 - DNA, 585 bp, Haemophilus influenzae
  Name: NTH2308
atggctaatattttatttttagataacttcgattccttcacttacaatcttgtggatcaatttcgtgtattaggtcacaacgtcacaatttatcgtaatgactgcgacttagaaaaactggtagaaaccgcactcaatatcaatacacttgataccattcttgcactttctccagggccaggaacaccatcagaagcggggattttactgccattgatcgaacgcttaaaaaatcaagtgccgattattggaatttgtttaggccatcaagcgttgattcaagcctttggtggtaaggttgttcacgctggcgaagtgttgcatggtaaagtttctcgtatatcccatgataacgaagctatgtttaaagatcttgctaatccaatgcctgcggcgcgttatcattctttaatgggacaagatttaccaaaagaatttatcgtcaatgcggaatataatggcattatcatggcaattcgtcatcgtgatttacccatttgcgcattccaatttcaccctgaaagtattttaactgtgcaaggttcgcaattattacaacaatcaattgaatggttgttaaataga

SEQ ID NO: 4130 - protein, 195 aa, Haemophilus influenzae
  Name: NTH2308
MANILFLDNFDSFTYNLVDQFRVLGHNVTIYRNDCDLEKLVETALNINTLDTILALSPGPGTPSEAGILLPLIERLKNQVPIIGICLGHQALIQAFGGKVVHAGEVLHGKVSRISHDNEAMFKDLANPMPAARYHSLMGQDLPKEFIVNAEYNGIIMAIRHRDLPICAFQFHPESILTVQGSQLLQQSIEWLLNR

SEQ ID NO: 4131 - DNA, 108 bp, Haemophilus influenzae
  Name: NTH2309
ttgttcacgacgtggtgcgagtttggatttaagtccgaatacggtgatcattttttctcctttaaagtgcggttaaaaatcaccgcacttttttctgtcttatctatt

SEQ ID NO: 4132 - protein, 36 aa, Haemophilus influenzae
  Name: NTH2309
LFTTWCEFGFKSEYGDHFFSFKVRLKITALFSVLSI

SEQ ID NO: 4133 - DNA, 261 bp, Haemophilus influenzae
  Name: NTH2310
ttgtgtttagaaaaagaagatttttactacccttttgatcgtagcgatgattacaccgtcatcgaaattaacctgatggctggtcgtatggaaggtacaaaaaaacgcttgataaaaatgctatttagcgaattagagtacaaactcggtattcgagctcacgatgtggaaattacgattaaagaacaaccggcacattgctggggtttccgaggaatgacaggcgatgaggcacgcgatttagattacgatatttatgtt

SEQ ID NO: 4134 - protein, 87 aa, Haemophilus influenzae
  Name: NTH2310
LCLEKEDFYYPFDRSDDYTVIEINLMAGRMEGTKKRLIKMLFSELEYKLGIRAHDVEITIKEQPAHCWGFRGMTGDEARDLDYDIYV

SEQ ID NO: 4135 - DNA, 252 bp, Haemophilus influenzae
  Name: NTH2311
atgcaacacaaccaattattagagcaactttatagcggacattcactttcaacctcagaaagcaccgcactttttaatgcagtcatccaaggtgagctttccaatgaacaaattgctgcaatgcttattgctttaaaagtgcgggaagcaaatactgaggaaattacgggtgcggttgccgcctcattacaaaatgccaaagtatttccacgtccagattatccttttgcggatattgtaggaaacgggtgg

SEQ ID NO: 4136 - protein, 84 aa, Haemophilus influenzae
  Name: NTH2311
MQHNQLLEQLYSGHSLSTSESTALFNAVIQGELSNEQIAAMLIALKVREANTEEITGAVAASLQNAKVFPRPDYPFADIVGNGW

SEQ ID NO: 4137 - DNA, 693 bp, Haemophilus influenzae
  Name: NTH2313
atgggagcaaaagtggcaaaacatggcaatcgtagcgtgtcgagtaaatcaggtgctagcgatgtgcttaccgcacttggcgttaatgtgaacgtcacaccagagcaagctcgacaagcattagatgaaattggtgtctgttttttatttgctcaacaatatcattctggcttccgtcatgttgcaccagtccgtaccgctttaaaaacgcacactatatttaatattttagggccgcttatcaatcctgctcgcccaacttatcatttacttggcgtatatgcgcctgaattagtaaaaacctatgctgaaaccgcagttgccttagaacatcaacattcctttgttgtacatggttctggcttagatgaagtcgcattgcacggcgaaacacaagtggcagaaattaaaaatggcaaaattgaatatttcactttaacgcctgaagattttggcttaaaaacgcaatccctcgaaagtcttcgcggtggtgaaccacaagaaaatacccaatatctgaccgcacttttacaaggcaaaggaaaggctgaacatgctaatgcggtggctgcaaatacggcattattattgaaattattcggttacgatgatttaaaacaaaatgtgcaaaatgtattggcgcatcttgcatcaggtaacgcctttaaaacattacagaaattaaccacatat

SEQ ID NO: 4138 - protein, 231 aa, Haemophilus influenzae
  Name: NTH2313
MGAKVAKHGNRSVSSKSGASDVLTALGVNVNVTPEQARQALDEIGVCFLFAQQYHSGFRHVAPVRTALKTHTIFNILGPLINPARPTYHLLGVYAPELVKTYAETAVALEHQHSFVVHGSGLDEVALHGETQVAEIKNGKIEYFTLTPEDFGLKTQSLESLRGGEPQENTQYLTALLQGKGKAEHANAVAANTALLLKLFGYDDLKQNVQNVLAHLASGNAFKTLQKLTTY

SEQ ID NO: 4139 - DNA, 1431 bp, Haemophilus influenzae
  Name: NTH2314
atgatgatcactcaagattttaccaaacccattgattccgctacggtgctacaaaaaatcgtgcttgataaagcacaatgggttaaagcaaaagaaaaggaatttcccctttcacaatttaaacaaaacattcaaaactctgaccgctctttttatgatgcgttagcaaaaggtacgcatcaaaagcccgcttacattttggaatgtaaaaaagcctccccttctaagggattaattcgtgctgaatttaatttggaagaaatcgccaatgtctataaacattatgcctctgctgtatctgttctgacagatgaaaaatacttccaaggcaattttgagttcttgccgttagttcgcggtatcgtgagccaacctgtgctttgcaaagattttatgattagcgaatatcaagtttaccttgctcgctactatcaagcggatgcgattttattaatgctttctgtggtaaatgatgaaacttatcgtgtgctggcagagcttgcacattctcttggcatgggcgtattgacagaaaccagcaatgaagaagaatttgaacgcgcccttgcgcttggtgcgaaaatcattggtgttaataatcgtaacttgcacgatttaactgtggatttaaatcgtgttgttaaactcactgaaaaatacgccgaccgaatccctgctgatgtacgtattattagcgaatcaggcatttacaatcacaagcaaattcatcaattacaaaaggtggcgcatggtttcttaattgggagtagcttaatgggcaaccaagatttgaataatgcggttcgctcggtgatttttggagaaaataaagtatgcggtttaacacgcacgcaagatgtcaaaatcgtttacgaaaacggggcactttacggcggattaatcttcgtagaacattcaaaacgttgtgtgagtttacgccaagcgcaagaattagtaaccgctgcgccacttcgatttgttggtgtttttcagaatcaagaaattgactttatcgtcaaaatagccaaccagttgcagctttatgcggtgcaattacatggtgcagaaactgaagcatttattaccgcacttcgccagcaactaccaaaaaacacgcaaatctggaaagcgatttcggtcaatactgaagcccaaagtacggtcgattttaccgatgatttgaatgtggatcgttatatttttgacagccagacagcgaaccaacaaggcggcacgggtaaaacctttgattggtcattaattcccgaacatcttaagcacaagattattttagctggaggtatctcgccaaataatgtagaacaagccattcaacaaaattgcttaggcttggatcttaattcaggagtagaaagttctgtgggcgtaaaagatcaagaaaaagtacggttagtttttaataatatttat

SEQ ID NO: 4140 - protein, 477 aa, Haemophilus influenzae
  Name: NTH2314
MMITQDFTKPIDSATVLQKIVLDKAQWVKAKEKEFPLSQFKQNIQNSDRSFYDALAKGTHQKPAYILECKKASPSKGLIRAEFNLEEIANVYKHYASAVSVLTDEKYFQGNFEFLPLVRGIVSQPVLCKDFMISEYQVYLARYYQADAILLMLSVVNDETYRVLAELAHSLGMGVLTETSNEEEFERALALGAKIIGVNNRNLHDLTVDLNRVVKLTEKYADRIPADVRIISESGIYNHKQIHQLQKVAHGFLIGSSLMGNQDLNNAVRSVIFGENKVCGLTRTQDVKIVYENGALYGGLIFVEHSKRCVSLRQAQELVTAAPLRFVGVFQNQEIDFIVKIANQLQLYAVQLHGAETEAFITALRQQLPKNTQIWKAISVNTEAQSTVDFTDDLNVDRYIFDSQTANQQGGTGKTFDWSLIPEHLKHKIILAGGISPNNVEQAIQQNCLGLDLNSGVESSVGVKDQEKVRLVFNNIY

SEQ ID NO: 4141 - DNA, 147 bp, Haemophilus influenzae
  Name: NTH2315
atgtgtttaggcgttccgggtcaaattgtcaaaattgatacaaattatcttcaacttgccacagtagatgtatgtagcgtacaacgtgaagtaaatatttctgggaaatccagccgatttacttggcaaatgggtggcttgttcatg

SEQ ID NO: 4142 - protein, 49 aa, Haemophilus influenzae
  Name: NTH2315
MCLGVPGQIVKIDTNYLQLATVDVCSVQREVNISGKSSRFTWQMGGLFM

SEQ ID NO: 4143 - DNA, 141 bp, Haemophilus influenzae
  Name: NTH2316
ttggcaaatgggtggcttgttcatgtgagctttgcaatgagtgttattgatgaagatgaagccaagaaaccccaaaaggctctgatcacaatgaggcaactcgaacacgaagttggagattttttaggattaaatcaaaaa

SEQ ID NO: 4144 - protein, 47 aa, Haemophilus influenzae
  Name: NTH2316
LANGWLVHVSFAMSVIDEDEAKKPQKALITMRQLEHEVGDFLGLNQK

SEQ ID NO: 4145 - DNA, 717 bp, Haemophilus influenzae
  n 716: n is any nucleotide
  Name: NTH2317
ttgactaaaccagtatttgccaacggcaacgcagcacaaatccgtgcagcaagccaaaccttggttcacgtgttagaaaaattattacgtttagcacatccgcttattccatttattactgaagaaatttggcaaaaagtgaaaggttttgtcggcattacggctgacagcattatgttgcaacctttcccacaagtggaagagaacggctttgatctagaagcagaagctgaaattgagtggttaaaagaagtgatcgttgcggtacgtaatatccgtgcagaaagcaacatcgcaccaagtaaaggcttagatctgttattccgtaatttaagcgcagagaatgcaaagattcttgaaaaacagaccgctcttttgaaagcaatggctaaattagataacgttcaagtgttagctgcaaacgaagcagcaccgcttgcggtagcgaaactcgttggcaatgcggaattactcgtgccaatggctggctttatcaataaagaagcagagcttgcccgtttaaccaaagagattgaaaaatatcaaaacgaagttaaacgcatcgagaataaacttagcaatgaatcttttgtggctaaagcacctgaagcagtgattgcgaaagaacgagaaaaacaagcggaataccaatctggattagaaaaaatccaagagcagtataaggcgattgaggcattgtaccaaaacataaaaang

SEQ ID NO: 4146 - protein, 239 aa, Haemophilus influenzae
  Xaa 239: Xaa is any amino acid
  Name: NTH2317
LTKPVFANGNAAQIRAASQTLVHVLEKLLRLAHPLIPFITEEIWQKVKGFVGITADSIMLQPFPQVEENGFDLEAEAEIEWLKEVIVAVRNIRAESNIAPSKGLDLLFRNLSAENAKILEKQTALLKAMAKLDNVQVLAANEAAPLAVAKLVGNAELLVPMAGFINKEAELARLTKEIEKYQNEVKRIENKLSNESFVAKAPEAVIAKEREKQAEYQSGLEKIQEQYKAIEALYQNIKX

SEQ ID NO: 4147 - DNA, 1275 bp, Haemophilus influenzae
  Name: NTH2318
ttgccgatgaatatgtgggatcgtgaattcggtacaggtgtcgtgaaaatcaccccagcacacgatttcaacgactacgaagtgggtaaacgtcataacttaccaatggtaaatgtattgacgctgaacgcaaatattcgtgatgaagcggaaattatcggtactgacggcaaaccacttgctggctatgaagcgacaattcctgcggattaccgtggcttagaacgttttgctgcgcgtaagaaaattgtcgcagattttgaagcactgggtttattagacgaaattaaaccacacgatttgaaagtgccttatggcgaccgtggcggtgtgccaatcgagccgatgctaactgaccaatggtatgtgagcgtgaaaccgcttgctgatgtagcaatcaaagcggtagaagacggcgaaatccaattcgtgccgaaacaatatgaaaacctttacttctcttggatgcgtgatattcaagattggtgtatttctcgccaactttggtggggacaccgtattccagcgtggtatgacgcagaaggtaacgtttatgtcgcgcgtaacgaagaagaagtgcggtcaaaatacaacttagattctgcggttgaactcaaacaagatgaagatgtgttagacacatggttctcatcaggcttatggacgttctctaccttaggttggccagagcaaaccaaagagctcaaaatgttccatccaacggatgtgttaatcacaggcttcgacatcatcttcttctgggttgcgcgtatgattatgtttacgatgcactttgtgaaagatgaaaatggcaaacctcaagtgccattcaaaactgtgtatgtaacaggcttgatccgtgatgagcaaggtcaaaaaatgtcgaaatcgaaaggtaacgtacttgatccaatcgatatgattgacggtatcagccttgaagatttacttgaaaaacgcactggcaacatgatgcagccgcaattagcagagaaaattgccaaagcaacccgtaaagaatttgcggacggcattgctgctcacggtacagacgcattgcgttttacattagcggcgttggcttcaaatggtcgtgatatcaactgggatatgaaacgtttagaaggttaccgtaacttctgtaacaaattgtggaatgcaagccgtttcgtcttaacgaatgaaaaattagatttaagtgaaggcgagatcgaattctcattagcggatcgttggattcaatcggaattcaatcgcacagtgggaaacgttccg

SEQ ID NO: 4148 - protein, 425 aa, Haemophilus influenzae
  Name: NTH2318
LPMNMWDREFGTGVVKITPAHDFNDYEVGKRHNLPMVNVLTLNANIRDEAEIIGTDGKPLAGYEATIPADYRGLERFAARKKIVADFEALGLLDEIKPHDLKVPYGDRGGVPIEPMLTDQWYVSVKPLADVAIKAVEDGEIQFVPKQYENLYFSWMRDIQDWCISRQLWWGHRIPAWYDAEGNVYVARNEEEVRSKYNLDSAVELKQDEDVLDTWFSSGLWTFSTLGWPEQTKELKMFHPTDVLITGFDIIFFWVARMIMFTMHFVKDENGKPQVPFKTVYVTGLIRDEQGQKMSKSKGNVLDPIDMIDGISLEDLLEKRTGNMMQPQLAEKIAKATRKEFADGIAAHGTDALRFTLAALASNGRDINWDMKRLEGYRNFCNKLWNASRFVLTNEKLDLSEGEIEFSLADRWIQSEFNRTVGNVP

SEQ ID NO: 4149 - DNA, 105 bp, Haemophilus influenzae
  Name: NTH2319
gtgcatcctgaagatgagcgttatcaatctttaattggtaaaactgttgttctaccactggctaatcgtgaaattccgattattgccgatgaatatgtgggatcg

SEQ ID NO: 4150 - protein, 35 aa, Haemophilus influenzae
  Name: NTH2319
VHPEDERYQSLIGKTVVLPLANREIPIIADEYVGS

SEQ ID NO: 4151 - DNA, 450 bp, Haemophilus influenzae
  Name: NTH2321
atgtggtggaacgtaaaatttgcggctgaagaaggcaaactcgccacgattatggtcgtgaagcgttcatcaacaaaattttgggattggaaagcttattcaggtggcacaatcagccaacaaatgcgccgtttagggaactcaatcgactgggaacgtgagcgtttcaccatggacgatggtttatcgaatgcagtaaaagaagtgtttgttcgtttgcacgaagaaggtttgatttaccgtggcaaacgcttagtaaactgggatccaaaacttcacaccgcaatttctgatttagaagtagaaaacaaagagagcaaaggctccctttggcatttccgttatccgttagcaaacggtgcaaaaacggcagatggtaaagattatttagtggtggcaaccacccgtccagaaaccatgttgggcgatacggcttgttgcagtgcatcc

SEQ ID NO: 4152 - protein, 150 aa, Haemophilus influenzae
  Name: NTH2321
MWWNVKFAAEEGKLATIMVVKRSSTKFWDWKAYSGGTISQQMRRLGNSIDWERERFTMDDGLSNAVKEVFVRLHEEGLIYRGKRLVNWDPKLHTAISDLEVENKESKGSLWHFRYPLANGAKTADGKDYLVVATTRPETMLGDTACCSAS

SEQ ID NO: 4153 - DNA, 306 bp, Haemophilus influenzae
  Name: NTH2322
atgacacaaaaattcgaaatggcagaccgttttaatccgtctgcggtagaacaagccctttatcaacattgggaagagagcggttattttaaaccgtctgaaaatgaaaatgcgccgagctattgcattgcaattccgccgccgaacgtaacagggttctttacatatgggacacgcattcccacaaaccttatggataccttaacccgttttaccgtatgggaggggcatacacccttatgggcagcggggacagaccacgcaggtattgcaacccaaaatgtggtggaacgtaaaatttgcggc

SEQ ID NO: 4154 - protein, 102 aa, Haemophilus influenzae
  Name: NTH2322
MTQKFEMADRFNPSAVEQALYQHWEESGYFKPSENENAPSYCIAIPPPNVTGFFTYGTRIPTNLMDTLTRFTVWEGHTPLWAAGTDHAGIATQNVVERKICG

SEQ ID NO: 4155 - DNA, 399 bp, Haemophilus influenzae
  Name: NTH2323
atgaatttttcttatattttagaacaacttaaaagttttactattgaggacgttattctcaaaatctgttattttgttatctcaattatcgtaggtaaagtttcacggcaatgttggaagctgattagaatatacgttaatgaatgtagaacgattagagagctttctgaatcagataaagaatttattcaaaataataattttgaatttgaagtcgataaggaaaatgaataccaaaatttagaagagctaaagcggaaaggattagtaaatattgagttttgtgaggatgaattacaagatgcctcaggaatttatttatgtactgtaacaaataaaaatagattaaaaatttcattaacgaaatttggaaaacaaataaaatatcttatagaaaaa

SEQ ID NO: 4156 - protein, 133 aa, Haemophilus influenzae
  Name: NTH2323
MNFSYILEQLKSFTIEDVILKICYFVISIIVGKVSRQCWKLIRIYVNECRTIRELSESDKEFIQNNNFEFEVDKENEYQNLEELKRKGLVNIEFCEDELQDASGIYLCTVTNKNRLKISLTKFGKQIKYLIEK

SEQ ID NO: 4157 - DNA, 126 bp, Haemophilus influenzae
  Name: NTH2324
atggcaccaagccgtcgtagtgatgttgctcgtttaggtatcaaagccgttatcgctggtactctcgctaacttaatgagtgcaactattgctggtttatttatcggcttaggtgctgcagcactt

SEQ ID NO: 4158 - protein, 42 aa, Haemophilus influenzae
  Name: NTH2324
MAPSRRSDVARLGIKAVIAGTLANLMSATIAGLFIGLGAAAL

SEQ ID NO: 4159 - DNA, 714 bp, Haemophilus influenzae
  Name: NTH2325
atgactccacatattaacgcgcctgaaggtgcatttgctgatgttgttttaatgcctggcgatccacttcgtgcaaaatatattgcagaaacttttttacaagatgttgttgaagtaacgaatgttcgtaatatgcttggttttactggaacttataaaggtcgtaaaatttctattatggggcacggtatggggattccatcttgctctatttacgcgaaagaattaatcactgaatatggcgtgaaaaaaattatccgtgtaggttcttgtggcactgttcgtatggacgtgaaagtgcgcgatgtgattatcggtttaggtgcatgtactgattcaaaagtaaaccgtattcgtttcaaagataacgactttgcagctattgctgactttgatatggcacaagccgctgttcaagctgcaaaagcaaaaggtaaagtcgttcgtgtaggtaatttattctcggcggatttattctatacacccgatgtggaaatgttcgatgtaatggaaaaatacggcattttaggtgtggaaatggaagctgctggaatttatggtgtggctgcagaatatggtgcaaaagcattaacgatttgtaccgtgtctgaccatattcgtactcacgaacaaaccacggcagaagaacgtcaattaacattcaatgatatgattgaaattgcgttagattcagtattaattggtgatgcacta

SEQ ID NO: 4160 - protein, 238 aa, Haemophilus influenzae
  Name: NTH2325
MTPHINAPEGAFADVVLMPGDPLRAKYIAETFLQDVVEVTNVRNMLGFTGTYKGRKISIMGHGMGIPSCSIYAKELITEYGVKKIIRVGSCGTVRMDVKVRDVIIGLGACTDSKVNRIRFKDNDFAAIADFDMAQAAVQAAKAKGKVVRVGNLFSADLFYTPDVEMFDVMEKYGILGVEMEAAGIYGVAAEYGAKALTICTVSDHIRTHEQTTAEERQLTFNDMIEIALDSVLIGDAL

SEQ ID NO: 4161 - DNA, 102 bp, Haemophilus influenzae
  Name: NTH2326
atgagccgtttgtggctcatatttttgtgtggtgcaatgaatcttgcactaaaaattatcggggagctatttaatagcgttattacccaattagaggaaaac

SEQ ID NO: 4162 - protein, 34 aa, Haemophilus influenzae
  Name: NTH2326
MSRLWLIFLCGAMNLALKIIGELFNSVITQLEEN

SEQ ID NO: 4163 - DNA, 426 bp, Haemophilus influenzae
  Name: NTH2327
atggcaaaaaaagtccaagcctatgttaagttgcaagttgcagctggtatggctaacccatcaccaccagttggtcctgcattaggtcagcaaggtgtgaacattatggaattctgtaaagcattcaacgctcgtactgagagcttagaaaaaggtttaccaattccagttgttatcactgtatatgcagaccgttcatttactttcgtcactaaaactccaccagcagcagtattattgaaaaaagctgcaggtatcaaatctggttctggtaaaccgaacaaagataaagtgggtaaagtaactttagatcaagttcgtcaaatcgctgaaactaaagcagcagatatgactggtgcgactatcgaaacgaaaatgaaatcaatcgctggtactgctcgttcaatgggcttagtggtggaggaa

SEQ ID NO: 4164 - protein, 142 aa, Haemophilus influenzae
  Name: NTH2327
MAKKVQAYVKLQVAAGMANPSPPVGPALGQQGVNIMEFCKAFNARTESLEKGLPIPVVITVYADRSFTFVTKTPPAAVLLKKAAGIKSGSGKPNKDKVGKVTLDQVRQIAETKAADMTGATIETKMKSIAGTARSMGLVVEE

SEQ ID NO: 4165 - DNA, 687 bp, Haemophilus influenzae
  Name: NTH2328
atggctaaattgactaaaaaaatgaaagcaatcaaagctggcgtagattctactaaagcatacgaaattaacgaagcgattgcggtattaaaacaattcgcaacggctaaattcgttgaaagtgttgatgttgcagtaaacttaggtatcgatcctcgtaaatctgaccaaaacgttcgtggtgcaactgtattaccacacggtactggtcgtgaagtacgtgtagctgtgttcactcaaggtgctaacgcagatgcagctaaagaagctggtgctgatttagtaggtatggaagatttagcagagcaaatcaaaaaaggcgaaatgaactttgatgttgttatcgcttctcctgatgcaatgcgtgttgttggtcaattaggtcaagtattaggcccacgtggtttaatgccaaaccctaaagttggtactgtaacaccaaacgttgctgaagcagttaaaaatgctaaatctggtcagatccgttatcgtaatgataaaaacggtatcatccacaccactatcggtaaagcaaacttctctgaagttcaattaaaagaaaatcttcaagcattattggctgctttaaataaagcaaaaccaactactgctaaaggtattttcatcaagaaagtaagcatctctaccactatgggtgcaggtgttgctgttgatcaagcttcttta

SEQ ID NO: 4166 - protein, 229 aa, Haemophilus influenzae
  Name: NTH2328
MAKLTKKMKAIKAGVDSTKAYEINEAIAVLKQFATAKFVESVDVAVNLGIDPRKSDQNVRGATVLPHGTGREVRVAVFTQGANADAAKEAGADLVGMEDLAEQIKKGEMNFDVVIASPDAMRVVGQLGQVLGPRGLMPNPKVGTVTPNVAEAVKNAKSGQIRYRNDKNGIIHTTIGKANFSEVQLKENLQALLAALNKAKPTTAKGIFIKKVSISTTMGAGVAVDQASL

SEQ ID NO: 4167 - DNA, 3894 bp, Haemophilus influenzae
  Name: NTH2329
atgggttactcctattctgaaaaaaaacgaattcgtaaagatttcggtaaacgtccgcaagttttaaatgttccttatttattaaccattcagttggattcttttgataaatttattcaaaaagatcctgaaggtcagcaaggtttagaagcggcattccgttctgtatttcctattgtaagcaataatggctatacagaattacaatatgtagattatcgtttagaagagccagagtttgatgtacgtgagtgccaaattcgtggctcaacttatgcagcaggcttacgtgtaaaattacgtttagtgagctacgataaagaatcttcttcacgcgcagttaaagatattaaagaaaatgaagtttatatgggggaaatcccattaatgactgataacggtacttttgtaattaatggtaccgagcgtgttatcgtttcacaattacaccgtagtccaggtgtattctttgattctgacaaaggtaaaacccattcttcaggtaaagtgctttataacgcacgcattattccttaccgtggttcttggttagattttgaattcgatccaaaagataacttatttgcgcgcattgaccgtcgccgtaaattaccggcaacaatcattcttcgtgcattaggctacaccactgaagaaatcttaaacttattctttgataaaattacctttgaaatcgctggcgataaattgttaatgactttagtgccagaacgtttacgtggtgaaacggcttcttttgatattgaagcaaatggcaaagtgtatgttgaacgtggtcgtcgcatcactgctcgtcacattaaagcattagaaaaagataatatctcacaagtggttgtgccttctgaatatattttaggtaaagttgcgtcgaaagattatgttgatttagagtctggcgaaattatttgtcctgcaaatggcgaaatttcgttagaaaccctcgcaaaattagcacaagctggttacaccacgatcgaaactttatttactaatgatttagattacggtccatatatttctgaaacgctacgtgtcgatccaacttatgacaaaactagtgcgctttacgaaatttatcgtatgatgcgtccgggcgagccaccaacaccagaatcttcagaagcgttattcaataatttattcttctctgcagaacgttatgatttatctacagtaggtcgtatgaagttcaaccgttctttagcttttccagaaggggaaggtgcgggtattttaagcaatgaagatattattgcggtaatgcgtaaattgatcgacatccgtaatggtcgtggcgaagtagacgatattgaccatttgggtaaccgtcgtatccgtagcgtgggcgaaatggctgaaaaccaattccgtatcggtttagtgcgtgttgaaagagcggtcaaagaacgtctatctttaggcgatttagatgcgatcacgccacaagacttaattaacccgaaaccgatttctgcggcagtaaaagaattctttggttcttcacagctttcgcaatttatggatcaaaacaacccattgtcagaagtgacacacaaacgtcgtatttctgcattaggtccaggcggtttaacgcgtgagcgtgcaggctttgaagtgcgtgacgtacataatactcactatggtcgtttatgtccgattgaaacccctgaaggtccaaacatcggtttgatcaactcactttctgcttttgcacgtactaatgattatggtttcttagaaacaccatatcgtaaagtggttgatggtcaagttactgaagaaattgaatacttatctgtaattgatgaagcaaactacatcattgcacaggcaaactcaaacttagacgaaaataaccgttttactgatgctttcgttactgctcgtggtgaacgtggtgaatctggtttatataaacctgaagatattcactatatggatgtttcgacacaacaagtggtatctgttgcggctgcattaattccattccttgagcatgacgatgcgaaccgtgcgttgatgggtgcgaacatgcaacgtcaagcagttccaacattacgtgcggataaaccattagttggtacaggtatggaaaaaccaatcgcacttgactcaggtgttgcggttgttgcaaaacgtggtggtaccgttcagtacgttgatgcgtctcgtattgtgattaaagtaaatgaagatgaaaccattgcaggtgaagctggtattgatatttataatttaattaaatacacccgctctaaccaaaatacttgtattaaccaaattccttgtgtgaatttaggcgatccaattaatcgtggcgaagtattagcagatggtccttcaactgatttaggggaacttgcattaggtcaaaatattcgcgtggcgttcatgccttggaacggctataacttcgaagactcaatgttagtttctgaacgtgttgttcaacaagaccgtttcactacgatccatattcaagaattatcttgtgttgcgcgtgatactaagttaggtgcagaagaaattactgcggatattccaaacgtaggtgaatcagcgttaagcaaacttgatgaatctggtatcgtttatgtcggtgctgaggttaaaggtggcgacatcttagtaggtaaagtaacccctaaaggcgaaactcaattaaccccagaagaaaaattgttacgtgcaatctttggggaaaaagcttccgatgtgaaagattcttcattacgcgtgccaaatggtacatcaggtacggttattgatgttcaagtcttcactcgtgatggcgtagaaaaagataaacgtgcattagaaatcgaagaaatgcaacttcgtgaagcgaaaaaagatttaactgaagagttagagattttagaagctggtttatttgctcgtgtgcgtaatcttcttatttctagtggtgcggatgcagcacaattagataaagtagatcgcactaaatggttagaacaaaccattgcagatgaagaaaaacaaaaccaattagaacagcttgctgagcaatacgaagaacttcgtaaagagtttgaacataaacttgaagtgaaacgtaagaaaatcattaaaggcgatgatcttgcaccgggcgtattaaaagttgtgaaagtttaccttgcagtgaaacgtcaaatccagccgggggataaaatggcgggtcgtcacggtaacaaaggtgttatctcgaaaattaacccagttgaagatatgccatacgatgaaaatggtcagccagttgaaatcgtattaaacccactgggcgtaccgtctcgtatgaacatcggtcagatccttgaaactcacttaggtttagctgcaaaaggtattggtgatcaaatcaatgcaatgcttaaacaaaaacaagaagtggaaaaattacgtagctatatccaaaaagcatacgatttattaggtaatggttcacaaaaagtggatttaagcacttttactgatgaagaagtattgcgtttagcgggaaatttacgtaagggcttaccagttgcaacgccagtgttcgatggtgcagacgaagcggaaatcaaagagctattaaaacttggtggattaccaacttcaggtcaaataaccctttacgatggtcgtactggcgagaaatttgaacgtccagtaaccgtgggttatatgtacatgctaaaattgaaccacttagttgatgataaaatgcacgctcgttcaacaggttcttatagccttgttacacaacagccactgggtggtaaagcacaatttggtggtcagcgtttcggtgagatggaggtatgggcacttgaagcatatggtgcagcctacaccttacaagaaatgctaactgtgaatccgatgatg

SEQ ID NO: 4168 - protein, 1298 aa, Haemophilus influenzae
  Name: NTH2329
MGYSYSEKKRIRKDFGKRPQVLNVPYLLTIQLDSFDKFIQKDPEGQQGLEAAFRSVFPIVSNNGYTELQYVDYRLEEPEFDVRECQIRGSTYAAGLRVKLRLVSYDKESSSRAVKDIKENEVYMGEIPLMTDNGTFVINGTERVIVSQLHRSPGVFFDSDKGKTHSSGKVLYNARIIPYRGSWLDFEFDPKDNLFARIDRRRKLPATIILRALGYTTEEILNLFFDKITFEIAGDKLLMTLVPERLRGETASFDIEANGKVYVERGRRITARHIKALEKDNISQVVVPSEYILGKVASKDYVDLESGEIICPANGEISLETLAKLAQAGYTTIETLFTNDLDYGPYISETLRVDPTYDKTSALYEIYRMMRPGEPPTPESSEALFNNLFFSAERYDLSTVGRMKFNRSLAFPEGEGAGILSNEDIIAVMRKLIDIRNGRGEVDDIDHLGNRRIRSVGEMAENQFRIGLVRVERAVKERLSLGDLDAITPQDLINPKPISAAVKEFFGSSQLSQFMDQNNPLSEVTHKRRISALGPGGLTRERAGFEVRDVHNTHYGRLCPIETPEGPNIGLINSLSAFARTNDYGFLETPYRKVVDGQVTEEIEYLSVIDEANYIIAQANSNLDENNRFTDAFVTARGERGESGLYKPEDIHYMDVSTQQVVSVAAALIPFLEHDDANRALMGANMQRQAVPTLRADKPLVGTGMEKPIALDSGVAVVAKRGGTVQYVDASRIVIKVNEDETIAGEAGIDIYNLIKYTRSNQNTCINQIPCVNLGDPINRGEVLADGPSTDLGELALGQNIRVAFMPWNGYNFEDSMLVSERVVQQDRFTTIHIQELSCVARDTKLGAEEITADIPNVGESALSKLDESGIVYVGAEVKGGDILVGKVTPKGETQLTPEEKLLRAIFGEKASDVKDSSLRVPNGTSGTVIDVQVFTRDGVEKDKRALEIEEMQLREAKKDLTEELEILEAGLFARVRNLLISSGADAAQLDKVDRTKWLEQTIADEEKQNQLEQLAEQYEELRKEFEHKLEVKRKKIIKGDDLAPGVLKVVKVYLAVKRQIQPGDKMAGRHGNKGVISKINPVEDMPYDENGQPVEIVLNPLGVPSRMNIGQILETHLGLAAKGIGDQINAMLKQKQEVEKLRSYIQKAYDLLGNGSQKVDLSTFTDEEVLRLAGNLRKGLPVATPVFDGADEAEIKELLKLGGLPTSGQITLYDGRTGEKFERPVTVGYMYMLKLNHLVDDKMHARSTGSYSLVTQQPLGGKAQFGGQRFGEMEVWALEAYGAAYTLQEMLTVNPMM

SEQ ID NO: 4169 - DNA, 114 bp, Haemophilus influenzae
  Name: NTH2330
gtggtttacgatcacactaaattatctgaaaaaatatggaaaaatcagtgcttgattatgcaacaccaaaatggaaaggcaaaatcggttatgtatcaacttctggcgcgttct

SEQ ID NO: 4170 - protein, 38 aa, Haemophilus influenzae
  Name: NTH2330
VVYDHTKLSEKIWKNQCLIMQHQNGKAKSVMYQLLARS

SEQ ID NO: 4171 - DNA, 474 bp, Haemophilus influenzae
  Name: NTH2331
atgaaaggggacaaagttgcgcttaattggttaaaaggtttaaaagagaacggaaaactttacgctaaaaatagtgtggcattacaagcggttgaaaatggcgaagtacctgctgcgttaatcaataactattattggtataacctagcaaaagaaaaaggcgtggaaaacctaaaaagccgtctttattttgttcgccaccaagatccaggtgcgttagttagctattcaggtgcagcagtattgaaagcttctaaaaatcaagctgaagcacaaaaatttgttgatttcttagcgagtaaaaaaggtcaagaggcattagtggcagcgcgtgcagaatatccgttacgtgctgatgtggtttcgccatttaatcttgaaccttatgaaaaattagaagcaccagtggtgtccgcaacaacagctcaagataaagaacatgcgatcaaattaattgaagaagctggattgaaa

SEQ ID NO: 4172 - protein, 158 aa, Haemophilus influenzae
  Name: NTH2331
MKGDKVALNWLKGLKENGKLYAKNSVALQAVENGEVPAALINNYYWYNLAKEKGVENLKSRLYFVRHQDPGALVSYSGAAVLKASKNQAEAQKFVDFLASKKGQEALVAARAEYPLRADVVSPFNLEPYEKLEAPVVSATTAQDKEHAIKLIEEAGLK

SEQ ID NO: 4173 - DNA, 90 bp, Haemophilus influenzae
  Name: NTH2332
gtgcgtgtatttgaaaaaattcacgcacgcgtttacaattctctaacaaaattaaccgcttgcgtgcgtgaactgaaaggttcacattcc

SEQ ID NO: 4174 - protein, 30 aa, Haemophilus influenzae
  Name: NTH2332
VRVFEKIHARVYNSLTKLTACVRELKGSHS

SEQ ID NO: 4175 - DNA, 1518 bp, Haemophilus influenzae
  Name: NTH2333
ttgcctcgcagaccgccattctggctcactttacttatcatcttaatcgggcttccgttatgtttgccgtttctgtatgtcattttgcgtgcgacagaagtgggattaacgcgaagtgttgagctattgtttcgccctcgaatggctgaattattaagcaatacaatgcttttaatggtttgtgtaactatcggtgctatttcacttggcacgctttgtgcttttttacttgaacgttatcgctttttcggtaaagctttttttgaagtggcgatgacgttacccctttgtattcccgcctttgtaagttgttttacttggatcagcctcacattccgcgttgaaggtttttggggaacaattggtattatgacattaagttcatttcctttggcttatttgcccgtttccgctatattaaaaagacttgatcgttctcttgaagaagtaagcctttcgctgggtaaaagccctgtgtataccttttggtatgttattttcccgcaacttaaacccgccattggtagtagtatcttactgattgctttacatatgttgatcgaatttggtgcagtgtcaattttaaattatcaaacctttaccactgccattttccaagaatatgaaatgtcttttaacaacagcactgctgcattattatccgccgttttaatggcgatttgtatacttattgtttttggggaaattttctttcgtggaaaacaaaccctttaccacagtggaaaaggtgttacgcgtccttatctcgtaaaaacactttcctttggaaaacaatgtttaaccttcggatttttctctagcatattcattttaagcattggcgtgcctgtgattatgttaatttactggcttatcgtggggacttcacttgaaagtgcgggcgatttttcagaatttttatcggcattcagcaattcatttatcatttcaggcttaggcgcattgcttaccgtaatgtgcgccttgccattagtttgggcagctgttcgttaccgtagttatttaacgatttggatcgaccgcttgccatatctattacacgctgtgccaggcttagtcattgccttatcattagtctatttttccatccattacgctaacgacctatatcaaaccttttttgtgattatcattgcctactttatgctctatttgccaatggcacaaactacattaagagcgtctttagagcaactttccgatcaaattgaaaaagtcggacaaagtcttgggcgaagccctttctatatttttcgcaccttgacgctaccagccatattaccaggtgtggccgccgcatttgctttggtttttttgaatttaatgaaagagcttaccgcgacgcttttgctcacatcaaatgatattaaaaccttatccattgctgtgtgggaacataccagcgatgcgcaatatgctgccgccaccccttatgcgttaatgctcgttcttttttcgggtattcctgtatttttattgaaaaaatatgcgtttaaa

SEQ ID NO: 4176 - protein, 506 aa, Haemophilus influenzae
  Name: NTH2333
LPRRPPFWLTLLIILIGLPLCLPFLYVILRATEVGLTRSVELLFRPRMAELLSNTMLLMVCVTIGAISLGTLCAFLLERYRFFGKAFFEVAMTLPLCIPAFVSCFTWISLTFRVEGFWGTIGIMTLSSFPLAYLPVSAILKRLDRSLEEVSLSLGKSPVYTFWYVIFPQLKPAIGSSILLIALHMLIEFGAVSILNYQTFTTAIFQEYEMSFNNSTAALLSAVLMAICILIVFGEIFFRGKQTLYHSGKGVTRPYLVKTLSFGKQCLTFGFFSSIFILSIGVPVIMLIYWLIVGTSLESAGDFSEFLSAFSNSFIISGLGALLTVMCALPLVWAAVRYRSYLTIWIDRLPYLLHAVPGLVIALSLVYFSIHYANDLYQTFFVIIIAYFMLYLPMAQTTLRASLEQLSDQIEKVGQSLGRSPFYIFRTLTLPAILPGVAAAFALVFLNLMKELTATLLLTSNDIKTLSIAVWEHTSDAQYAAATPYALMLVLFSGIPVFLLKKYAFK

SEQ ID NO: 4177 - DNA, 1068 bp, Haemophilus influenzae
  Name: NTH2335
atgcgtttaaataaaatgataaataatccgttattaaccgttaaaaatctcaataaattttttaatgaacaacaagttctgcacgatatttcattcagcttacaacgcggagaaatcctctttttacttggtgcttcaggctgtggcaaaactacattattacgtgccattgcaggatttgaacaccccaatactggcgaaatttggctaaaagagcggttaatttttggcgagaattttaatcttccaacgcaacaacgtcatctcggttatgtggtgcaagagggcgtactttttcctcacttaaatgtctatcgcaacattgcttacggattaggcaacggcaaaggaaaaaatagcgaagaaaaaacgcggattgaacaaataatgcaactaacgggtatttttgaactggcggatcgctttccacatcaactttcaggcggacaacaacaacgcgtagcattggcgcgtgctttagcccctaatccagaactgattttattagacgagcctttcagtgccttagacgagcatcttcgccaacaaattcgccaagagatgctccaagcacttcgccaaagcggtgcttccgcaattttcgttactcacgaccgtgatgaatccttacgctacgctgataaaatcgccattattcagcaaggtaaaattttacaaatcgatacgccacgcaccctttattggtcgcctaatcatcttgaaacagcaaaatttatgggggaaagtattgttttgcctgcaaatctactcgatgaaaataccgctcaatgccaattaggcaatattcctataaaaaataaatcaatctcacaaaatcaaggtaggattttgcttcgtccagaacaatttagcctgtttaaaacatcagaaaatccaaccgcactttttaatggacaaataaaacaaattgaatttaaaggaaaaattacctccattcaaattgaaattaatggctacgcaatatggattgagaacgttatttctcccgatttatctattggcgataatttgcctgtttatttacatagaaaagggcttttttacgct

SEQ ID NO: 4178 - protein, 356 aa, Haemophilus influenzae
  Name: NTH2335
MRLNKMINNPLLTVKNLNKFFNEQQVLHDISFSLQRGEILFLLGASGCGKTTLLRAIAGFEHPNTGEIWLKERLIFGENFNLPTQQRHLGYVVQEGVLFPHLNVYRNIAYGLGNGKGKNSEEKTRIEQIMQLTGIFELADRFPHQLSGGQQQRVALARALAPNPELILLDEPFSALDEHLRQQIRQEMLQALRQSGASAIFVTHDRDESLRYADKIAIIQQGKILQIDTPRTLYWSPNHLETAKFMGESIVLPANLLDENTAQCQLGNIPIKNKSISQNQGRILLRPEQFSLFKTSENPTALFNGQIKQIEFKGKITSIQIEINGYAIWIENVISPDLSIGDNLPVYLHRKGLFYA

SEQ ID NO: 4179 - DNA, 498 bp, Haemophilus influenzae
  n 29: n is any nucleotide
  Name: NTH2336
ttgacgccaaaacttatttggaacagtanatttaagggcgagcggaaagtacacgatgatgcaggaaaggcattagatttgaaccaattagatgactggcaaaaatgtcaggcgattttacgttggtctgcattgccgggggcgagccgtcatcattggggaacggaagtggatatttttgatcctgatcttttgccacaagggcaatctttacaactggagccttgggaatatgaaaaaggcggctacttctttgaattgagtgaatttcttgccgaaaatttaccgcactttgattttgctttgccttttatgaatatgcagtccaataagaaagtggggcgggagccttggcatatcagttatttgccgttagctgaattggcaagccagcaattttctccagagattttgcaacaggcgtggaaaggggaaaatattttaggcgcagactgtttaatatcacatcttgaacaaattttttccgaatatattgtt

SEQ ID NO: 4180 - protein, 166 aa, Haemophilus influenzae
  Xaa 10: Xaa is any amino acid
  Name: NTH2336
LTPKLIWNSXFKGERKVHDDAGKALDLNQLDDWQKCQAILRWSALPGASRHHWGTEVDIFDPDLLPQGQSLQLEPWEYEKGGYFFELSEFLAENLPHFDFALPFMNMQSNKKVGREPWHISYLPLAELASQQFSPEILQQAWKGENILGADCLISHLEQIFSEYIV

SEQ ID NO: 4181 - DNA, 180 bp, Haemophilus influenzae
  n 118, 126: n is any nucleotide
  Name: NTH2337
atgaaattaaccctagaaatgcttacaggaaagtctcgtgagcatttagtcaatttacccacaactcattcatcaaatcattttttgcaaacacaagctatgcaagcatttcaagctntgcaacanagtgcggcaaaaaatggctttaatttacagcctgcgagcagttttcgtgatttt

SEQ ID NO: 4182 - protein, 60 aa, Haemophilus influenzae
  Xaa 40, 42: Xaa is any amino acid
  Name: NTH2337
MKLTLEMLTGKSREHLVNLPTTHSSNHFLQTQAMQAFQAXQXSAAKNGFNLQPASSFRDF

SEQ ID NO: 4183 - DNA, 1131 bp, Haemophilus influenzae
  Name: NTH2338
atgagagaaaaagtggtttcgttggcacaagatttaattcgtcgcccgtctattagcccgaatgacgaaggctgtcagcaaattattgccgaacgtttagaaaagctaggttttcaaattgaatggatgccttttaatgacacgttgaatttgtgggcaaaacacggaacgagcgagccagttattgcttttgcaggtcatacggatgttgtgcctactggcgatgaaaatcaatggtcgtctccgccgttttctgcggagattattgatggcatgctttatgggcgtggtgcggcggatatgaaaggctcccttgcagcaatgattgtggcggcagaagaatacgtaaaagcaaatcctaatcataaaggcaccattgcattattgattacctctgatgaagaggctgccgcaaaagatggaactatacgcgtggttgagacgttaatggcgcgtgatgaaaaaattacttattgtatggttggagagccatcgagtgctaaaaacttaggcgatgttgtcaaaaatggtcgccgcggctcaattacaggaaatctctatattaaaggtattcaaggacacgtagcctatccgcatttagctgaaaacccaatccataaagcagccccattcttgcaagaattaacgacttaccaatgggataaaggcaatgaatttttcccgccaacaagcctacaaattgctaacattcacgcgggtacgggaagtaataatgtaattcctgctgaattatatattcagtttaatttgcgttattgcacagaagtcacggatgaaatcattaagcaaaaagtcgctgaaatgctagaaaaacacaatttgaaatatcgtattgaatggaatttatcaggcaaaccctttttaacaaaaccaggtaaattattagattcgataacctccgctattgaggaaaccataggcataacgccaaaggctgaaacaggtggtggcacgtcagacggtcgttttattgcattgatgggcgcagaagtagtggaatttggtccgttaaattcaaccattcataaagtcaatgaatgtgtcagtatagaagatcttggcaagtgcggtgaaatttatcacaaaatgttagtgaatttattggatagc

SEQ ID NO: 4184 - protein, 377 aa, Haemophilus influenzae
  Name: NTH2338
MREKVVSLAQDLIRRPSISPNDEGCQQIIAERLEKLGFQIEWMPFNDTLNLWAKHGTSEPVIAFAGHTDVVPTGDENQWSSPPFSAEIIDGMLYGRGAADMKGSLAAMIVAAEEYVKANPNHKGTIALLITSDEEAAAKDGTIRVVETLMARDEKITYCMVGEPSSAKNLGDVVKNGRRGSITGNLYIKGIQGHVAYPHLAENPIHKAAPFLQELTTYQWDKGNEFFPPTSLQIANIHAGTGSNNVIPAELYIQFNLRYCTEVTDEIIKQKVAEMLEKHNLKYRIEWNLSGKPFLTKPGKLLDSITSAIEETIGITPKAETGGGTSDGRFIALMGAEVVEFGPLNSTIHKVNECVSIEDLGKCGEIYHKMLVNLLDS

SEQ ID NO: 4185 - DNA, 342 bp, Haemophilus influenzae
  Name: NTH2339
atgattacagtttacggcattaaaaattgcgatacagtgaagaaagcgttgaaatggctggcggatcacaatatcgaacacaaacttcacgactaccgtgttgatgggttagatttgaattttttaacccaagcggaaactcaatttggctgggatgtgttagtgaataaacgcagtacaacttggcgtaatttggatgagcaagttaaaaattcccttgataaaaccaccgcactttccgtgttggctgagaatccaactttaattaaacgcccaattattttacaagatgaaaaggcattaattggctttaatgaaaaggaatatcaggctgtttttgct

SEQ ID NO: 4186 - protein, 114 aa, Haemophilus influenzae
  Name: NTH2339
MITVYGIKNCDTVKKALKWLADHNIEHKLHDYRVDGLDLNFLTQAETQFGWDVLVNKRSTTWRNLDEQVKNSLDKTTALSVLAENPTLIKRPIILQDEKALIGFNEKEYQAVFA

SEQ ID NO: 4187 - DNA, 1893 bp, Haemophilus influenzae
  Name: NTH2341
atgaaggaaaaaattatgtcacaaaatcaagaaactcgcggcttccaatctgaagtcaaacaactactccaattaatgattcattctttgtactctaacaaagaaattttcttacgtgaattgatttctaatgcttctgatgcggcagataaattacgctttaaagcactttccaaccctgctttatatgaaggcgatggcgacttgcgtgtgcgtgttagctttgatgcggataaaggcactatcacaattagcgataacggcattggtatgactcgtgagcaagtcatcgatcatttggggacgattgcaaaatcaggaacaaaagaatttttaaccgcacttggccaagatcaagcaaaaaatagccagcttattgggcagtttggtgtgggtttttattctgcttttattgtggcagataaagtgactgtaaaaactagagcggctggcgaagaggcggataaagctgtgctttgggaatctgcgggcgaaggcgaatattctgtggcggatattgagaaaaaatctcgtggtacagatgtgattttacatttacgtgaagatgaaaaagaatttttaaatgaatggcgtttgcgtgaaattattggtaaatattctgaccatattggcttgccagtggaaatgctgacgaaagaatacgatgatgagggcaaagagtgcggcgaaaaatgggaaaaaatcaataaatctgatgccctttggacgcgttctaaaaatgatgtttccgatgaggaatacaaagcgttttacaaacacttaagccatgattttgttgatcctgtgacttgggcgcataacaaagtggaaggaaatcaagcatatactagtttgctttatgtaccagctaaagcaccttgggatttatttaatcgcgaacataaacacggcttaaaactttatgttcaacgtgtatttattatggatgatgctgagcaatttatgccgaattatctacgttttatgcgtggtttaatcgatagtaatgacttgccattaaatgtatctcgtgaaattttacaggataacaaaattacggctgcactacgcaaagcattaactaagcgttcattacaaatgctagaaaaattagcaaaagatgatgcagaaaaatatcttaaattctggaaagagtttggtttagtcttaaaagaaggccctgcagaagattttgctaacaaagaaactatcgcaaagttattgcgttttgcttcgacacataatgatggtagtgagcaaactgtctctttagaagattacatcttgcgtatgaaagaggggcaaaaagctatctattacattacagcggatagttatgttgcagcgaaaaatagcccacacttggaattattcaataaaaaaggcattgaggttttattactttccgatcgtattgatgaatggatgttaagctatttaactgaatttgacggtaaacaattacaaagtatcacgaaagcagatttggatttaggcgatttagcggataaagaatctgaaacacaaaaacaacaagataaagcctttggtagttttattgagcgtgtgaaaaacttgcttggcgaacgtgtgaaaacggtgcgtttaactcacaatttaacggatacaccagcggcgggttctacggataacgatcaaatgacgacccaaatggcgaaattgtttgcagccgcagggcaacctgtaccagaagtaaaatacacatttgaactgaatccagaacactatttagtgaaaaaagtggctgatattgcagatgaaactgaatttgctgattgggtggaactgttgcttgaacaagctatgttagcagagcgcggatctttggaaaatccagctgcgtttattaaacgtatcaataagttgttaggt

SEQ ID NO: 4188 - protein, 631 aa, Haemophilus influenzae
  Name: NTH2341
MKEKIMSQNQETRGFQSEVKQLLQLMIHSLYSNKEIFLRELISNASDAADKLRFKALSNPALYEGDGDLRVRVSFDADKGTITISDNGIGMTREQVIDHLGTIAKSGTKEFLTALGQDQAKNSQLIGQFGVGFYSAFIVADKVTVKTRAAGEEADKAVLWESAGEGEYSVADIEKKSRGTDVILHLREDEKEFLNEWRLREIIGKYSDHIGLPVEMLTKEYDDEGKECGEKWEKINKSDALWTRSKNDVSDEEYKAFYKHLSHDFVDPVTWAHNKVEGNQAYTSLLYVPAKAPWDLFNREHKHGLKLYVQRVFIMDDAEQFMPNYLRFMRGLIDSNDLPLNVSREILQDNKITAALRKALTKRSLQMLEKLAKDDAEKYLKFWKEFGLVLKEGPAEDFANKETIAKLLRFASTHNDGSEQTVSLEDYILRMKEGQKAIYYITADSYVAAKNSPHLELFNKKGIEVLLLSDRIDEWMLSYLTEFDGKQLQSITKADLDLGDLADKESETQKQQDKAFGSFIERVKNLLGERVKTVRLTHNLTDTPAAGSTDNDQMTTQMAKLFAAAGQPVPEVKYTFELNPEHYLVKKVADIADETEFADWVELLLEQAMLAERGSLENPAAFIKRINKLLG

SEQ ID NO: 4189 - DNA, 837 bp, Haemophilus influenzae
  Name: NTH2342
gtgcattcccccactcctttcgcactagccatttttttgggaattttgtaccatatcccgactttttccaatcaacgatccattatgaataatctcgaacttgaacaactcattaatcaaaaactttcttctgataaaatcaatgactatgcacccaacggcttacaagtcgaaggtaaaacagaaatcaaaaaaatcattactggcgtaacggcgagtcaggctttaattgattacgcaatcagccaaaatgctgatgctattttagttcatcatggctatttttggaaaagtgaaaccccttgtatccgaggaatgaaaggcaagcgaattaaagcccttttagtgaacgacattaatttatatggctatcatttgccattagatgtgcacccagaattaggtaacaatgcacaattagccaaactgctcgacattgaaaatttacaaccattagaaaaaggcactgtgagtattcctgtttggggcgaattaaaagaaccgatgacaggtaaagactttgcagaaaaaatagaaaaagtgttaaatcgaaaaccgttaatttgcattgaaaacggaccgcacttaatccgaaaaattggcatctgcactggtggcggacaaggttatattgatcttgctgcagaacaaggctgcgacgcatttattacaggggaagtgtcagaacaaacaatccattctgcccgtgagcaaggattgcatttcttctctgcaggtcatcacgcaacagaacgctatggcatcaaggcattaggcgaatggttggcgaaagaatatggctttgacgtagaatttaaagatatagataatccagca

SEQ ID NO: 4190 - protein, 279 aa, Haemophilus influenzae
  Name: NTH2342
VHSPTPFALAIFLGILYHIPTFSNQRSIMNNLELEQLINQKLSSDKINDYAPNGLQVEGKTEIKKIITGVTASQALIDYAISQNADAILVHHGYFWKSETPCIRGMKGKRIKALLVNDINLYGYHLPLDVHPELGNNAQLAKLLDIENLQPLEKGTVSIPVWGELKEPMTGKDFAEKIEKVLNRKPLICIENGPHLIRKIGICTGGGQGYIDLAAEQGCDAFITGEVSEQTIHSAREQGLHFFSAGHHATERYGIKALGEWLAKEYGFDVEFKDIDNPA

SEQ ID NO: 4191 - DNA, 495 bp, Haemophilus influenzae
  n 482, 483, 484, 485, 486: n is any nucleotide
  Name: NTH2343
gtgggaacaaatatggagcattctgttcataacaaactggtttcttttatttggagtattgcagacgattgtctgcgcgatgtgtatgtgcgcggtaaatatcgtgatgtgattttaccgatgtttgtgcttcgtcgtttggatactttacttgagccaagcaaagatgccgtattggaagaaatgcgttttcaaaaagaagaattggcattcaccgaattggatgaccttccccttaaaaaaattaccggtcatgttttttataacacctcaaaatggacattaaaatccctctatcaaaccgccagcaatacgccgcagtatatgctggccaattttgaagaatatcttgatggtttcagcaccaacattcatgaaatcatcaactgcttcaagctgcgtgaacaaatccgccatatgtcccataaaaatgttttgctgagcgtgttggaaaaatttgtatcgccctatatcattcttannnnnttaattaat

SEQ ID NO: 4192 - protein, 165 aa, Haemophilus influenzae
  Xaa 161, 162: Xaa is any amino acid
  Name: NTH2343
VGTNMEHSVHNKLVSFIWSIADDCLRDVYVRGKYRDVILPMFVLRRLDTLLEPSKDAVLEEMRFQKEELAFTELDDLPLKKITGHVFYNTSKWTLKSLYQTASNTPQYMLANFEEYLDGFSTNIHEIINCFKLREQIRHMSHKNVLLSVLEKFVSPYIILXXLIN

SEQ ID NO: 4193 - DNA, 318 bp, Haemophilus influenzae
  Name: NTH2344
atgaataaaaaacacactttaatttcacttgctattttgaccgcactttatagccaacaaagtttggcagatttgcacgaacaatgtttaatgggcgtgccaaaatttagcggtgaagtcgtgacgggtgatgtgaattctctgcctgtatatattgaagcggataacgcagaaattaatcagccaaatgatgcgacctatcaaggtaatgtagatttgaaacaaggccaatcgccatttgttagcacaatccgtgcaggtcaaacaatctggaaaccaatcaacacctttacgcatggcttatgtccgcaatggatt

SEQ ID NO: 4194 - protein, 106 aa, Haemophilus influenzae
  Name: NTH2344
MNKKHTLISLAILTALYSQQSLADLHEQCLMGVPKFSGEVVTGDVNSLPVYIEADNAEINQPNDATYQGNVDLKQGQSPFVSTIRAGQTIWKPINTFTHGLCPQWI

SEQ ID NO: 4195 - DNA, 2001 bp, Haemophilus influenzae
  Name: NTH2345
ttgggtaaagatgcagagtttaatttagatagtcacgatggtaatttaacaaattcagaatatgaatttgtcggtcgtcaaggacgtggtaaagctgataatataacactgcataataattatcgtgtaatgaagaatgcaacctttacgtcatgtttgcacggcgacaatgcttgggctgtagatgcgtcagaaattcgtcaatacgtgaaagaagaatatgctgaaatgtggcatgctcgctttaaaatacatggtgttcccgtcttttataccccttacttacaattacccattggagatcgtcgtcgttctggtttattgattccaagcgcgggaacatctaaccgagatggtctttggtatgcacaaccaatttattggaatatcgctcctaattatgatcttactttcaccccgaaatatatgtctcgccgtggttggcaagcaaatggggaatttcgctatttaacctccattggcgaaggtaaagtggcaggagaatatttaggtaaggatcgttactctgaatatgctagtgataatcgaaaacgtcatttgttctattggaatcacaattctagctttttacaaaattggcgtctaaatattaattacacccgagtaagcgataaacgttatttcaacgactttgattctatttatggacgcagtaccgatggttatgcgaaccaatatgctcgcatagcttattatcaaccaaattataatttttctctttctgcacatcagttccaaatttttgatgatattgtaaacatcggcccttaccgtgcagtaccacaattagatttcaactatcacaaatatgatttagcgaatggatggttaaatttcaaattacattcacaagcagttcgttttgataatgacagtaaattgatgccaactgcatggcgtttccatgcagaacctagcctaaattctttaatgtcaaataaatacggcagtttgaatattgaaacgaaactttatgcgactcgttacgagcagaaaaaaggttcaggaaaaaatgcagaggacgtgcaaaaaacggtaaatcgagttattccacaatttaaagttgatttacaaagtgtattatcacgcgatataacgttcttaaaagagtatacacaaaccttcgaaccgcacgtgcagtatttatatcgtccttaccgaaatcaaagcaatattggttcaacacttaataatgattatttgggatttggttacgattcagcattagtacagcaagattactattcgctattccgtgatcgccgttatagtggtttagatcgaatttcatcggcaaatcaagttaccttgggtggcacaacgcgtttttatgatattgctggcgaagaacgatttaatttatctgcaggtcaaatttattacttaagtaattctcgtattgatgaaaaccctgcgaataaaacaccaacttcatcatctgcttgggcattagaatctaattggaaaataagtaataaatggtattggcgtggtagctatcaatttgatactcataccaattcaacatcattagcgaatacatcactagaatataatcctgaaaaaaataatttaattcagttaaattatcgatatgtgaaccaagaatatattgaccaaaacttaggtaaatcggctaacgcctatcaacaagatatccaacaagtgggattagttgtaggctgggaaattgccaataattgggctgtagtaggacgctattatcaagatctcgccttacaaaaaccagtagaacaatatctaggcgttcaatataacagttgctgttgggctgcaagtgttggtgtaaaacgcaatgtcacaaaccaccaaaaccaaacacgtaatgaaattgtttatgataatagcattggcataaccttagaattaagggggctaggcagcaatgaccatcaaagcggcattcaagagatgttagaaaaagggaaactaccttatattcgagcatttagtttggat

SEQ ID NO: 4196 - protein, 667 aa, Haemophilus influenzae
  Name: NTH2345
LGKDAEFNLDSHDGNLTNSEYEFVGRQGRGKADNITLHNNYRVMKNATFTSCLHGDNAWAVDASEIRQYVKEEYAEMWHARFKIHGVPVFYTPYLQLPIGDRRRSGLLIPSAGTSNRDGLWYAQPIYWNIAPNYDLTFTPKYMSRRGWQANGEFRYLTSIGEGKVAGEYLGKDRYSEYASDNRKRHLFYWNHNSSFLQNWRLNINYTRVSDKRYFNDFDSIYGRSTDGYANQYARIAYYQPNYNFSLSAHQFQIFDDIVNIGPYRAVPQLDFNYHKYDLANGWLNFKLHSQAVRFDNDSKLMPTAWRFHAEPSLNSLMSNKYGSLNIETKLYATRYEQKKGSGKNAEDVQKTVNRVIPQFKVDLQSVLSRDITFLKEYTQTFEPHVQYLYRPYRNQSNIGSTLNNDYLGFGYDSALVQQDYYSLFRDRRYSGLDRISSANQVTLGGTTRFYDIAGEERFNLSAGQIYYLSNSRIDENPANKTPTSSSAWALESNWKISNKWYWRGSYQFDTHTNSTSLANTSLEYNPEKNNLIQLNYRYVNQEYIDQNLGKSANAYQQDIQQVGLVVGWEIANNWAVVGRYYQDLALQKPVEQYLGVQYNSCCWAASVGVKRNVTNHQNQTRNEIVYDNSIGITLELRGLGSNDHQSGIQEMLEKGKLPYIRAFSLD

SEQ ID NO: 4197 - DNA, 1716 bp, Haemophilus influenzae
  Name: NTH2346
atgcgtacaagtcaatatttattttccaccctaaaagaaacgccaaatgatgctcaggttgtgagccaccaattaatgttgcgtgcaggtatgattcgcccaatggcatcaggtttatataactggttaccgacgggtattcgcgtattgaaaaaagtggaaaaagttgttcgcgaagagatgaacaaaggtggtgccattgaggtattaatgccagttgtgcaacctgcggaattatgggaagagtctggtcgttgggatcaatatggccctgaattgcttcgttttgaagaccgtggaaaccgtaactttgtacttgggccaactcacgaggaagtgattacagatttagtccgccgagaagtttcttcatacaaacaacttccacttaatttataccaaattcaaactaaattccgtgatgaagtgcgccctcgttttggtgtaatgcgttcgcgtgaatttattatgaaagatgcgtattctttccacacgacacaagaaagtttgcaagcaacctatgatgtgatgtatcaagtatacagtaacatttttagacgtttaggcttagatttccgtgcggtgcaagcggatacaggttcaatcgggggttcagcttctcacgaattccaagtgttagcttcaagcggggaagatgatgttgtgttctcaacggaatcggattttgccgcgaatattgagcttgcagaagcaattgctataggcgaacgccaagctccaaccgctgaaatgtgtttagttgatacaccaaatgcgaaaactattgcggagttggtggagcaattcaatttaccaatcgagaaaaccgtaaaaactttgattgtgaaaggtgcagacgaaaatcaaccgcttgttgcgttgattattcgcggcgaccatgaattaaacgagatcaaagcacaaaaacacccgttagtggcagatccccttgagtttgcggacgaaactgaaatcaaagcgaaaattggtgcgggcgtgggatcgttaggcgcggtaaatcttaatattcctgcaattattgaccgcactgtggcgttaatgtctgattttagttgtggtgcgaatattgatggaaaacattatttcaatgtgaactgggtacgcgatgtagcaatgcctgaagtatttgatttacgtaacgtagtagaaggcgatcctagtccagatggcaaaggcacgcttcaaatcaaacgtggtattgaagtggggcatattttccaactgggtaaaaaatactctgaagcgatgaaagcgaccgttcaaggcgaagatggtaaaccacttgtgatgacgatgggttgctacggtattggtgtaactcgtgtggtggcttcagcgattgaacagcatcatgatgatcgcggtatcatctggccatcagacgaaatcgccccattcactgtggcgattgtgccaatgaacatgcacaaatctgaagccgtgcaaaaatacgctgaagaactttaccgcactttacaatcgcaaggcgtagatgtgatttttgatgatcgtaaagaacgcccaggcgtgatgtttgcagacatggaacttatcggtataccgcatatggtggtaatcggtgagaaaaacctagacaacggtgaaattgaatataagaatcgtcgtaccggtgaaaaagaaatgattagtaaagataaattgctcagtgttttaaacgaaaagttaggtaatctc

SEQ ID NO: 4198 - protein, 572 aa, Haemophilus influenzae
  Name: NTH2346
MRTSQYLFSTLKETPNDAQVVSHQLMLRAGMIRPMASGLYNWLPTGIRVLKKVEKVVREEMNKGGAIEVLMPVVQPAELWEESGRWDQYGPELLRFEDRGNRNFVLGPTHEEVITDLVRREVSSYKQLPLNLYQIQTKFRDEVRPRFGVMRSREFIMKDAYSFHTTQESLQATYDVMYQVYSNIFRRLGLDFRAVQADTGSIGGSASHEFQVLASSGEDDVVFSTESDFAANIELAEAIAIGERQAPTAEMCLVDTPNAKTIAELVEQFNLPIEKTVKTLIVKGADENQPLVALIIRGDHELNEIKAQKHPLVADPLEFADETEIKAKIGAGVGSLGAVNLNIPAIIDRTVALMSDFSCGANIDGKHYFNVNWVRDVAMPEVFDLRNVVEGDPSPDGKGTLQIKRGIEVGHIFQLGKKYSEAMKATVQGEDGKPLVMTMGCYGIGVTRVVASAIEQHHDDRGIIWPSDEIAPFTVAIVPMNMHKSEAVQKYAEELYRTLQSQGVDVIFDDRKERPGVMFADMELIGIPHMVVIGEKNLDNGEIEYKNRRTGEKEMISKDKLLSVLNEKLGNL

SEQ ID NO: 4199 - DNA, 1890 bp, Haemophilus influenzae
  Name: NTH2347
gtgctgcacatggcgagaacgtgcagttctaaaatgctggattctcctttaccatcaaaaataatagaaaaaccgaccgcactttctgttttgaaatcggttttcggttatcaatctttccgtaaagggcaggaagaagttattaatgctgctttaaatggacaagatgcgttggtggtaatggcaacggggaatggcaaatcgctttgttaccaaattcccgcactttgttttgatggtttaactttagtgatttctccgctgatttccttgatgaaagatcaagtggatcagctgcaagctaatggaattgaggcggattttcttaattctagtcagactttagaacagcagcaacaagtacaaaataagcttatttctgggcaacttaaactactttatgtgtcgccagaaaaagtgatgacgaacagtttctttcaacttatttcttatagcaaagtctgctttattgcgattgatgaagcacattgtatttctcaatgggggcatgactttcgccctgaatatacccagcttggcggtttaaaagccagtttccctgatgcgccgattatggcacttacggcaacggcagattatgcgactcaaaaagatattctgcggcatcttaatctgaaaaatctgcacaaatatattggtagttttgatcgaccaaatattcgttataccttggaagaaaaatacaaacctatggagcaactgacacgttttgtgttggctcaaaagggtaagagtgggattatttattgcaacagcagaaataaggttgagcgaattgcggaaagtttacgcaataaaggtgtctctgctgctgcttaccacgcaggaatggaaacggcaattcgtgaacgtgtgcaacaggattttcagcgtgataatgttcaagtagtagtcgcaaccattgcttttggaatggggattaataaatccaatgtgcgctttgttgcccattttgatttaccacgtagcattgaatcttactatcaagaaacaggtcgagcaggacgtgatgatttgcctgccgaggcggttttgttttatgaaccagctgattacgcttggttacaaaaaattctcttcgaaaaaccagaaacgccacagcgtcagattgagcagcataaattagaagctattggggaatttgcggaaagccagacttgtcgccgtttagttcttctcaattattttggcgagcatcgacaaacaccatgtaataactgtgatatttgccttgatcctcctaaaaaatatgatggcttagtcgatgcgcaaaaagtaatgtctactatttatcgagtgggacaatgttttggtgcacattatgtgattgcggtgttgcgtggcatgcacaatcagaaaattattgaacgccaacaccataaactttcagtatatggcattggaaaagataaaagcaaagagcattggcagtctgttattcgtcagcttattcatttgggttttgtgcaacaggttattagtgaattaaatccaacgttgcaacttactgaaagtgcgaaagtgattttgaaaggcgaagaaccgttagaattggcaatgcctcgtatttcttcaatcagtaaaattgcccataatccacaacgtcaaggtgttgcaaattacgataaggatttatttgcacgcttgcgtttcctacgcaaacaaattgccgataaagaaaatattccgccgtacattgtctttaatgatgcgacgttgcaagaaatggcacaatatatgccgacaagcaatattgaaatgttgcaaattaatggcgtgggctctatcaaattagagcggtttgggcagccgtttatggcattgattcaagaacataaggcaattttggcgaatgcgcaaaataatgac

SEQ ID NO: 4200 - protein, 630 aa, Haemophilus influenzae
  Name: NTH2347
VLHMARTCSSKMLDSPLPSKIIEKPTALSVLKSVFGYQSFRKGQEEVINAALNGQDALVVMATGNGKSLCYQIPALCFDGLTLVISPLISLMKDQVDQLQANGIEADFLNSSQTLEQQQQVQNKLISGQLKLLYVSPEKVMTNSFFQLISYSKVCFIAIDEAHCISQWGHDFRPEYTQLGGLKASFPDAPIMALTATADYATQKDILRHLNLKNLHKYIGSFDRPNIRYTLEEKYKPMEQLTRFVLAQKGKSGIIYCNSRNKVERIAESLRNKGVSAAAYHAGMETAIRERVQQDFQRDNVQVVVATIAFGMGINKSNVRFVAHFDLPRSIESYYQETGRAGRDDLPAEAVLFYEPADYAWLQKILFEKPETPQRQIEQHKLEAIGEFAESQTCRRLVLLNYFGEHRQTPCNNCDICLDPPKKYDGLVDAQKVMSTIYRVGQCFGAHYVIAVLRGMHNQKIIERQHHKLSVYGIGKDKSKEHWQSVIRQLIHLGFVQQVISELNPTLQLTESAKVILKGEEPLELAMPRISSISKIAHNPQRQGVANYDKDLFARLRFLRKQIADKENIPPYIVFNDATLQEMAQYMPTSNIEMLQINGVGSIKLERFGQPFMALIQEHKAILANAQNND

SEQ ID NO: 4201 - DNA, 339 bp, Haemophilus influenzae
  Name: NTH2348
ttgccacattttatcagatttaaacaggaacattttatgaatattgcagaatttcaccaaaatattgaacaagtttggcaaaaaattgaagaagaattggaaaaccaaggtgcagatgtagattgtgaaacgcaaggttcagtatttacaatcacctttgataatcgcacacaaatagtgattaacaagcaagaaccgctgcttgagctttggattgcaagtaaattaggcggtttccattttgcttttaaaaatggcgactgggtttctaatgacggacaacgtttttgggattgtttcgttgaagcctgtgctgcacatggcgagaacgtgcagttc

SEQ ID NO: 4202 - protein, 113 aa, Haemophilus influenzae
  Name: NTH2348
LPHFIRFKQEHFMNIAEFHQNIEQVWQKIEEELENQGADVDCETQGSVFTITFDNRTQIVINKQEPLLELWIASKLGGFHFAFKNGDWVSNDGQRFWDCFVEACAAHGENVQF

SEQ ID NO: 4203 - DNA, 129 bp, Haemophilus influenzae
  Name: NTH2349
gtgagagagagaaaaatgaaaaaactactatcaattttagtgcttagtgcaatttgcattgtgacaacaggatgcggcgtaaaaggttctttatattttcctgaaaaagatcaagctcaacaaactcaa

SEQ ID NO: 4204 - protein, 43 aa, Haemophilus influenzae
  Name: NTH2349
VRERKMKKLLSILVLSAICIVTTGCGVKGSLYFPEKDQAQQTQ

SEQ ID NO: 4205 - DNA, 1245 bp, Haemophilus influenzae
  Name: NTH2350
atgaatttcttccaatataaacataacaaactttatgccgaagatatgccagttcaacaacttgctgaacaattcggtacacctctttatgtatattctcgcgcgacactagaacgtcattggcacgcttttgactcagctttcggtaagcgtcctcacttaatttgctttgccgtgaaatcttgctcaaatattggcgtgttaaatattatggcaaaacttggttcaggtttcgatattgtctcacaaggcgaacttgagcgtgtactggcagcaggtggcgatgcgtcaaaagtagtcttttctggcgttgcgaaatctcgagaagaaattatgcgcgcattagaagttggaatccgttgctttaatgtggaatcagtttctgagctcaagcacattaaccaaatcgcgggagaaatgggtaaaatcgcacctatttctttacgtgtaaatccagatgttgatgctcatacacacccttatatttcaacaggattaaaagaaaataaatttggtgtaagcgtaaatgaagctcgagaggtatataaattagcctcaacgctaccaaacataaaaataacagggatggattgccacataggctcacagctcaccgaattacaaccattcttagatgcaacagatcgattaattgtcctaatggaacaattaaaagaagatggaattacattaaaacatctcgatctgggcggtggtttaggcgtgacttatacggatgaaacaccaccgcatccaagcgattacgcaaatgcgttattagaaaaactaaaaaattatcccgaacttgaaattattcttgaacccggcagagcaatttctgcaaatgcaggaattctagtagcaaaagtacaatacttaaaaagtaatgaaagccgtaatttcgccattaccgatacaggaatgaacgatatgatccgaccagcattgtatgaggcttacatgaacatcgtcgaaattgaccgcactttagaaagagaaaaagccatttatgatgttgtagggcctgtttgcgaaacgtctgatttcttaggcaaacaacgggaactttcaattgctgaaggggattatattgctcaatgttctgctggtgcctatggagcaagtatgtcatcaaactataattcaagagcccgcactgcagaagttttagtagatggcgatcaatcctatctaattcgtcgtcgagaaaccttacaggaactttgggcattagaatcgaccatt

SEQ ID NO: 4206 - protein, 415 aa, Haemophilus influenzae
  Name: NTH2350
MNFFQYKHNKLYAEDMPVQQLAEQFGTPLYVYSRATLERHWHAFDSAFGKRPHLICFAVKSCSNIGVLNIMAKLGSGFDIVSQGELERVLAAGGDASKVVFSGVAKSREEIMRALEVGIRCFNVESVSELKHINQIAGEMGKIAPISLRVNPDVDAHTHPYISTGLKENKFGVSVNEAREVYKLASTLPNIKITGMDCHIGSQLTELQPFLDATDRLIVLMEQLKEDGITLKHLDLGGGLGVTYTDETPPHPSDYANALLEKLKNYPELEIILEPGRAISANAGILVAKVQYLKSNESRNFAITDTGMNDMIRPALYEAYMNIVEIDRTLEREKAIYDVVGPVCETSDFLGKQRELSIAEGDYIAQCSAGAYGASMSSNYNSRARTAEVLVDGDQSYLIRRRETLQELWALESTI

SEQ ID NO: 4207 - DNA, 624 bp, Haemophilus influenzae
  Name: NTH2351
atgcaagataagctaaaagttttattgattgacgaccatccgttaatgcgtcgtggcattaaacaacttgtagaattagacgataactttgaagtagtggctgacgtaagcagcggcacagaagggatttctgtggcattacaaacatcacctgatgtgatcattttagatctcaacatgaaaggactttctgggttagatacgctcaaaggattacgtgcagaaggcgttgatgcgcgaattttaattttaacagtgtctgatgcaaaaaatgatatttatactctaattgatgcaggtgcagatggttatttgttaaaagatactgaacctgatacattgctagaccaaatcaagcgcatagcacaaggcgaagtcattctgagtgattctattaaaaatttattattagaacgtactcacgaagataatccgttagacagcttaacggatcgtgaaatgggcgtacttcgtcaaattgcaactggcttatcaaacaaacaaattgcagcacaactgtttatttcagaagaaaccgtaaaagtacatatccgtaatttattacgtaaattaaatgttcattctcgtgttgcagcaacggtattattttttgaacaaaatcgt

SEQ ID NO: 4208 - protein, 208 aa, Haemophilus influenzae
  Name: NTH2351
MQDKLKVLLIDDHPLMRRGIKQLVELDDNFEVVADVSSGTEGISVALQTSPDVIILDLNMKGLSGLDTLKGLRAEGVDARILILTVSDAKNDIYTLIDAGADGYLLKDTEPDTLLDQIKRIAQGEVILSDSIKNLLLERTHEDNPLDSLTDREMGVLRQIATGLSNKQIAAQLFISEETVKVHIRNLLRKLNVHSRVAATVLFFEQNR

SEQ ID NO: 4209 - DNA, 342 bp, Haemophilus influenzae
  n 65: n is any nucleotide
  Name: NTH2352
ttgattgctaaagctaagaatatcggggttatacgattaaaagagagcattgatattatgctcgntgcaatgcagtctggagaatgtaatctttctgaaggcgtaattcgtcttactatgctattaaggccttttggtaagaatttatcatcttatcctgcgatggctaatttatatgaagtggtgcgtgatatgcctacacatgatgaccgtaaactacttgagaaaagagaaagaatgcgtctggatttagctcgagaaagtgcagaagcacagtttgaaaaaaatattaaacaagaattgtatattttattagaagatattaaatctattgagctaatt

SEQ ID NO: 4210 - protein, 114 aa, Haemophilus influenzae
  Xaa 22: Xaa is any amino acid
  Name: NTH2352
LIAKAKNIGVIRLKESIDIMLXAMQSGECNLSEGVIRLTMLLRPFGKNLSSYPAMANLYEVVRDMPTHDDRKLLEKRERMRLDLARESAEAQFEKNIKQELYILLEDIKSIELI

SEQ ID NO: 4211 - DNA, 108 bp, Haemophilus influenzae
  n 66, 80: n is any nucleotide
  Name: NTH2353
gtgatgatgctagatcgaattttgagtaatggagaacttggcattgagccgaagatgaaagcgaanatgattatcccgcnccttcgagcgtatggatatttatcaatt

SEQ ID NO: 4212 - protein, 36 aa, Haemophilus influenzae
  Xaa 22, 27: Xaa is any amino acid
  Name: NTH2353
VMMLDRILSNGELGIEPKMKAXMIIPXLRAYGYLSI

SEQ ID NO: 4213 - DNA, 609 bp, Haemophilus influenzae
  n 596, 597, 598, 599, 600: n is any nucleotide
  Name: NTH2354
atgccacaaattaccctttcggctgaagtgcagccagaacaaatgggacaacgtttagaccaaacacttgcagagttgttccctgaatattctcgttcccgattaaaaacatggattgaagccgatctcgtaaaacttaacgaccgcattactaatattccgcgtgagaaagtgtttggaggagagagaatagagattattgttgaagtggaagatgaaacacgttttgaagcagaaaatattccattgaatattgtgtatgaagatgatgatattattgtgattaacaaaccaaaagatcttgtggtacaccccggtgctggcaatccaaatggaactgtactcaatgcgttactctatcattatccaccgatatcagaagtaccgagagcaggaattgtgcatcgattagataaagatacaacaggtctaatggttgttgctaaaaccattccagcacaaactaagttagtgcgagacttacaaaaacgcaaaattacgcgcgaatatgaagcagtcgcttcaggcattatgactaaaggcggcacagtagatcaacctatggctcgtcatgcaaccaaacgtatggggtctcnnnnnttaattaat

SEQ ID NO: 4214 - protein, 203 aa, Haemophilus influenzae
  Xaa 199, 200: Xaa is any amino acid
  Name: NTH2354
MPQITLSAEVQPEQMGQRLDQTLAELFPEYSRSRLKTWIEADLVKLNDRITNIPREKVFGGERIEIIVEVEDETRFEAENIPLNIVYEDDDIIVINKPKDLVVHPGAGNPNGTVLNALLYHYPPISEVPRAGIVHRLDKDTTGLMVVAKTIPAQTKLVRDLQKRKITREYEAVASGIMTKGGTVDQPMARHATKRMGSXXLIN

SEQ ID NO: 4215 - DNA, 816 bp, Haemophilus influenzae
  Name: NTH2356
ttggttttcgtaaaaattaaggaaaaaacaatgcgtaaaataaaatctttggcattgcttgccgtggcagcattggttattggatgttcaagtggttcaaaagatgttgaacaagcatcggtaaatgaattatacacaaaaggtacaacatcattacaagaaggtagttactctgaagccattcgctatttaaaagcgacgactgagcgttttccaggtagcgtttatcaagaacaagcaatgttagatttaatttatgcaaattataaaactcaagattatacgcaagtattattgatggtagatagctttttacatcaatttccacaaagcccaaatcaagcctatgcggtatatatggctggcttaactaatgcagcaacaggcgataatttcattcaagatttttttggaattgaccgtgctacacgtgaaacaacctctatgcgtaccgctttttctaatttccaaaacttagttcgtgtattccctaatagcccttatgctcaagatgctttagcgcgtatggcttatattaaagatgcactggctcgtcacgaattagagattgcaaaattctatgcaaaacgtaaagcgtgggtagcagttgcaaatcgtgtggtaggaatgttaaaacaatatcctgatactaaagcaacttatgaaggattatttctgatgcaggaagcttatgaaaaaatgggtttaaccgcattagcaaatgatactcaaaaaattattgatgcgaataaagataaaacttttgcaccaattgaaaaaccaaacgagccagacttaaaagtgccagcagtaaaa

SEQ ID NO: 4216 - protein, 272 aa, Haemophilus influenzae
  Name: NTH2356
LVFVKIKEKTMRKIKSLALLAVAALVIGCSSGSKDVEQASVNELYTKGTTSLQEGSYSEAIRYLKATTERFPGSVYQEQAMLDLIYANYKTQDYTQVLLMVDSFLHQFPQSPNQAYAVYMAGLTNAATGDNFIQDFFGIDRATRETTSMRTAFSNFQNLVRVFPNSPYAQDALARMAYIKDALARHELEIAKFYAKRKAWVAVANRVVGMLKQYPDTKATYEGLFLMQEAYEKMGLTALANDTQKIIDANKDKTFAPIEKPNEPDLKVPAVK

SEQ ID NO: 4217 - DNA, 480 bp, Haemophilus influenzae
  Name: NTH2358
atgaaaaaaattattttaacattatcacttgggttacttactgcctgttctgctcaaatccaaaaggctaaacaaaatgatgtgaagctggcaccgccgactgatgtacgaagcggatatatacgtttggtaaagaatgtgaattattacatcgatagtgaatcgatctgggtggataaccaagagccacaaattgtacattttgatgcagtggtgaatttagataagggattgtatgtttatcctgagcctaaacgttatgcacgttctgttcgtcagtataagatcttgaattgtgcaaattatcatttaactcaagtacgaactgatttctatgatgaattttggggacagggtttgcgggcagcacctaaaaagcaaaagaaacatacgttaagtttaacacctgatacaacgctttataatgctgctcagattatttgtgcgaactatggtgaagcattttcagttgataaaaaa

SEQ ID NO: 4218 - protein, 160 aa, Haemophilus influenzae
  Name: NTH2358
MKKIILTLSLGLLTACSAQIQKAKQNDVKLAPPTDVRSGYIRLVKNVNYYIDSESIWVDNQEPQIVHFDAVVNLDKGLYVYPEPKRYARSVRQYKILNCANYHLTQVRTDFYDEFWGQGLRAAPKKQKKHTLSLTPDTTLYNAAQIICANYGEAFSVDKK

SEQ ID NO: 4219 - DNA, 738 bp, Haemophilus influenzae
  Name: NTH2359
atgtcagttcttggacgaattcactcttttgaatcctgtggcactgtagatgggccaggtattcgttttattttatttatgcaaggctgcttgatgcgctgcaaatattgccacaatcgtgatacttgggatcttgaaggggggaaagaaatcagtgtcgaagatttaatgaaagaagtcgtgacttatcgccattttatgaatgctactggcggtggtgttacggcatctggtggcgaggctgtgttacaagcagagtttgtacgcgattggttccgagcttgtaaagcggaagggattaatacttgcttggatacaaatggttttgtacgtcattataatcatattattgatgaattattagatgtaacagatcttgttttactcgatttaaaagagcttaatgatcaagttcatcaaaatcttattggggtacccaataaacgtacccttgaatttgcaaaatatttgcaaaaacgtaatcaacatacctggattcgttatgttgtggttcctggttatactgatagcgatcacgatgtgcatttattaggtcagtttattgaaggtatgaccaatattgaaaaagttgagcttcttccttatcatcgattaggtgcacataaatggaaaacccttgggttagattatgagcttgaagatgtattaccgccaactaaagaatccttagagcatattaaaacaatcctagaaggttatgggcacactgtaaaattc

SEQ ID NO: 4220 - protein, 246 aa, Haemophilus influenzae
  Name: NTH2359
MSVLGRIHSFESCGTVDGPGIRFILFMQGCLMRCKYCHNRDTWDLEGGKEISVEDLMKEVVTYRHFMNATGGGVTASGGEAVLQAEFVRDWFRACKAEGINTCLDTNGFVRHYNHIIDELLDVTDLVLLDLKELNDQVHQNLIGVPNKRTLEFAKYLQKRNQHTWIRYVVVPGYTDSDHDVHLLGQFIEGMTNIEKVELLPYHRLGAHKWKTLGLDYELEDVLPPTKESLEHIKTILEGYGHTVKF

SEQ ID NO: 4221 - DNA, 2316 bp, Haemophilus influenzae
  Name: NTH2360
atgactatgtcagaacttaatgaaatgcaaaaattggcgtgggctggttttgctggtggcgattggcaagaaaatgtcaatgtacgtgactttatccaaaaaaactataccccttatgaaggcgatgactctttcttagcaggtccaaccgaagcaacaaccaagctttgggaatctgtaatggaaggaattaaaattgaaaaccgtactcacgcgccattagattttgatgaacatacaccatctaccattatctctcacgcacccggttacattaacaaagatttagaaaaaatcgttggtcttcaaactgatgaacctttaaaacgtgccattatgccattcggtggtatcaaaatggtggaaggttcttgtaaagtttatggtcgtgaacttgatccaaaagtgaaaaaaatcttcactgaataccgtaaaacacataaccaaggtgtattcgatgtttacacgccagatattttacgttgccgtaaatctggggtattaactggtcttccagatgcttatggtcgtggtcgtatcatcggtgactaccgtcgtgtagcactttatggtgtagatttcttaatgaaagataaatatgcacaattctcttctttacaaaaagatttagaagatggcgtaaatcttgaagcaacaattcgtttacgtgaagaaatcgcagaacaacaccgtgcattaggtcaattaaaacaaatggcagcaagctatggttatgatatttctaacccagcaactaatgctcaagaagccattcaatggatgtactttgcttatcttgctgcaataaaatcacaaaatggtgctgcaatgtcattcggtcgtaccgcaacctttattgacgtgtacattgagcgtgatttaaaagcaggaaaaattactgaaactgaagcgcaagaattagttgaccacttagttatgaaacttcgtatggttcgtttcttacgtacacctgaatacgatcaattattctcaggcgacccaatgtgggcaactgaaaccatcgcaggtatgggtttagatggtcgtacattagtaaccaaaaatacattccgtattttacacaccctttacaacatgggtacttccccagagccaaacttaaccattctttggtctgaacaattacctgaaaacttcaaacgtttctgtgcaaaagtatcgattgatacctcatcagttcaatacgaaaacgatgatttaatgcgtccagacttcaacaatgatgactacgcaatcgcatgttgtgtatcaccaatgattgtgggtaaacaaatgcaattcttcggtgcacgtgcaaacttagcgaaaacattgttatacgcaatcaacggcggtattgatgaaaaattaggtatgcaagtaggcccgaaaactgcaccaattactgatgaagtattagatttcgatacagtaatgactcgtatggatagctttatggattggttggctaaacaatatgtgactgccttaaacgtaatccactatatgcacgataaatattcatacgaagccgcattaatggcattacatgatcgtgatgtataccgtaccatggcttgtggtatcgcaggtctttctgttgcggctgactcactttcagcaatcaaatatgcaaaagttaaaccagttcgtggcgacatcaaagataaagatggcaatgttgttgcaactaacgtagcaatcgactttgaaattgaaggtgaatatccacaatatggtaataacgataaccgtgttgatgacatcgcttgtgacttagttgaacgtttcatgaagaaaattcaaaaacttaaaacttaccgcaatgcagtgcctacacaatctgtattaaccattacttctaacgtagtttatggtaagaaaacgggcaacaccccagatggccgtcgtgctggtgcaccattcggaccaggtgcgaacccaatgcacggacgtgaccaaaaaggtgcggtagcatcattaacttctgtagctaaacttccatttgcttacgcgaaagatggtatttcttataccttctcaatcgtaccaaatgcgttaggtaaagatgccgaagcacaacgtcgcaaccttgctggcttaatggatggttacttccaccacgaagcaacggttgaaggtggccaacacttaaatgtgaacgtgttaaaccgtgaaatgttgttagatgcaatggaaaatccggataaatatccacaattgactatccgtgtatctggttacgcagtacgttttaactctttaactaaagagcaacaacaagacgtaattactagaactttcacagagtcaatg

SEQ ID NO: 4222 - protein, 772 aa, Haemophilus influenzae
  Name: NTH2360
MTMSELNEMQKLAWAGFAGGDWQENVNVRDFIQKNYTPYEGDDSFLAGPTEATTKLWESVMEGIKIENRTHAPLDFDEHTPSTIISHAPGYINKDLEKIVGLQTDEPLKRAIMPFGGIKMVEGSCKVYGRELDPKVKKIFTEYRKTHNQGVFDVYTPDILRCRKSGVLTGLPDAYGRGRIIGDYRRVALYGVDFLMKDKYAQFSSLQKDLEDGVNLEATIRLREEIAEQHRALGQLKQMAASYGYDISNPATNAQEAIQWMYFAYLAAIKSQNGAAMSFGRTATFIDVYIERDLKAGKITETEAQELVDHLVMKLRMVRFLRTPEYDQLFSGDPMWATETIAGMGLDGRTLVTKNTFRILHTLYNMGTSPEPNLTILWSEQLPENFKRFCAKVSIDTSSVQYENDDLMRPDFNNDDYAIACCVSPMIVGKQMQFFGARANLAKTLLYAINGGIDEKLGMQVGPKTAPITDEVLDFDTVMTRMDSFMDWLAKQYVTALNVIHYMHDKYSYEAALMALHDRDVYRTMACGIAGLSVAADSLSAIKYAKVKPVRGDIKDKDGNVVATNVAIDFEIEGEYPQYGNNDNRVDDIACDLVERFMKKIQKLKTYRNAVPTQSVLTITSNVVYGKKTGNTPDGRRAGAPFGPGANPMHGRDQKGAVASLTSVAKLPFAYAKDGISYTFSIVPNALGKDAEAQRRNLAGLMDGYFHHEATVEGGQHLNVNVLNREMLLDAMENPDKYPQLTIRVSGYAVRFNSLTKEQQQDVITRTFTESM

SEQ ID NO: 4223 - DNA, 858 bp, Haemophilus influenzae
  Name: NTH2361
ttgattatggcatcagaaaatcaaaaactatcttctgttgcgctcacacctgttgaagcaacggattatgcagaaaatacagcaacttataaagcaaataaacgtccatttttatcgtttatgtctggtattagtgctggtgcttgtattgccttagcctttgtattttacacgacaacacaaactgctagtgcaggcgcaccttggggattaaccaagttagtaggtgggttagtattctccttgggcgtaattatggtggtgattttaggatctgaattattcacttcttctactttaactttagtcgcccgtgtaggcggtagaatcaccacgacacaaatgattcgaaattggatcgtagtatatttgggcaacttcgttggtggtttatttattgcggctgttatttggtttagtggacaaacaatggcagcaaatggtcaatggggtttaacaattcttgcaaccgcccaacataaaattcatcacacttggtttgaagcttttaacctaggtattttatgtaacattatggtgtgtgtggcggtttggatgtcttattctggtaagactgttacagacaaagcatttattatgattatgccgattggtttgtttgttgcatcaggatttgaacactgtgtggctaatatgtttatgattccgatgggaattattaccgcacattttagtacacctgaattttggcaacaaatcggcgttgatccgatgaaatacgcagatttagatttgtaccatttcatcgtgaagaatttaatccctgtaacgttgggaaatattgtcggcggggcaatttgtattggtgtattccaacgttatttaaccaaaacgcat

SEQ ID NO: 4224 - protein, 286 aa, Haemophilus influenzae
  Name: NTH2361
LIMASENQKLSSVALTPVEATDYAENTATYKANKRPFLSFMSGISAGACIALAFVFYTTTQTASAGAPWGLTKLVGGLVFSLGVIMVVILGSELFTSSTLTLVARVGGRITTTQMIRNWIVVYLGNFVGGLFIAAVIWFSGQTMAANGQWGLTILATAQHKIHHTWFEAFNLGILCNIMVCVAVWMSYSGKTVTDKAFIMIMPIGLFVASGFEHCVANMFMIPMGIITAHFSTPEFWQQIGVDPMKYADLDLYHFIVKNLIPVTLGNIVGGAICIGVFQRYLTKTH

SEQ ID NO: 4225 - DNA, 90 bp, Haemophilus influenzae
  Name: NTH2362
ttggtgctattttactctcctcccctttcattgcaaagaaaagcaaaaattatttcaacaaactttgatattttgcaaggtttgtttaat

SEQ ID NO: 4226 - protein, 30 aa, Haemophilus influenzae
  Name: NTH2362
LVLFYSPPLSLQRKAKIISTNFDILQGLFN

SEQ ID NO: 4227 - DNA, 108 bp, Haemophilus influenzae
  Name: NTH2363
gtgcacttaaaattaaccaaaattttaaccgcacttaaatcattattttatgacaaagatcgcctttttcttcaaaaagatcaaaataatgctattaattactcaaaa

SEQ ID NO: 4228 - protein, 36 aa, Haemophilus influenzae
  Name: NTH2363
VHLKLTKILTALKSLFYDKDRLFLQKDQNNAINYSK

SEQ ID NO: 4229 - DNA, 108 bp, Haemophilus influenzae
  Name: NTH2364
gtgcggttaaaattttggttaattttaagtgcacttctttatacaggagcagattatgtattatggtttagatattggtggcacgaaaatagagcttgccgtattcaa

SEQ ID NO: 4230 - protein, 36 aa, Haemophilus influenzae
  Name: NTH2364
VRLKFWLILSALLYTGADYVLWFRYWWHENRACRIQ

SEQ ID NO: 4231 - DNA, 828 bp, Haemophilus influenzae
  Name: NTH2365
gtgccaacacctaaaaccgactatgaagaatggcttaacacgattgtggatttagtgaatcgtgctgatgaaaagtttggtgaagtgggcaccgtaggtttgggcgtacctggttttgttaatcaacaaactggattagccgaaattaccaatattcgtgtggcagataataaaccgattttacgcgatttgtctgtgcgtttaggccgtgaagtgcgggcagaaaatgatgcaaattgttttgcattatctgaagcgtgggatacggaaaatcagcaatatccgactgtacttggtttaattcttggaactggttttggtggcggctttgtcttaaatggtaaagttcattcaggtcaagtgggaatggcgggagagcttggtcatttacaactaaattatcatgccttgaaattattgggatgggataacgcccctatttatcaatgtggttgtggcaacaaggcttgtttggataattatttgtctggtcgcggttttgaaatgctttatcgagatttgaaaggcgaaacattatctgctcgtgaaattattgatttgttctatcaaggcaatgaaagtgcggtagattttgtgaatctttttgttgagttggcggcgatttctattggcaatatcattacggcatttgatcctcatatgattgtactcggcggtggattatctaattttgattacctttatgaggctttaccaaaagcattaccgcctcacttgatgcggacagcaaaagttccaccaattaaaaaagcgaaacacggcgattctggtggtgtgcgtggcgcggcagcgttgtttttaaccaaa

SEQ ID NO: 4232 - protein, 276 aa, Haemophilus influenzae
  Name: NTH2365
VPTPKTDYEEWLNTIVDLVNRADEKFGEVGTVGLGVPGFVNQQTGLAEITNIRVADNKPILRDLSVRLGREVRAENDANCFALSEAWDTENQQYPTVLGLILGTGFGGGFVLNGKVHSGQVGMAGELGHLQLNYHALKLLGWDNAPIYQCGCGNKACLDNYLSGRGFEMLYRDLKGETLSAREIIDLFYQGNESAVDFVNLFVELAAISIGNIITAFDPHMIVLGGGLSNFDYLYEALPKALPPHLMRTAKVPPIKKAKHGDSGGVRGAAALFLTK

SEQ ID NO: 4233 - DNA, 1131 bp, Haemophilus influenzae
  n 1126, 1127, 1128, 1129, 1130: n is any nucleotide
  Name: NTH2368
atgattatggactttgaattttcaaaaatgttagaagaagtgctaacttggatagtcgcacaccttgacgggcctttatgggatgtcacaattattattttgcttgggactggtctattttttaccattacaacaggatttgtgcagttccgtttattcccagcaagtcttcgtgaaatgtggtttggtcgtgcggtggagggtagttcgttaacacctttccaagcatttacgacaggtcttgcgagccgcgttggtgtgggtaacattggtggggttgcaacggcaatcgccttgggaggcgaaggcgcagtgttttggatgtgggtaacggcatttattggtatgtcgagtgctttcgctgaatctacccttgctcaattatttaaaattcaagataaagatggatcattccgcggtggccctgcttattatattgttcaaggtttaaaatcacgttgtatggcagtggcttttgcacttgcattaatttttacatttggttttgcctttaattctgtgcaggcaaactctattgttgaagcaacgagtaatgcgtggaattggaaaggggaatatgtcggtatttcattagtaatttttaccgcacttattattttcggtggcgttaagcgtattgcgattatttcgagcaaccttgtaccaatgatggcacttttctatttgattatagcagtaattattcttggcatgcatattgatatgatcccttccgtgattcatcgtattgttcaaagtgcatttagttttgatgctgccgctggcggaatgtttggtgcattggtatcgaaagcaatgatgatggggattaaacgtggtttattctcaaacgaagcggggatgggatctgcgcctaattcggctgcagcagctcacgttaagcatccagttagccaaggtttagtgcaaatgctcggtgtgtttgttgatacaatgatcgtttgtacttgtactgccgttattattttgctttcgaataattatggtagcgaaacgctcaaaagtatctcacttacgcaaaatgctttgcaataccacataggtgaatttggggtgcttttctggcgtttttcttatgggtaccgagtccgaattggtataccannnnnt

SEQ ID NO: 4234 - protein, 377 aa, Haemophilus influenzae
  Xaa 376, 377: Xaa is any amino acid
  Name: NTH2368
MIMDFEFSKMLEEVLTWIVAHLDGPLWDVTIIILLGTGLFFTITTGFVQFRLFPASLREMWFGRAVEGSSLTPFQAFTTGLASRVGVGNIGGVATAIALGGEGAVFWMWVTAFIGMSSAFAESTLAQLFKIQDKDGSFRGGPAYYIVQGLKSRCMAVAFALALIFTFGFAFNSVQANSIVEATSNAWNWKGEYVGISLVIFTALIIFGGVKRIAIISSNLVPMMALFYLIIAVIILGMHIDMIPSVIHRIVQSAFSFDAAAGGMFGALVSKAMMMGIKRGLFSNEAGMGSAPNSAAAAHVKHPVSQGLVQMLGVFVDTMIVCTCTAVIILLSNNYGSETLKSISLTQNALQYHIGEFGVLFWRFSYGYRVRIGIPXX

SEQ ID NO: 4235 - DNA, 276 bp, Haemophilus influenzae
  Name: NTH2369
atgcgacttcttattttaatccttctttctgtattagtattgtttcaatataatttttggtttggcagtaacggttttttagattatcgtcaaaatgctgagaaaattaaggaaaatcaagcagaaaatgaaaagctatctcaacgtaatcagcgtattaatgcagaaattcaaggattaacaaaaggttttgaagcgatcgaagaacgcgcacgaatgcaacatggcttagtgaaagaaaatgaagtgttctatcatattgtaaaagagagtaaa

SEQ ID NO: 4236 - protein, 92 aa, Haemophilus influenzae
  Name: NTH2369
MRLLILILLSVLVLFQYNFWFGSNGFLDYRQNAEKIKENQAENEKLSQRNQRINAEIQGLTKGFEAIEERARMQHGLVKENEVFYHIVKESK

SEQ ID NO: 4237 - DNA, 675 bp, Haemophilus influenzae
  Name: NTH2370
atgactcgttcaattattgcggtcttgcccgcggctggtgttggttcacggatgcaagcggataaaccgaaacaatatttaacgctgcttggcaaaacactgcttgaacatacactcgatgtgatgctttcttatcctgctgtatctaaaattatcttggcggtaagcaaagatgatccttatatttctacactatcgctcgatcctaaaattcagttagtggaaggtggcacaacgcgagctgaatctgtcttaaatggtttaaatgcaattgcggaaaaaaatgcctgggtgcttgttcatgatgctgcccgcccttgtttacaacatgctgatattgataaattgttagctattgaagataaacaaggtgcgattttggcaatcccagtaacagatacgattaaacgagcggacaatcagcaatgtattgtaaaaacagaagatcgtagccagctttggcaagcaatgacaccgcagtttttcccagtagatatattaagagatgcgctttccacaggaattcaacaaggtgcgaatataacagatgaagcatcagcgatagaacttgctggatttagaccgcacttagtggctggacgtagcgataatttaaaagtgactcgtccagaagatttagcattagcagaattttatttaacaaggaataaatta

SEQ ID NO: 4238 - protein, 225 aa, Haemophilus influenzae
  Name: NTH2370
MTRSIIAVLPAAGVGSRMQADKPKQYLTLLGKTLLEHTLDVMLSYPAVSKIILAVSKDDPYISTLSLDPKIQLVEGGTTRAESVLNGLNAIAEKNAWVLVHDAARPCLQHADIDKLLAIEDKQGAILAIPVTDTIKRADNQQCIVKTEDRSQLWQAMTPQFFPVDILRDALSTGIQQGANITDEASAIELAGFRPHLVAGRSDNLKVTRPEDLALAEFYLTRNKL

SEQ ID NO: 4239 - DNA, 474 bp, Haemophilus influenzae
  Name: NTH2371
atgatcagaattggacacggctttgatgttcacgcttttggcgaagatcgaccattaattattggtggtgtagaagtgccttatcatacgggctttattgcgcactcagatggagatgtggcattacacgcattaactgatgcaatcttaggggctgcagctttaggcgatattggaaaacttttccccgataccgatatgcaatataaaaatgcggatagtcgaggtttactgcgtgaagcgtttcgccaagtacaagaaaagggatataaaataggtaatgttgatattaccatcatcgctcaagcacctaaaatgcgcccacatattgatgcaatgcgtgccaaaatagctgaagatatcctatgtgatattgagcaagttaatgtaaaagcaacgactaccgaaaaattaggctttacaggaagacaagaggggattgcttgtgaagccgttgctcttttaattcgacaa

SEQ ID NO: 4240 - protein, 158 aa, Haemophilus influenzae
  Name: NTH2371
MIRIGHGFDVHAFGEDRPLIIGGVEVPYHTGFIAHSDGDVALHALTDAILGAAALGDIGKLFPDTDMQYKNADSRGLLREAFRQVQEKGYKIGNVDITIIAQAPKMRPHIDAMRAKIAEDILCDIEQVNVKATTTEKLGFTGRQEGIACEAVALLIRQ

SEQ ID NO: 4241 - DNA, 432 bp, Haemophilus influenzae
  Name: NTH2372
atgatcgccctaattcagcgtgtgtctcaagcaaaagtgaatgtaaagggcgaaacaatagggaaaattggcaaaggtttgttagttttgcttggtgtagaaaaagaagataaccgagaaaaagcggataaactcgctgaaaaagtgcttaattatcgaattttcagtgatgaaaatgacaagatgaatttaaatgttcaacaagcgcagggggaattacttatcgtttcgcaatttacattagcagcggatacgcaaaaaggtttacgcccgagtttttcaaaaggtgcgtccccagcattggctaatgaattatatgaatactttatccaaaagtgcgcagagaaattacctgtttcaacagggcaatttgcagcggatatgcaagtgagcttaacaaatgatgggcctgtgacgttttggttaaatgta

SEQ ID NO: 4242 - protein, 144 aa, Haemophilus influenzae
  Name: NTH2372
MIALIQRVSQAKVNVKGETIGKIGKGLLVLLGVEKEDNREKADKLAEKVLNYRIFSDENDKMNLNVQQAQGELLIVSQFTLAADTQKGLRPSFSKGASPALANELYEYFIQKCAEKLPVSTGQFAADMQVSLTNDGPVTFWLNV

SEQ ID NO: 4243 - DNA, 438 bp, Haemophilus influenzae
  Name: NTH2373
atgcacatttgtattctttcaggcagcactttaggtggggcggaatatgttgccgagcatttaaacgatgttttagaaactcaaggtttttccaccgcactttttcacggaccaaatttatctgacattgaaaacgagaaaatttggctgattgtcacttcaacgcacggtgcaggcgaattgccagacaatttaaaacccctatttgatgaattagcgaatagccaaaaggatttttcagatgttcgctttgcggtcgttggattaggtagttctgattatgatactttttgctatgcagcggacaaagtggagcaaacacttcaagcaaaaagtgcggtaaaaatttgtgagactttaaaaattgacgtgttaaacgtggatgatcaagaaagttatgctgaagaatggttaccgagttttattgagggattgaaa

SEQ ID NO: 4244 - protein, 146 aa, Haemophilus influenzae
  Name: NTH2373
MHICILSGSTLGGAEYVAEHLNDVLETQGFSTALFHGPNLSDIENEKIWLIVTSTHGAGELPDNLKPLFDELANSQKDFSDVRFAVVGLGSSDYDTFCYAADKVEQTLQAKSAVKICETLKIDVLNVDDQESYAEEWLPSFIEGLK

SEQ ID NO: 4245 - DNA, 216 bp, Haemophilus influenzae
  Name: NTH2375
atgtctttagaaattttagaccagcttgaagaaaaaattaaacaagcggtagaaactatccaattacttcaattagaagttgaagaattaaaagagaaaaacgcagaatctcaaagaaatatcgaaaacttacaaactgaaaatgaacagctgaaaaacgaacatcgtaactggcaagagcatattcgttcattacttggtaagtttgataacgtt

SEQ ID NO: 4246 - protein, 72 aa, Haemophilus influenzae
  Name: NTH2375
MSLEILDQLEEKIKQAVETIQLLQLEVEELKEKNAESQRNIENLQTENEQLKNEHRNWQEHIRSLLGKFDNV

SEQ ID NO: 4247 - DNA, 999 bp, Haemophilus influenzae
  Name: NTH2376
atgaatcgagcattagccattgaattttcacgagtaacagaagcagccgctctagcagcttacacgtggcttggtcgaggagataaaaatgcggcagacgatgcagcggtaaaagcgatgcgttatatgctgaatttgattcatatggacgctgaaatcgttataggagagggcgaaattgatgaagccccaatgctttatattggcgaaaaagtcggttctggcttaggggaattagtttctatcgcagtagatcctattgatggtacacgtatgaccgcaatggggcaatctaatgctatttctgtcttggctgcaggtggcaaaaatacctttttaaaagcacctgatatgtatatggaaaaattagtggtgggttcaaatgtaaaaggcatcattgatttaaatttaccactggaacaaaatcttcgccgcatcgcatctaagctaggaaaatccctttctgaccttaccgtaatggtattagcaaaaccacgtcacgatgccgtaattaaacaaatacataacttgggcgcgaaagtattggcaattcctgatggcgatgtggcaggttccgtattgtgttgtttacctgatgctgaagtcgatcttctttatggaattggtggtgcgccagaaggcgtggcagctgctgcagccattcgagcattaggtggcgatatgcaagctcgtttaatcccacgcaatgaagtaaaaggcgacaccgaagaaaataaaaaaattgcagctaatgagattcaacgctgtgcagcactgggcataaaagtgaatgaagtgttaaaacttgaagatctcgtgcgtgatgacaatcttgtatttactgcaacaggcattaccaatggcgatttgcttaaaggtatctcccgcaaaggcaatttagccagtactgaaaccattttaattcgaggaaaatcccgcacaattcgtaaaattcaatctattcattatttggatgacctttataaaattttgaatatt

SEQ ID NO: 4248 - protein, 333 aa, Haemophilus influenzae
  Name: NTH2376
MNRALAIEFSRVTEAAALAAYTWLGRGDKNAADDAAVKAMRYMLNLIHMDAEIVIGEGEIDEAPMLYIGEKVGSGLGELVSIAVDPIDGTRMTAMGQSNAISVLAAGGKNTFLKAPDMYMEKLVVGSNVKGIIDLNLPLEQNLRRIASKLGKSLSDLTVMVLAKPRHDAVIKQIHNLGAKVLAIPDGDVAGSVLCCLPDAEVDLLYGIGGAPEGVAAAAAIRALGGDMQARLIPRNEVKGDTEENKKIAANEIQRCAALGIKVNEVLKLEDLVRDDNLVFTATGITNGDLLKGISRKGNLASTETILIRGKSRTIRKIQSIHYLDDLYKILNI

SEQ ID NO: 4249 - DNA, 306 bp, Haemophilus influenzae
  Name: NTH2377
atgaataaccttagtgcgcaattagaaaatcaaattgatgaattaaaaaagcttcagaaatctgtcattacctatgagcaatcgcaaagacaacagctttacgcaggaaaaattaccgatctcaaagcctttggaaaaatgctcaatgataagcgtaaatcacttggtattgagcttagtatgctagaactgcaaactggcgtgtctatttctaccttgaatcgcttatttcaagatccaagccaagttcgatttacaaccgtgtttcttgttgctaaaacattaggggtttcactatgcgcgatt

SEQ ID NO: 4250 - protein, 102 aa, Haemophilus influenzae
  Name: NTH2377
MNNLSAQLENQIDELKKLQKSVITYEQSQRQQLYAGKITDLKAFGKMLNDKRKSLGIELSMLELQTGVSISTLNRLFQDPSQVRFTTVFLVAKTLGVSLCAI

SEQ ID NO: 4251 - DNA, 318 bp, Haemophilus influenzae
  Name: NTH2378
atgcgcgatttagtccgctcgggcaaagtatttctctacggcgaatttattggcttacttagagaagatcatcgaggttttcattttgcttacaatcccgattatcaaggaataccgctctctctcagctttcctattgagcaaagtccttttcattctgacaccttattcccttattttgcatccctcgtcccagaaggctggctaaaacacaaatatgcacttcatcaacgaattgatgaaagcgatatgtttcgctttttacttaataacggggaaaatatgttaggcgcagtgcaaattcaggaagaaaaacaa

SEQ ID NO: 4252 - protein, 106 aa, Haemophilus influenzae
  Name: NTH2378
MRDLVRSGKVFLYGEFIGLLREDHRGFHFAYNPDYQGIPLSLSFPIEQSPFHSDTLFPYFASLVPEGWLKHKYALHQRIDESDMFRFLLNNGENMLGAVQIQEEKQ

SEQ ID NO: 4253 - DNA, 1029 bp, Haemophilus influenzae
  Name: NTH2379
atgaatttttgtcgtattttattaaagccattgaaaaaaaatgaagttcattctggttacagcacaaaaggtttacactatcttacaggcaataaacattttaatcctgaattgcccttttctcgccaagaatttattacagtgaaaccccaaaaacagcaagggatgagcatttcaggttttcaaccaaaattacagcttattatcaaagatgatcactttgacagcgtagatcaacagggacattacattttaaagccttcgcccgaagagtatccttttttagctgaaaatgaacacgccaccatgcgcattatgaaagaattagggtttgatgtgccagaaaatggtttagtttcttttgctggcgaacaaaatcagaaggaatttgcttttgttataaagcgttttgatcgtgatgaacaacaaacagagattcaccaagaacaacttgatggtgcaatgaatattcgagcaaggtacggaaaaataggtgcagataatgagcaatatgtgagttatgaacaaattgctaagtttattttgcagcacactgaaaaatcatttagctcagcaacgagaaatttttcgtcgaatatttacgcttatttattaggaaataatgatcttcacttacgcaatttttcatttatttatcccaaaaacagtcatccaaaacttgctccaatttatgactttgtgtcggtgtcgccctatcctgaaatatttaattcaacactacttgctttgccattgttagcgcgagaagaaggtaatgccacactagccaaaggatttaatactcaatacggtgaatatatcggcgatgattttgtcgagtttggggaaaatattggattaaataaaaatgtgattattcaaaaattaattcctgaaattacacaagaaaaggaaaaagtagagcagatttattcacaatcctttatgccgcagccacatattgattgcgtgctgaaaacttatcgcaagcgtttagcattacttaacgtattaaatgaacctgaacta

SEQ ID NO: 4254 - protein, 343 aa, Haemophilus influenzae
  Name: NTH2379
MNFCRILLKPLKKNEVHSGYSTKGLHYLTGNKHFNPELPFSRQEFITVKPQKQQGMSISGFQPKLQLIIKDDHFDSVDQQGHYILKPSPEEYPFLAENEHATMRIMKELGFDVPENGLVSFAGEQNQKEFAFVIKRFDRDEQQTEIHQEQLDGAMNIRARYGKIGADNEQYVSYEQIAKFILQHTEKSFSSATRNFSSNIYAYLLGNNDLHLRNFSFIYPKNSHPKLAPIYDFVSVSPYPEIFNSTLLALPLLAREEGNATLAKGFNTQYGEYIGDDFVEFGENIGLNKNVIIQKLIPEITQEKEKVEQIYSQSFMPQPHIDCVLKTYRKRLALLNVLNEPEL

SEQ ID NO: 4255 - DNA, 1653 bp, Haemophilus influenzae
  Name: NTH2381
atgcgtaaaaatggttttgttgtaatggggcatttgttgaaattagtgactccacttgcacacattatggcgtttaccattactatggggacgctcggtttccttgctgccatctttattatggtgtttggtgcaatggggttagtaaatctcttaaactttgacacccatttaagtttttctggcattttgaccgcacttatcgtattagcggtggctcgtggtgtattgcgttatttagagcaaatgtctgggcattatattgcttttaaattactcgcattattgcgtgacaaagtgttttcttctttgcgtcgtttggcttttgtgaagttgcaagataaacaagcagggcaattagtgtcattagtaaccaatgatattgaattgctcgaagtattttatgcacacaccattgcaccaattatgattgcgttctttacctctgcgattctattgttggtctttgcccatctttcaggttggtttgtagttgtcgcattagccgcttatttaacggtaggtgtgattttaccgattatcaccaccaaattggctcgtgaagatggcagacgctatcgtgaattagtcggcgaaatgaatgatttcttccttgacagcgtgcgtggtatgaaagaaattcagctttttggctatgcacaacaacgtttagcagaaatccaacaacgtagccaaaaaattgataccgcctttgaacgcattaaagaccaagaagcgaaagttcgtgtttatactgaagtggcagtatctgttttcaacatcattatgctgtttactggcttaattttgtttagcttagataaaattgatttcgctgcctttttaatcggcgttattttattaatgtcgagctatgggccagttatcgccttaagtaacctttcaagcaacttattacaaactttggcttctggcgaacgagtattaagtttattagcggaagagccagagttaaaagatgtagaaagtgcggtagatttaaaagatgtttctcgcattgatgtagagaacctaaacttcgcttacggcgaagaacaaattttatcggatgtcagcttatctgtgaaaaaaggcgaaattttaggtattcacggcagaagcggcagcggtaaaagtaccttattgaaattgctgatgcgtttttatgatccaaaatcaggtagcattaaaattaccgccgaaaccttaccaatacaacacttgcagttgcgtgacaatatggcgtacattactcagcaaacctatatttcaacgaaacccattgaagaaaatattcgccttgcgcgccgtgatgcaaccttagaagaaattatggaagcggcgaagaaagcctcaattcatgattttattttgagtttgccacaaggttatcaaacaaaaatgaccgaattgggcggcaatctctctgacggtgaaaaacaacgtatcggtattgcccgagcattcttgcataatgcaccgattatcttgcttgatgagccaaccagtaatttggatagcttaaacgaagcaatgattttgaaatcattactcgatgctaaagctgagaaattgattattctcgtcagccatcgccaatctaccatggctatttgcgatcaggtaattggtatagaaaacggcagaatgtcc

SEQ ID NO: 4256 - protein, 551 aa, Haemophilus influenzae
  Name: NTH2381
MRKNGFVVMGHLLKLVTPLAHIMAFTITMGTLGFLAAIFIMVFGAMGLVNLLNFDTHLSFSGILTALIVLAVARGVLRYLEQMSGHYIAFKLLALLRDKVFSSLRRLAFVKLQDKQAGQLVSLVTNDIELLEVFYAHTIAPIMIAFFTSAILLLVFAHLSGWFVVVALAAYLTVGVILPIITTKLAREDGRRYRELVGEMNDFFLDSVRGMKEIQLFGYAQQRLAEIQQRSQKIDTAFERIKDQEAKVRVYTEVAVSVFNIIMLFTGLILFSLDKIDFAAFLIGVILLMSSYGPVIALSNLSSNLLQTLASGERVLSLLAEEPELKDVESAVDLKDVSRIDVENLNFAYGEEQILSDVSLSVKKGEILGIHGRSGSGKSTLLKLLMRFYDPKSGSIKITAETLPIQHLQLRDNMAYITQQTYISTKPIEENIRLARRDATLEEIMEAAKKASIHDFILSLPQGYQTKMTELGGNLSDGEKQRIGIARAFLHNAPIILLDEPTSNLDSLNEAMILKSLLDAKAEKLIILVSHRQSTMAICDQVIGIENGRMS

SEQ ID NO: 4257 - DNA, 1080 bp, Haemophilus influenzae
  Name: NTH2382
atggataaagaggctgagcatttccgcaaaattaccatgaaagtgcttactatgcagcttaactcggtttcactgatggatttactcgcttatggtggcgcagctatcgggattttaaccgcactattgcaattccaaaatgcacaactcagcgtgttaggcgtgattttatttattctactttcctccgagttctttattccgcttcgtttgcttggttcattcttccatgtggcgatgaatggcaaagcggcttcagataagattttcacattgttagatacgccagtggaaacccaacaaagtgcggtggattttgaagcaaaaaataacgttcaagtggaaattaaagatctgcatttttcttatagtgaagaaaaatcagcaattacaggtttagatttgagtattttaccaaatcagcttacggtatttgtgggtaaaagtggttgcggtaaatcgaccttagtttcgttgttgatgggttttaatcaagcgcaacaaggtgagattttgtttaatggacaaaacgccctcaatattgaccgcacttctttctatcaaaaagtatcattagtaagccacagcagttatgtgtttaaaggctcgctgcgtgaaaatatgacgatggcgaaaattgatgccacagatgaacaaatttatgcttgtttagaacaagtgaatctcgcccaatttgtacgcgaaaatggcggcttagatatgcagctattaagccgaggtgcgaatttatcgggcggtcaaattcaacgtttagctttagcgcgtgctttgttacacaatgccgagctttatatttttgatgaagcgaccagtaatattgatgtggaaagcgaagaaattattttgcagtttattcaacaatttaaacaacaaaaaaccattgtgatgatttctcaccgtttggcaaatgctgtgaatgcggactgtattaatgtgcttgaccaaggcaaattgattgagcaaggcacacacgaaagcttaatggcaaaacaaggtgcgtatgctgaaatgttccaacaacaaaaagatttagaacaaattagagaggtggcaaatgcg

SEQ ID NO: 4258 - protein, 360 aa, Haemophilus influenzae
  Name: NTH2382
MDKEAEHFRKITMKVLTMQLNSVSLMDLLAYGGAAIGILTALLQFQNAQLSVLGVILFILLSSEFFIPLRLLGSFFHVAMNGKAASDKIFTLLDTPVETQQSAVDFEAKNNVQVEIKDLHFSYSEEKSAITGLDLSILPNQLTVFVGKSGCGKSTLVSLLMGFNQAQQGEILFNGQNALNIDRTSFYQKVSLVSHSSYVFKGSLRENMTMAKIDATDEQIYACLEQVNLAQFVRENGGLDMQLLSRGANLSGGQIQRLALARALLHNAELYIFDEATSNIDVESEEIILQFIQQFKQQKTIVMISHRLANAVNADCINVLDQGKLIEQGTHESLMAKQGAYAEMFQQQKDLEQIREVANA

SEQ ID NO: 4259 - DNA, 684 bp, Haemophilus influenzae
  n 109: n is any nucleotide
  Name: NTH2383
ttgaatttaacattttcgtcattatatcgttttttgctacactatgcccaattacgattaatcaattttgttttacggagaaaaaaaatgtcagaacaaagaacaaaanagttgaaatccccagaagtagaaaatcaagaagaagtcgttgtggaagaagcacaacaagcagatccttctcaagaatttgatcctttagaagaagcaattgctcgcgtgcaagagcttgaagagcagctaaaaactcaaatagaagaagcggcaaacaaagaacaggatattttacttcgctctcgtgctgaaattgaaaatcttcgtcgtcgtactgaacaagacgtagaaaaagcacataaattcgctttggaaaaattttcaaaagacattttgaatactatcgataacctagagcgtgcgcttgccactccagcaaataaagaagatgaaagcgtaaaagccttatttgacggtgtagaactaaccttaaaagaattagtttcaaccgttgggcgttttggcgtggaagctgtgggagttgtcggtgaagcctttaatcctgatttacatcaagccatttcaatgcaaccagctgaaggctttgaaaccaatcaaattagcgtcgtattgcaaaaaggctacaccttaagtggtcgagtcattcgcccagcgatggtaatggtggcggct

SEQ ID NO: 4260 - protein, 228 aa, Haemophilus influenzae
  Xaa 37: Xaa is any amino acid
  Name: NTH2383
LNLTFSSLYRFLLHYAQLRLINFVLRRKKMSEQRTKXLKSPEVENQEEVVVEEAQQADPSQEFDPLEEAIARVQELEEQLKTQIEEAANKEQDILLRSRAEIENLRRRTEQDVEKAHKFALEKFSKDILNTIDNLERALATPANKEDESVKALFDGVELTLKELVSTVGRFGVEAVGVVGEAFNPDLHQAISMQPAEGFETNQISVVLQKGYTLSGRVIRPAMVMVAA

SEQ ID NO: 4261 - DNA, 816 bp, Haemophilus influenzae
  Name: NTH2384
atgcacaaaaacttatttcattggttaatggaacgtggttatcaagtgttggtggaaaaagaagtcgccataacacttgagttaccttttgaacatcttgctacgttagaagaaataggccaccgagcccaattagccattgtgattggtggagacggcaatatgctagggcgcgctcgggtattagcaaaatatgatattccattgattggtattaatcgtggtaatttgggatttttaacggatattgacccgaaaaatgcctattcccagcttgaagcttgtttagaacgtggcgaattttttgtggaagaacgttttttattggaagcaaaaatcgaacgagcaagtgaaatcgtatcaaccagcaatgcggtaaatgaagcggttattcatcccgccaaaattgcacatatgattgactttcacgtatatatcaatgataagtttgcattttctcaacgttctgatggattaattgtttctactccaacaggttctacggcttattctctttccgctggtggacctattttgacaccaaaccttaatgccattgcattagtgccaatgtttccacataaattaacttctcgccctcttgttgttgatggggatagtaaaatatcgattcgttttgctgaacataatacctctcaattagaagtgggctgtgatagtcaaattaccttaccttttaccccagatgatgtggtgcatattcaaaaaagcgagcataaactccgattgcttcatctgaaaaattataattattacaatgtgttaagtagcaaattaggttggttaaaatcattt

SEQ ID NO: 4262 - protein, 272 aa, Haemophilus influenzae
  Name: NTH2384
MHKNLFHWLMERGYQVLVEKEVAITLELPFEHLATLEEIGHRAQLAIVIGGDGNMLGRARVLAKYDIPLIGINRGNLGFLTDIDPKNAYSQLEACLERGEFFVEERFLLEAKIERASEIVSTSNAVNEAVIHPAKIAHMIDFHVYINDKFAFSQRSDGLIVSTPTGSTAYSLSAGGPILTPNLNAIALVPMFPHKLTSRPLVVDGDSKISIRFAEHNTSQLEVGCDSQITLPFTPDDVVHIQKSEHKLRLLHLKNYNYYNVLSSKLGWLKSF

SEQ ID NO: 4263 - DNA, 1560 bp, Haemophilus influenzae
  Name: NTH2385
atgcttactcaacttactatcaataattttgcgattgttcgtcagcttgatattgaattggcgaaaggaatgtctgttataacaggggaaactggtgctggaaaatctatcgccattgatgctttaggtttatgtttcggacaaagagtagaaacctcaatggtgcgtgaagggcaagagcgtgcggaaatttgtgcaactttccaactagaatcgcaaaatcctgcttatcactggttgagtgagcaagaattacaggatccagataatccaactgaatgtattttacgtcgtataattaatgcagacggacgttctaaggcttttattaatagtacaccagtatccgcttctcaattaaaagaaattgctcaatatctcgttcatattaatgggcaacacgcttctcaattattgttaaaaaatgactatcagcttcagttagttgataattttgccgctcatcctgaattacttgtgaaaatgcgtgaagattatcagacatggaaaaatcttcaaaatcaagttaaaacctttcaacaaaaagtggcggaaaatgaagcacgtaaacaacttttacagtatcaagtggatgagttagatgaatttaaccttcgaccaaatgaatatttggaattagaagatgaacaacgtcgtttatctagcagcgaacagctaacccaactttctcaatcggccctgcaaattttaagtgaaaatgacaccgtaaatatcgatagtttgctttatcgtgcgacacaatatattgatgaattagctgaacttgatccgcaatatgctgaagtgcaaaatatgttgaatgatgcgttgattcaagtgcaagaagcaaccagtgaagtgcaaaatttatcaagtaatatcgagcaggatcctcaacttttacaggaaatcgaacagcgaattagtcaggctttacaacttgctcgtaaacatcaagttaaacctgaagatcttgtagaacagcacaaaaaattaaaagcggaattaaccgcacttttggatttttctgaaagtgaagagatgttgattgagcaagaaaaacgagcatttgaacaaatgcaagcaacggctacagcattaacagcaagtcgtcagcaatctgcaacccgcttagcgcaaaatgtcacacagtcgataaaacaacttgcaatggaaaacgctgaattttatgtagagttgaatacggatttagataaagtgagtgcaaatggtgcggataatgtgattttcactttgcgtagtaatttaggacaacaaccgcagccattagctaaaattgcctctggtggtgagctttctcgtatttctttagcgattcaagttttaacttctgatcaatcggctattccaacgttaattttcgatgaagtggacgtgggcattagcggaaaaacagcaagtgttgtcggaaaacttttacgtcaattaagtgaacgctgccaagtattatgcgtaacgcacttgccacaggttgcttgtcatggccatcatcagttcaatgtagaaaaatttactgttgataataaaactgaaacaaaa

SEQ ID NO: 4264 - protein, 520 aa, Haemophilus influenzae
  Name: NTH2385
MLTQLTINNFAIVRQLDIELAKGMSVITGETGAGKSIAIDALGLCFGQRVETSMVREGQERAEICATFQLESQNPAYHWLSEQELQDPDNPTECILRRIINADGRSKAFINSTPVSASQLKEIAQYLVHINGQHASQLLLKNDYQLQLVDNFAAHPELLVKMREDYQTWKNLQNQVKTFQQKVAENEARKQLLQYQVDELDEFNLRPNEYLELEDEQRRLSSSEQLTQLSQSALQILSENDTVNIDSLLYRATQYIDELAELDPQYAEVQNMLNDALIQVQEATSEVQNLSSNIEQDPQLLQEIEQRISQALQLARKHQVKPEDLVEQHKKLKAELTALLDFSESEEMLIEQEKRAFEQMQATATALTASRQQSATRLAQNVTQSIKQLAMENAEFYVELNTDLDKVSANGADNVIFTLRSNLGQQPQPLAKIASGGELSRISLAIQVLTSDQSAIPTLIFDEVDVGISGKTASVVGKLLRQLSERCQVLCVTHLPQVACHGHHQFNVEKFTVDNKTETK

SEQ ID NO: 4265 - DNA, 111 bp, Haemophilus influenzae
  Name: NTH2386
ttggctagagctaattctgtgatttcacttccgcccaagagtcttgccaaggctggtacacgttcagcttgtgaaagtgcggtcattttgtttcagttttattatcaacag

SEQ ID NO: 4266 - protein, 37 aa, Haemophilus influenzae
  Name: NTH2386
LARANSVISLPPKSLAKAGTRSACESAVILFQFYYQQ

SEQ ID NO: 4267 - DNA, 114 bp, Haemophilus influenzae
  Name: NTH2387
atgaccgcactttcacaagctgaacgtgtaccagccttggcaagactcttgggcggaagtgaaatcacagaattagctctagccaatgcacaggaaatgttagatttggttcat

SEQ ID NO: 4268 - protein, 38 aa, Haemophilus influenzae
  Name: NTH2387
MTALSQAERVPALARLLGGSEITELALANAQEMLDLVH

SEQ ID NO: 4269 - DNA, 2943 bp, Haemophilus influenzae
  Name: NTH2388
atgaccgcactttctgccctcattgaacaaaaattacaatctcttggcacaatcctgtgccaatcttttccagagctttccccagaaaaaattcacgaagctattcaacaaaattcaaatcatccagaactgcctgtttatcaattaggctatgccatagcaatgtctgactttgtggaaaaagtcttgcaaaaatacccgcacttagtgaaacaatggtgggaaaaatccccctgttttgcagattgcactgcctatattgaacgtttgaatagagagttagccaatgtacatgacgaaactgcactctatcaaacattacgtcaattccgtaacattgaaatggcaaaattaagtttttgtcaaagtttgaatcttgcgactgttgaggaaatttttgttcagctttcacaacttgcagagagtttaattatcgctgcccgcgattggctttatcatcaagcctgtgcggagataggcacaccaatggatgaacaaggcaatccgcagcagctttatatcctaggaatggggaaactaggcggctttgaactaaatttttcctcggatattgatttaattttcacttatccatcacaaggggaaacatctattgaaaatacgaatgctcgacgttctgtggataatggaaaattttttacacgtttagggcaacgccttatttctgccttagatgaatttacctctgatggttttgtgtatcgaaccgatatgcgcttgcgcccatttggtgacagcggcgcgcttgttctcagctttgcagcaatggaacaatattatcaagatcaaggtcgagattgggaacgctatgcaatgattaaagggcgagtattgggcgtacaaacaaaggatcccaacgtatctaaattgcaaaaaatgttacgcccctttgtgtatcgtcgctatattgactttagtgtgattcaatctttacgtgaaatgaaaggcaaaattgagcgagaagtacgccgtcgtggtttgaaagataatattaaactaggtgctggtggtattcgtgaagtcgaatttatcgtacaagtttttcaactcattcgaggcgggcgagaaatcaatctgcaacaacattcactcttaaagatcttgcctgaaattaccaaactaggattaattaccgaacaacaattccacgatttacgtgaaagttatatttttttacgccgcgtagaaaacattctacaagccattaacgatcaacaaacgcaaacactaccaaccgatgaaatagatcaaattcgtttagtcaaggcatgtaaaactttcacctgtttaaatgaaaataatcaaaccattgaaaaacattatccaatagaaaattgggacgatttttaccgcactttacaacaaaaacaagaaaaagtgcgggcagtatttactcaattaatcggtgatgaacaagatgagccttcacaaactgatagccaatggcaagattttttagaagcagattttgaggatattgaacaaacattattagagagtggtgtatcagaaaataatattgatgaagttttagaaaagcttgctcaattcaaagacggcctaaatcacagagtgattgggtcgcgtgggcgtgatgttttgagtcatttgatgccaacagtacttgcactcatttttgaacaagaaaattaccgcactttgctcccccgaatactgaacattattgaaaaaatttcgagtcgcacgacttatttagaattattattggaaaatcctcgcgcacttcagcaagttattgaactttgtgcacagtctcaacttatttcagaacaattggctcgctatcctattttattagatgaattgcttaatacggaagcactacgtcatccattgccatttacccaatatcctgcagagttacaccaatatttgcttcgtttaccccctgatgatgaagaacagattatcgatgctttacgtcaatttaaacaagcaaccctattaaaagtggcagcggcagatattttaggcgcattaccagtaatgaaagtaagcgatcatttaacctatcttgctgaatccattattgaagtggttgtgaatctagcttggaaacaagtgtcttctagatttggcgtgcctgaacatttacaaaataatgaaaaaggatttttagttattggttatggaaaacttggtggtattgaactcggttataaatccgatttagacctcgtatttttgtacgatgccgtagaaaatcaaacaacaggtggcaagaaagtgattgatagcaatcaattttacctacgcttggcacaaaagattgtgagtattttcagcataaatacttccgctggcgtactttatgaggcagatatgcgcctgcgcccttctggcgatgctggcttaattggctgctctctttctgcattttcccattatcaattgaatgacgcttggacatgggaaaaacaagcacttgtgcgcgctcgtccagtatttggcgaatcatctcttaaagctaaatttgagcatatccgccaacaagtgctttctgcatcacgagatattgaacaattaaaacaagatgttgttgagatgcggaaaaaaatgtttgcccatttatctcactcaaaacacagtgaatttaaccttaaaacagatcgcggtggcattacagatatagaatttattgctcaatatttaatgcttgccaatgccccgaaaaaaccacaactaacaaaatggtcagacaatgttcgtattttcgatgatatagcagaggctaaaattattagccaaacagactgcgacacattaaaacaatgttatgttgatttacgcaatgctattcaccatttaaatttgataggcaaatcccccgttgtggatgaaactgaatttgtcaaagagcggtcatttattcaagcattttgggataggttatttgtatcc

SEQ ID NO: 4270 - protein, 981 aa, Haemophilus influenzae
  Name: NTH2388
MTALSALIEQKLQSLGTILCQSFPELSPEKIHEAIQQNSNHPELPVYQLGYAIAMSDFVEKVLQKYPHLVKQWWEKSPCFADCTAYIERLNRELANVHDETALYQTLRQFRNIEMAKLSFCQSLNLATVEEIFVQLSQLAESLIIAARDWLYHQACAEIGTPMDEQGNPQQLYILGMGKLGGFELNFSSDIDLIFTYPSQGETSIENTNARRSVDNGKFFTRLGQRLISALDEFTSDGFVYRTDMRLRPFGDSGALVLSFAAMEQYYQDQGRDWERYAMIKGRVLGVQTKDPNVSKLQKMLRPFVYRRYIDFSVIQSLREMKGKIEREVRRRGLKDNIKLGAGGIREVEFIVQVFQLIRGGREINLQQHSLLKILPEITKLGLITEQQFHDLRESYIFLRRVENILQAINDQQTQTLPTDEIDQIRLVKACKTFTCLNENNQTIEKHYPIENWDDFYRTLQQKQEKVRAVFTQLIGDEQDEPSQTDSQWQDFLEADFEDIEQTLLESGVSENNIDEVLEKLAQFKDGLNHRVIGSRGRDVLSHLMPTVLALIFEQENYRTLLPRILNIIEKISSRTTYLELLLENPRALQQVIELCAQSQLISEQLARYPILLDELLNTEALRHPLPFTQYPAELHQYLLRLPPDDEEQIIDALRQFKQATLLKVAAADILGALPVMKVSDHLTYLAESIIEVVVNLAWKQVSSRFGVPEHLQNNEKGFLVIGYGKLGGIELGYKSDLDLVFLYDAVENQTTGGKKVIDSNQFYLRLAQKIVSIFSINTSAGVLYEADMRLRPSGDAGLIGCSLSAFSHYQLNDAWTWEKQALVRARPVFGESSLKAKFEHIRQQVLSASRDIEQLKQDVVEMRKKMFAHLSHSKHSEFNLKTDRGGITDIEFIAQYLMLANAPKKPQLTKWSDNVRIFDDIAEAKIISQTDCDTLKQCYVDLRNAIHHLNLIGKSPVVDETEFVKERSFIQAFWDRLFVS

SEQ ID NO: 4271 - DNA, 933 bp, Haemophilus influenzae
  Name: NTH2389
atgaaaccaaccgcaatttttttaatgggccctacggcctcaggcaaaacggatttagctattcaactacgaagctcgcttccagttgaagtgattagtgtagattcagcgctcatttataaaggaatggatattggcacagcgaaaccatcaaaagaagaacttgctcttgcgcctcaccgtttgattgatattttagatccatcagaaagctattccgcaatgaatttccgcgatgatgcgctacgcgaaatggcggatattaccgcacaaggcaaaatcccgttactagtgggtggtacgatgttgtattacaaagccttaattgaagggctttctcccttgccttctgctgatgaaaatattcgtgccgagcttgaacaaaaagcagctcaacaaggttgggcagcattgcatacagaactcgccaaaatcgatcccatttctgccgcccgaattaatcccagtgattctcaacgaatcaatcgtgctttagaggttttttatatcacgggaaaatcactcacagagctgactgaagaaaaaggcgaagccttgccttatgattttgtgcaatttgcaattgcgccgcaagatcgccatgttttgcatgaacgcatcgaacaacgctttcataaaatgattgaactaggctttcaagcagaagtggaaaaactttatgcacgtggcgatttaaatattaatctgccgtcaattcgctgtgtaggctaccgtcagatgtgggaatatttgcaaggcgattacgatcacgaggaaatgattttccgtggtatttgtgcaacgcgccaacttgcaaaacgccagctcacttggctgcgcggctggaaaacaccaatacaatggctagatagtttgcaacctcaacaagcgaaagaaaccgtattacgtcacttagattcctatcaaaaaggt

SEQ ID NO: 4272 - protein, 311 aa, Haemophilus influenzae
  Name: NTH2389
MKPTAIFLMGPTASGKTDLAIQLRSSLPVEVISVDSALIYKGMDIGTAKPSKEELALAPHRLIDILDPSESYSAMNFRDDALREMADITAQGKIPLLVGGTMLYYKALIEGLSPLPSADENIRAELEQKAAQQGWAALHTELAKIDPISAARINPSDSQRINRALEVFYITGKSLTELTEEKGEALPYDFVQFAIAPQDRHVLHERIEQRFHKMIELGFQAEVEKLYARGDLNINLPSIRCVGYRQMWEYLQGDYDHEEMIFRGICATRQLAKRQLTWLRGWKTPIQWLDSLQPQQAKETVLRHLDSYQKG

SEQ ID NO: 4273 - DNA, 1170 bp, Haemophilus influenzae
  Name: NTH2390
gtggcgacaccaaattttagccgaactcaaaatgatttaagttattgctatattaatggccgaatggttcgagataaagtgatcagccatgcgattcgacaagcctatgctcaatatttaccaaccgatgcttatcctgcgtttgtgttgtttattgatttaaacccgcacgatgtagatgtcaatgttcatccaaccaaacatgaagtacgctttcatcaacaacgcctcattcatgattttatttacgaaggcataagttatgcactaaacaatcaagaacagcttaattggcacacagaccaaagtgcggtagaaaatcacgaagaaaatacagtgcgtgagccccaaccgaattatagcattcgtcctaatcgtgcagctgcggggcaaaatagctttgcgccaaaatattatgaaaaaccacagcaaaatcaaccgcacttttctaacacaccagtgttgccaaatcatgtaagtactggttatcgagattaccgttctgatgcaccgagtaaaactgagcaacgtttatatgctgaattgttacgcacgttaccgcctacagcgcaaaaggatatatcggatacagcacaacaaaatatttcagatacagctaaaatcatctcaactgaaataattgagtgctcatcacatctgcgtaccctttcacttattgaaaatcgcgcgctcttattacaacagaaccaagatttctttttgctttcattggaaaaattacaacgcttgcaatggcaattggctttacaacaaatacagattgaacaacaaccattgttgattccaatcgtatttcgtttaacagaggcacaatttcaagcatggcaacaatattcagataacttcaaaaaaattggctttgaatttatcgaaaatcaagcacaattacgcttaaccttaaataaagtgccaaatgtgttacgcacacaaaatctacaaaaatgcctgatggcaatgctgactagagatgaaaattcatcaccatttttaaccgcactttgcgcacaattagaatgtaaaacctttgacgctttagcggacgcactcaatttattaagcgatacagaacgtttactcacgcaaacgaatcgcacggcattcacccaattactcaaacctgttaattggcagcctttattagacgaaatt

SEQ ID NO: 4274 - protein, 390 aa, Haemophilus influenzae
  Name: NTH2390
VATPNFSRTQNDLSYCYINGRMVRDKVISHAIRQAYAQYLPTDAYPAFVLFIDLNPHDVDVNVHPTKHEVRFHQQRLIHDFIYEGISYALNNQEQLNWHTDQSAVENHEENTVREPQPNYSIRPNRAAAGQNSFAPKYYEKPQQNQPHFSNTPVLPNHVSTGYRDYRSDAPSKTEQRLYAELLRTLPPTAQKDISDTAQQNISDTAKIISTEIIECSSHLRTLSLIENRALLLQQNQDFFLLSLEKLQRLQWQLALQQIQIEQQPLLIPIVFRLTEAQFQAWQQYSDNFKKIGFEFIENQAQLRLTLNKVPNVLRTQNLQKCLMAMLTRDENSSPFLTALCAQLECKTFDALADALNLLSDTERLLTQTNRTAFTQLLKPVNWQPLLDEI

SEQ ID NO: 4275 - DNA, 369 bp, Haemophilus influenzae
  Name: NTH2391
atgcacacgcatactttttctcttgtgggcgatactttacatcttactagttatcaacgttcctgtgatgttccgcttggattgaatttcaatcaaattcaggtgtttaccttcttagcgcttatggctcagatcacgggcaaaaaagccggcaaggcatatcataaaattgtgaatgcgcatatttatgaagatcagcttgagttaatgcgtgacgtacaacttaaacgcgagcctttcccattgccaaaattagaaatcaatccagatataaaaacgcttgaagatttagaaacttgggtcacgatggatgattttaaagtcgttggctatcaatctcatgagccaattaaatatcctttttccgtc

SEQ ID NO: 4276 - protein, 123 aa, Haemophilus influenzae
  Name: NTH2391
MHTHTFSLVGDTLHLTSYQRSCDVPLGLNFNQIQVFTFLALMAQITGKKAGKAYHKIVNAHIYEDQLELMRDVQLKREPFPLPKLEINPDIKTLEDLETWVTMDDFKVVGYQSHEPIKYPFSV

SEQ ID NO: 4277 - DNA, 519 bp, Haemophilus influenzae
  Name: NTH2392
atggatgcagcaaaagtgcggtcagaatttgacgagaaaatgatgcgctacgcccttgagcttgccgataaagcggaagcgttaggtgagattcctgtgggggcggttttggttgatgacgctagaaatattattggagaaggttggaatctctccattgttcaaagcgatcctaccgcacatgctgaaattatcgctttgcgtaatggcgcgaaaaatattcaaaattatcgcctactgaatagcacgctttatgtgacattagagccttgcacaatgtgtgcaggggcaattttgcatagccgtattaaacgccttgtgttcggtgcatctgattataaaactggcgcgattggatcacgttttcatttttttgatgattacaagatgaatcatactttagagattacatctggcgtattggcagaagagtgtagtcaaaaattgagtacattttttcagaaaagacgcgaggagaaaaaaatagagaaagcattattaaaaagtctgagtgataat

SEQ ID NO: 4278 - protein, 173 aa, Haemophilus influenzae
  Name: NTH2392
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDN

SEQ ID NO: 4279 - DNA, 312 bp, Haemophilus influenzae
  Name: NTH2393
atggaaaacaaggctgatcgttatcaaaaagcagtcaatattatggatgtgcttgagcaatcgccctttgccaaaataatcaaaaaaggtcttgccatcaatgaacttaatcaaaaatttaaccgcatttttccacaggaatttcacggcaaatttcgtattggcaacataacagatcatttaatttttattgaagtgtctaatgctattgttcggcaggggattctatttaaacaaattgaattattaacactaattcaagaagaatttccgcaagtaacagggtttgagataacgatcaatcctggattt

SEQ ID NO: 4280 - protein, 104 aa, Haemophilus influenzae
  Name: NTH2393
MENKADRYQKAVNIMDVLEQSPFAKIIKKGLAINELNQKFNRIFPQEFHGKFRIGNITDHLIFIEVSNAIVRQGILFKQIELLTLIQEEFPQVTGFEITINPGF

SEQ ID NO: 4281 - DNA, 309 bp, Haemophilus influenzae
  Name: NTH2394
atgagacgaatgatttcaggcactgtcaaaccgaatttttggtcgcgattacttttaagtatcatcgcgatttttgctttgcctaacgcacaaagttttgaaaatcaaaataatacggaaaattattcctcaagtgtttccattcaacaagcgttagaaacggtaaaagttgctcgtgaagtgcaacgacaagccattcctcaaccttcaatttcccgtcaaactgaaaaacaacctaaaattcaaccgcactttttagcggatgtattgaatcttagtgcgccaattcgagcaggccccttacttatt

SEQ ID NO: 4282 - protein, 103 aa, Haemophilus influenzae
  Name: NTH2394
MRRMISGTVKPNFWSRLLLSIIAIFALPNAQSFENQNNTENYSSSVSIQQALETVKVAREVQRQAIPQPSISRQTEKQPKIQPHFLADVLNLSAPIRAGPLLI

SEQ ID NO: 4283 - DNA, 1635 bp, Haemophilus influenzae
  Name: NTH2395
atgagcattttaacaagaatttttggtagtcgtaatgaacgcgttttacgtaaattaaaaaaacaagtcgtaaaaattaataaaatggagcctgcttttgaggcattaagtgatgatgaattaaaagcaaaaacacaagagtttcgtgatcgtttaagtggtggcgaaactttgcaacaaattttaccagaagcattcgcaacggtacgcgaagcaagtaagcgtgtgcttggtatgcgccattttgatgtgcagcttatcggtgggatggtattgactaaccgctgtatcgcagaaatgcgtactggtgaaggtaaaacattaacggcgactcttccttgttatttaatcgctcttgaaggtaaaggcgttcatgttgtcacggtgaatgattatcttgctcgccgagatgcagaaacaaaccgtccgttatttgaatttttgggtatgagcgtaggcgtcaatattcctggtttatcgccagaagaaaaacgtgcagcttatgcggcagatattacttatgcaaccaatagtgaacttggttttgattatttacgtgacaacttagcccactcaaaagaagagcgtttccaacgtactttaggctatgcgttggtggatgaagtggattctatcttaatcgatgaagcgcgtacgccattgattatttctggccaggcagaaaacagttcagagctttatattgcggtaaataaattgatcccaagtttaattaaacaagaaaaagaagatacggaagaatatcaaggagagggcgatttcactttagatttgaaatctaaacaggcgcatttaaccgaacgtggtcaagaaaaagtagaagattggttaattacgcaaggtttaatgcctgagggggactctttgtattctcctagtcgaattgtattgcttcatcacgttatggctgcattgcgtgcgcacacattgtttgaaaaagatgtcgattacattgtgaaggacggtgaaatcgtgattgttgatgaacacactggtcgtacaatggcggggcgtcgttggtcagatggtttgcaccaagccattgaggcaaaagaaggggtggatgttaagagcgaaaaccaaacggttgcgtcaatttcttatcaaaactacttccgtttatatgaacgtcttgcgggtatgacggggactgcggataccgaagcatttgagttccaacaaatttatggtttggaaactgttgtaattccaacaaatcgtccaatgattcgtgatgatcgcactgatgtgatgtttgaaaatgaacaatataaatttaatgcgattattgaagacattaaagattgtgtagaacgccagcaaccagtattagtggggacgatttcagtcgaaaaatcagaagaattatctaaagcgttagataaagcaggtataaaacacaatgtgttgaatgcgaaattccaccaacaagaagcggaaatcgtggcagaagcaggatttcctagtgcagtgactatcgcaacgaatatggcgggtcgaggtaccgatattattcttggcggtaactggaaagcgcaggctgccaaattagaaaatccaactcaagaacaaattgaagcccttaaagcagagtgggagaaaaaccacgaattg

SEQ ID NO: 4284 - protein, 545 aa, Haemophilus influenzae
  Name: NTH2395
MSILTRIFGSRNERVLRKLKKQVVKINKMEPAFEALSDDELKAKTQEFRDRLSGGETLQQILPEAFATVREASKRVLGMRHFDVQLIGGMVLTNRCIAEMRTGEGKTLTATLPCYLIALEGKGVHVVTVNDYLARRDAETNRPLFEFLGMSVGVNIPGLSPEEKRAAYAADITYATNSELGFDYLRDNLAHSKEERFQRTLGYALVDEVDSILIDEARTPLIISGQAENSSELYIAVNKLIPSLIKQEKEDTEEYQGEGDFTLDLKSKQAHLTERGQEKVEDWLITQGLMPEGDSLYSPSRIVLLHHVMAALRAHTLFEKDVDYIVKDGEIVIVDEHTGRTMAGRRWSDGLHQAIEAKEGVDVKSENQTVASISYQNYFRLYERLAGMTGTADTEAFEFQQIYGLETVVIPTNRPMIRDDRTDVMFENEQYKFNAIIEDIKDCVERQQPVLVGTISVEKSEELSKALDKAGIKHNVLNAKFHQQEAEIVAEAGFPSAVTIATNMAGRGTDIILGGNWKAQAAKLENPTQEQIEALKAEWEKNHEL

SEQ ID NO: 4285 - DNA, 1089 bp, Haemophilus influenzae
  Name: NTH2396
gtgggagaaaaaccacgaattgtaatgaaagcgggtgggttgcatattatcggtacagagcgtcacgaatctcgtcgtattgataaccagttgcgcggtcgttctgggcgtcaaggtgaccccggttcttctcgtttctatctttctttagaagatggtttaatgcgcatttatttgaatgagggtaagctcaatttaatgcgtaaagcgttcacggtagcaggcgaggcaatggagtcgaaaatgttggcgaaagtgattgcatctgctcaagcaaaagttgaggcgttccattttgatggccgtaaaaacctacttgaatatgatgatgtggcaaatgaccaacgtcacgcgatttatgagcaacgcaatcatttgcttgataatgatgatatttctgaaactatcaacgctattcgccacgatgtgtttaatggtgtgattgatcaatatattccaccacaatctttggaagaacaatgggatattaaagggcttgaagaacgtttatctcaagaatttggtatggaattaccgatttctaattggttagaagaagataataatcttcacgaagaaagtttgtgcgaacgcattgtggaaattgcagaaaaggaatacaaagaaaaagaggctttggttggcgaagacgctatgcgccattttgaaaaaggtgttatgttgcaaaccttagatgaactttggaaagaacacttagcttcgatggattatttacgccaaggtattcatttacgcggctatgcgcaaaaagatccaaaacaagagtataaaaaagaatctttccgtatgtttacggaaatgttggattctttaaaacatcaggttatcacgactttaacccgtgtacgtgtgcgtactcaagaagaaatggaagaagctgaacgtgctcgtcaagaaatggcagcacgtatcaatcaaaataatttacctgtggatgaaaatagtcagacaactcaaaattcagagactgaagattattcagatcgtcgcattggtcgcaacgagccttgtccttgtgggtcgggtaaaaaatataagcattgtcacggcagtcgtgtggcacgccag

SEQ ID NO: 4286 - protein, 363 aa, Haemophilus influenzae
  Name: NTH2396
VGEKPRIVMKAGGLHIIGTERHESRRIDNQLRGRSGRQGDPGSSRFYLSLEDGLMRIYLNEGKLNLMRKAFTVAGEAMESKMLAKVIASAQAKVEAFHFDGRKNLLEYDDVANDQRHAIYEQRNHLLDNDDISETINAIRHDVFNGVIDQYIPPQSLEEQWDIKGLEERLSQEFGMELPISNWLEEDNNLHEESLCERIVEIAEKEYKEKEALVGEDAMRHFEKGVMLQTLDELWKEHLASMDYLRQGIHLRGYAQKDPKQEYKKESFRMFTEMLDSLKHQVITTLTRVRVRTQEEMEEAERARQEMAARINQNNLPVDENSQTTQNSETEDYSDRRIGRNEPCPCGSGKKYKHCHGSRVARQ

SEQ ID NO: 4287 - DNA, 489 bp, Haemophilus influenzae
  Name: NTH2397
gtgtggcacgccagtaatgaacaatcaaagtgcggtgattttttaccgcacttttttcatacctctacattagatagaaaaatggataaaaaaattatacaagttgctgcggggattattcgtaatgaatttggtcagatctatttaacgcagcgtttagaaggacaggattttgcccaatctttagaatttcccggtggaaaagtagatgcgggagaaaccccagaacaggctttaaaacgtgaactggaagaggaaataggcattgttgcgttaaatgcagaactttatgaacgttttcaatttgaatatccaacaaaaatcatttcttttttcttttatctggtaaatgaatggattggcgaaccttttgggcgagaggggcaagaaggtttttgggttgagcagcgcgcattggatgcaggacagtttccccccgcaaatgcaaaattaattcatcgattactaaatgaaactcacaatttcata

SEQ ID NO: 4288 - protein, 163 aa, Haemophilus influenzae
  Name: NTH2397
VWHASNEQSKCGDFLPHFFHTSTLDRKMDKKIIQVAAGIIRNEFGQIYLTQRLEGQDFAQSLEFPGGKVDAGETPEQALKRELEEEIGIVALNAELYERFQFEYPTKIISFFFYLVNEWIGEPFGREGQEGFWVEQRALDAGQFPPANAKLIHRLLNETHNFI

SEQ ID NO: 4289 - DNA, 1854 bp, Haemophilus influenzae
  Name: NTH2398
atgtctcaacttgccaatccagaactgatgaaagtcgttattttactcgcatctagcgtaacaattgtgccgttatttaaaagactcgggttggggagtgtgctaggttatttagtggcaggttgtttgattggtccatctgtctttggcatagtgcaagatccaacagctgtggtacatttagcggaattaggtgtggtaatgtttctttttattatcgggcttgaaatgtatccagaacgcctttgggcaatgcgtaaagctatttttggcagaggtttgttacaagttggattatgtggttgcttactcactttttcgggtatttatttattaggattaacaaaagaagtatcatttatcgctggtatgggtttcacgctttcctctactgctattgtaatgcaatcactagaagaaagggggcttacttctacgtcaaaaggacaacgcgtaatttcgacattaatttttgaagatattgctattgtaccacttttggcttctgtcgcttttcttgctccccattcgaaagaagcgacaccacatactgattgggtatcaattggtatagcattaagtgctgttgtggggttaattgtgactggaaaatggctaatgaacccactatttcgtttaatttctaaagcacgtattcgtgaaatgatgacagcgggcgcattattggtcgttttaggtgctgcattagcaatggaaattggcggactttcaatggcaatgggggcgtttgttgctggtgtgatgatgtctgaatcagcgtttcgccatcagcttgaagcggatatagaaccatttcgcggcttattactcggattattttttatgggcgtaggaatgtccttagatttgcatttagtgtttaatcattggatcttgctacttggaattgtttttctttatatacttggaaaagccagtgctgtttatattattgcccgaattacccgtcttgatcatcgagaagccataggacgaatgtctttgatggcacacggtggcgaatttgcctttgttcttttttcagccgcagcaactgcggaagtaatcagtaatgaagaacaagcgacattcactgctgcagtgattatttcgatgcttttttcgcctattattgctcaaattgctcgcaaacttatacagcgtacagagcctaaacatcttgatcaacttgatgaaaatgatctagacagcatcgtggatttggaagataacgttttagttattggttttggacgttttagtcaaattgtctgccaaacattattgattcgtggaattagcgtttcagtgattgatcgcaatatcgaaaatatccgtgctgccgcaaagtttggttttaaagtttattatggcgatggcattcgattagatgttttacgagccgcaggaattgaaaaggcgaaatgtgtcgtattaggtattaacgatacacaaagaattgaacatattgtcagtcaaatgaaagaggcttatccaaatttaccgattttaacccgaacttatgacagaaaaacaacagttagtttgattaagcaggatgtagattttattgtgcgtgaaacttttgaatcagcaattacacttagtcgagcaacattgatgaaattaggtattgataaaattgaagcggaagaaattattaaggaagtacgaacattggatcaagaacggttaaatgaagaagttttacacggtttttcgaatgaaatagtaaaaaaatattggacaccaagaccatttattaaaccgcatcttgatacaaaagcattaaataaagaaacagaagaaattctaagtgagaaaattgaagaagaaatatcaaatgatcattca

SEQ ID NO: 4290 - protein, 618 aa, Haemophilus influenzae
  Name: NTH2398
MSQLANPELMKVVILLASSVTIVPLFKRLGLGSVLGYLVAGCLIGPSVFGIVQDPTAVVHLAELGVVMFLFIIGLEMYPERLWAMRKAIFGRGLLQVGLCGCLLTFSGIYLLGLTKEVSFIAGMGFTLSSTAIVMQSLEERGLTSTSKGQRVISTLIFEDIAIVPLLASVAFLAPHSKEATPHTDWVSIGIALSAVVGLIVTGKWLMNPLFRLISKARIREMMTAGALLVVLGAALAMEIGGLSMAMGAFVAGVMMSESAFRHQLEADIEPFRGLLLGLFFMGVGMSLDLHLVFNHWILLLGIVFLYILGKASAVYIIARITRLDHREAIGRMSLMAHGGEFAFVLFSAAATAEVISNEEQATFTAAVIISMLFSPIIAQIARKLIQRTEPKHLDQLDENDLDSIVDLEDNVLVIGFGRFSQIVCQTLLIRGISVSVIDRNIENIRAAAKFGFKVYYGDGIRLDVLRAAGIEKAKCVVLGINDTQRIEHIVSQMKEAYPNLPILTRTYDRKTTVSLIKQDVDFIVRETFESAITLSRATLMKLGIDKIEAEEIIKEVRTLDQERLNEEVLHGFSNEIVKKYWTPRPFIKPHLDTKALNKETEEILSEKIEEEISNDHS

SEQ ID NO: 4291 - DNA, 762 bp, Haemophilus influenzae
  Name: NTH2399
atgaataataaaattagtgtttatgataaagataatttctttgagctttatcagaaactccgtgcaaatccaattagcctcaatgaaattatcgaaaagcccaccatgctttcattgttgcctaatttaaaagggaagaaattactcgatttaggctgtggtacgggagggcatttacaactttatttagaacgaggggcggctaaagtaattggaactgatctttccgaaaaaatgctcgaacaagctgaaaaagatcttcaaaagtgcggtcaattttcagggcgtttttccttatatcacttaccaatagaaaaattagctgagttaccagaaagtcatttcgatgtgattactagctcttttgcctttcattatattgaaaattttccgacattattatcaacgatccatgacaaactctcgtctaatggcacattaattttctcacaagaacatccgataactacctgccataaagagggagaacgctgggaaaaaaatgacaaaaaacagcaagtcgcttatcgtttaaatcattaccgagaagagggcgaacgcaatagaaattggttcaaacaaccttttcaaacctatcatcgaacaacagcaacaattatcaataatttaattcatgcaaggtttcaaattgagcaaatggaagaacccatgcttgctgaccaaccgcaatggcataatgaatttaaagatttatcacaccgaccaccattgttatttatcaaagcaagaaaagtggagaaa

SEQ ID NO: 4292 - protein, 254 aa, Haemophilus influenzae
  Name: NTH2399
MNNKISVYDKDNFFELYQKLRANPISLNEIIEKPTMLSLLPNLKGKKLLDLGCGTGGHLQLYLERGAAKVIGTDLSEKMLEQAEKDLQKCGQFSGRFSLYHLPIEKLAELPESHFDVITSSFAFHYIENFPTLLSTIHDKLSSNGTLIFSQEHPITTCHKEGERWEKNDKKQQVAYRLNHYREEGERNRNWFKQPFQTYHRTTATIINNLIHARFQIEQMEEPMLADQPQWHNEFKDLSHRPPLLFIKARKVEK

SEQ ID NO: 4293 - DNA, 735 bp, Haemophilus influenzae
  n 694: n is any nucleotide
  Name: NTH2401
gtggaggctcaaccccaacaaaaggaaaatattatggcacaagtttcaatgcgcgacatgatcaacgcaggcgtacacttcggacaccaaactcgttactggaacccacaaatgaaacctttcatttttggtgctcgtaacggtgttcacatcatcaatcttgaaaaaactttacctttattcaacgaagctttagcggaattaactcgcattgctagcaacaacggtaaagtattattcgttggtacaaaacgtgcagcgtctgaagcagttcaagcagcagcattagattgtcagcaatattacgtaaaccaccgttggttaggtggtatgttgactaactggaaaaccgttcgtcaatcaattaaacgtttaaaagatttagaaacccaatctcaagacggtacttttgataaattaaccaaaaaagaagcgttaatgcgtagccgtgagatggaaaaacttgaattaagccttggcggtatcaaagatatgggcggcttaccagatgcgttattcgttatcggtgcagaccacgaacatatcgctgttaaagaagcaaacaacctaggtattcctgtatttgctatcgttgatactaactcaacaccagctggcgtagatttcgttatccctggtaacgatgatgcgactcgtgctatccaacttacgtttctgcagctgcagcagcggntaaagaaagtcgtggtaacgaagctcaagttgctgaagaat

SEQ ID NO: 4294 - protein, 245 aa, Haemophilus influenzae
  Xaa 232: Xaa is any amino acid
  Name: NTH2401
VEAQPQQKENIMAQVSMRDMINAGVHFGHQTRYWNPQMKPFIFGARNGVHIINLEKTLPLFNEALAELTRIASNNGKVLFVGTKRAASEAVQAAALDCQQYYVNHRWLGGMLTNWKTVRQSIKRLKDLETQSQDGTFDKLTKKEALMRSREMEKLELSLGGIKDMGGLPDALFVIGADHEHIAVKEANNLGIPVFAIVDTNSTPAGVDFVIPGNDDATRAIQLTFLQLQQRXKKVVVTKLKLLKN

SEQ ID NO: 4295 - DNA, 213 bp, Haemophilus influenzae
  n 208, 209, 210, 211, 212: n is any nucleotide
  Name: NTH2402
atggctaaacaaccaggttatcaagcaagaagtactaatagcggtaaaggtgaattaaaaagccgattacttttcgttttaggtgcacttatcgtttatcgaattggttcattcattccggttcctggtattgatgcgactgttctagctcaattagttgaacaacaaaaaggcacttcctgggtaccgagtcgatatcgtatacagnnnnnt

SEQ ID NO: 4296 - protein, 71 aa, Haemophilus influenzae
  Xaa 70, 71: Xaa is any amino acid
  Name: NTH2402
MAKQPGYQARSTNSGKGELKSRLLFVLGALIVYRIGSFIPVPGIDATVLAQLVEQQKGTSWVPSRYRIQXX

SEQ ID NO: 4297 - DNA, 432 bp, Haemophilus influenzae
  Name: NTH2403
atgcgtttaaatactctatctccggctgaaggtgcaaagcatagtgctaaacgcctcggtcgtggtattggttcaggtttaggcaagactggtggccgcggtcataaaggtcaaaaatctcgtactggtagcggtgttcgtcgcggtttcgaaggtggtcaaatgccgttataccgtcgtttaccaaaatttggttttacttcaatgaaatctgcagtgactgcagaagttcgtttaaatgaattaaccaaagttgaaggtaatgtagtaactttagaaacattaaaagcagcaaatatcttaactaaagatatccaattcgctaaagtaattttagctggagaagtgaaatctgcagtaacggtacgcggtttacgtgtaactaaaggtgcaaaagcagcaattgaagctgctggcggttcaattgaggaa

SEQ ID NO: 4298 - protein, 144 aa, Haemophilus influenzae
  Name: NTH2403
MRLNTLSPAEGAKHSAKRLGRGIGSGLGKTGGRGHKGQKSRTGSGVRRGFEGGQMPLYRRLPKFGFTSMKSAVTAEVRLNELTKVEGNVVTLETLKAANILTKDIQFAKVILAGEVKSAVTVRGLRVTKGAKAAIEAAGGSIEE

SEQ ID NO: 4299 - DNA, 177 bp, Haemophilus influenzae
  n 10, 24, 53, 54: n is any nucleotide
  Name: NTH2404
atggctaaanctattaaagtaacncaagttcgtagctcaattgctcgttacgnnaagcataaagctaccttgcgtggtcttggtcttcgccatatgcaccacactgttgagttaattgatacgcctgcagtacgtggtatgattaaccaagtttcatacatggttaaagtggaggag

SEQ ID NO: 4300 - protein, 59 aa, Haemophilus influenzae
  Xaa 4, 18: Xaa is any amino acid
  Name: NTH2404
MAKXIKVTQVRSSIARYXKHKATLRGLGLRHMHHTVELIDTPAVRGMINQVSYMVKVEE

SEQ ID NO: 4301 - DNA, 801 bp, Haemophilus influenzae
  Name: NTH2405
ttgattaccctttctcaatctggcgaaacagccgatactttagctgcacttcgtttagcgaaagaaaagggctacatggcagcattaacaatttgtaatgttgctggctcttcgctcgtacgcgaatcatatcttgcatttatgactcgtgctggtgttgaagttggggtggcatcgacaaaagcatttacgacacagctcgctgcattattaatgctggtaacggcacttggtaaagttaaaggtcatatttctgtagaaaaagaacgtgaaattattaaagcaatgcaatctttacctgctgaaattgaaaaagcgttagcctttgatagagaaattgaagctttagcagaggattttgctgaaaaacatcatgcgcttttcttaggccgtggtgcgttttatccaattgcggtagaggcttctttgaaattgaaagagatttcttatattcacgctgaggcctatgcggcaggagaattgaaacacgggccattagcgttaattgatgctgatatgccagtgattgtcgttgcaccaaataatgaattattagaaaaagtaaaatcgaacattgaggaagtgcgagctcgtggtggtcaattatacgtatttgccgataaagaagcaggatttacgccaagtgaaggaatgaaaatcatcacgatgccaaaagtcaatgatattgttgcaccgattttttataccattccaatgcaattactttcttattatgtggctttaattaaaggcactgatgtagatcaacctcgtaacttagcaaaatcagttaccgttgaa

SEQ ID NO: 4302 - protein, 267 aa, Haemophilus influenzae
  Name: NTH2405
LITLSQSGETADTLAALRLAKEKGYMAALTICNVAGSSLVRESYLAFMTRAGVEVGVASTKAFTTQLAALLMLVTALGKVKGHISVEKEREIIKAMQSLPAEIEKALAFDREIEALAEDFAEKHHALFLGRGAFYPIAVEASLKLKEISYIHAEAYAAGELKHGPLALIDADMPVIVVAPNNELLEKVKSNIEEVRARGGQLYVFADKEAGFTPSEGMKIITMPKVNDIVAPIFYTIPMQLLSYYVALIKGTDVDQPRNLAKSVTVE

SEQ ID NO: 4303 - DNA, 531 bp, Haemophilus influenzae
  Name: NTH2406
atgctcgcgctattaaaacaattttccgaaaaacgttttgtgtggtttttattggctttttcaagtttagccttagaatccaccgcactttacttccaatatggaatgggcttacaaccttgtgtgctctgtgtttatgaacgtttagcaatgattggcttatttgtagcgggcattattgcattacttcaacctcttgctttcatacttcgattaatcgccttggctttaggtttattcagcagtattaagggcttattgatttcatttcgtcatcttgatttgcaaatgaatccagctccttggaaacaatgtgagtttattccaaattttcccgagactttaccatttcatcaatggtttccatttatatttaacccaactggctcttgtaatgaaagccaatggtcattatttggtttaacgatggtgcaatggctagtggttattttttcactatatgtggttattctcacattattgttaatcgcacaagtgattaaaacacggaaacaaagaagattatttaac

SEQ ID NO: 4304 - protein, 177 aa, Haemophilus influenzae
  Name: NTH2406
MLALLKQFSEKRFVWFLLAFSSLALESTALYFQYGMGLQPCVLCVYERLAMIGLFVAGIIALLQPLAFILRLIALALGLFSSIKGLLISFRHLDLQMNPAPWKQCEFIPNFPETLPFHQWFPFIFNPTGSCNESQWSLFGLTMVQWLVVIFSLYVVILTLLLIAQVIKTRKQRRLFN

SEQ ID NO: 4305 - DNA, 714 bp, Haemophilus influenzae
  Name: NTH2407
gtgtggaaagtcttatcagacttagatcgcactaattcagaaaaaatgtctaaacaagataaaattaaattaggtatgcaagcgttaatcgcaatttggttaattcttggattagcattccatcttgccgcagtcggtttaattggtttaagtatcatcatttttgctacgtctttcactggtgtgacggatgaacatactatcggtaaagcctttcaggaatctttaccctttactgcattgctcgttgtattcttttctgttgttgcagtaattattgatcaaaaacttttttcaccaattattcacttcgttctttctgcggaagaaaatacacaacttgctttattctatttgtttaatggcttgctttcttctatttctgataatgtatttgttgcaacggtttatattaatgaagctaaagctgcactgacaaatggagtaattgcaccgcatcaatttgaattgctttctgttgccattaatacaggtacaaacttaccatcagttgcaacaccaaatgggcaagctgctttcttattcttattgacttcatcaatttcgccattaattcgcctttcttatggcagaatggtttatatggctttaccttacacgattgtactttcaatcattggtttactggctattgaatttattttaccagctgccacaatttggttagcaagtttaggtttaattttgccaatt

SEQ ID NO: 4306 - protein, 238 aa, Haemophilus influenzae
  Name: NTH2407
VWKVLSDLDRTNSEKMSKQDKIKLGMQALIAIWLILGLAFHLAAVGLIGLSIIIFATSFTGVTDEHTIGKAFQESLPFTALLVVFFSVVAVIIDQKLFSPIIHFVLSAEENTQLALFYLFNGLLSSISDNVFVATVYINEAKAALTNGVIAPHQFELLSVAINTGTNLPSVATPNGQAAFLFLLTSSISPLIRLSYGRMVYMALPYTIVLSIIGLLAIEFILPAATIWLASLGLILPI

SEQ ID NO: 4307 - DNA, 876 bp, Haemophilus influenzae
  n 807: n is any nucleotide
  Name: NTH2408
gtgataaaaataatggagttcactatgacaaacattcaggcttttatgaaaaactttcttggggcaagtccagaatggtacaaacttgccattgtggtttttcttattataaatccaattgttttcttttttattagtccttttattgcgggttggttactggttgcagaatttattttcacattggcaatggcattaaaatgctaccctcttcaaccaggtggtctattagcaattgaagctattattattggaatgacaaatgccaaacacgtcaaagcagaaattatggcaaactttgaagtgatcttgctactgatatttatggtggcaggtattttctttatgaaacaattactgctttatgtatttactaaattacttgtcaaaattcgttctaaaattgcactttctattgccttttgttttagtgctgcttttttatcggcttttctcgatgctttaacggttgttgctgttatcattagtgtcgcaatgggattttatggtgtgtatcacaaagttgcatcaggcaataatttaattgatgcggttgatatttcagacgatagaaaaattattgaacaacagcacgaaatcttagaaaaattccgtgcattcttacgtagtttaatgatgcatgcgggtgtaggaactgcactcggtggtgtaatgaccgttgttggagaaccacaaaacttaattattgcagaacaagcaaaatggaactttatggaatttttcctccagtatggcacccgtgactattcctgtgtttatctgcggattactcacttgtttcttggntcgaaaaattcaaattatttggttatggcgagaaattaccagacgaagtgtggaaagtcttatcagact

SEQ ID NO: 4308 - protein, 292 aa, Haemophilus influenzae
  Name: NTH2408
VIKIMEFTMTNIQAFMKNFLGASPEWYKLAIVVFLIINPIVFFFISPFIAGWLLVAEFIFTLAMALKCYPLQPGGLLAIEAIIIGMTNAKHVKAEIMANFEVILLLIFMVAGIFFMKQLLLYVFTKLLVKIRSKIALSIAFCFSAAFLSAFLDALTVVAVIISVAMGFYGVYHKVASGNNLIDAVDISDDRKIIEQQHEILEKFRAFLRSLMMHAGVGTALGGVMTVVGEPQNLIIAEQAKWNFMEFFLQYGTRDYSCVYLRITHLFLGSKNSNYLVMARNYQTKCGKSYQT

SEQ ID NO: 4309 - DNA, 723 bp, Haemophilus influenzae
  Name: NTH2410
atgcaaaacaataacgacattttaaaagcccaaagtccagcagctttagcagaggaatatattgtaaagagtatttggcaagatgtttttccttcgggcagtaatttgccatcagaacgtgatttagccgataagattggtgtaactcgcaccaccctacgtgaagttttacaacgtttggctcgtgatggttggctaacaattcagcacggcaaacccaccaaagtaaataatatttgggatgctgcagggccgaatattattgaaaccctaattgctttggatatgcagtccgcgcccttaattattgataatatgctctctttacgtagtaaaatgtcggaatcttacatttatgaagcagtaaaaaattcccctcaaaaatcaaccgcactttttgctgaattagagcaattacaaaacacagcacaagattacacagaatttgattaccaattatttcgtcaatttactgttgttgccaacaaacccttttatcgtttaattttcaatagtttaaaaggtgtttatcagcgaatagggttgttattttttaaagaaaaaaaacaccgtgaattaacaaagcaattttatttagaaatgcaacaaatttgtcttgagggaaatgcagatgcagtagtggattgcatccgtaaacataatttacgttcttcaacctattggaaagccattttagaacgattgccacaaaatttatcagat

SEQ ID NO: 4310 - protein, 241 aa, Haemophilus influenzae
  Name: NTH2410
MQNNNDILKAQSPAALAEEYIVKSIWQDVFPSGSNLPSERDLADKIGVTRTTLREVLQRLARDGWLTIQHGKPTKVNNIWDAAGPNIIETLIALDMQSAPLIIDNMLSLRSKMSESYIYEAVKNSPQKSTALFAELEQLQNTAQDYTEFDYQLFRQFTVVANKPFYRLIFNSLKGVYQRIGLLFFKEKKHRELTKQFYLEMQQICLEGNADAVVDCIRKHNLRSSTYWKAILERLPQNLSD

SEQ ID NO: 4311 - DNA, 1365 bp, Haemophilus influenzae
  Name: NTH2411
atgttaatcaataaaaccaaacgagctgaacaaaatttaaataatttgccattccttgctttgcaagctgagcaaattgaatttttgggtagctcggctgaatttaaaactcaaattattgaattaatcagaaacgcaaaaaaacgtatttatgtcaccgcactttattggcaaaaagacgaagcgggacaggaaattctcgatgaaatttatcgcgtgaagcaagaaaatccacacttggatgtaaaaattctcatagattggcatcgtgcacaacgcaatttattaggggcggaaaaatctgccactaatgcagactggtattgcgagcaacgccaaacttatcagttacctgatgatccgaatatgttctttggcgtgccaattaatacgcgagaagtttttggtgtattgcatgtcaaaggctttgtatttgatgatacggtgctttatagcggtgcaagtattaataatgtctatcttcatcaatttgaaaaatatcgttacgaccgctatcaaaaaatcactcatgccgaattagctgattcaatggtaaatttcatcaatgattacttgttagatttcagtgcagtttatccacttgatgtgaccaaccgccctcgtactaaagagatccgcggtaatattcgagcttatcgtaaagaccttgctcaaaatggagaatattcattaaaaagtgcggtgaaattaccgaatgttttaagcgtatcgccactgtttggcttaggcgcatcgggcaacgaattaaatcaagtaattgaagatttattcttacaagtacaagaaaaattggtgatttgtacgccatattttaatttcccacgcacattgcaacataaaatagcaacattattggaaagcggtaaacaagtagaaattattgttggcgataaagtcgcaaacgatttttacattccaccagaacaaccattcaaaatggcgggggcattaccttatctttatgaaagtaatcttcgccgtttctgtgaaaaatttgagactcaaattgaaaatggtcagcttgtggtgcgtttatggcgtgatggcgataatacctaccacttaaaaggtgtgtgggtagatgaccgttatattttattgacgggcaataatcttaaccctcgagcatggcgtttggatgcagaaaatggcttattaatttacgatccacaacaacagcttttagcccaagtggaaaaagagcaaaaccaaattcgccaacatacaaaagtattaaaacattactctgaattagaagaattgaatcaatacccagaaccagtgcaaaaacttttgaaaaaatttgcacgaattaaagcagataaattggtgaaaatgattttg

SEQ ID NO: 4312 - protein, 455 aa, Haemophilus influenzae
  Name: NTH2411
MLINKTKRAEQNLNNLPFLALQAEQIEFLGSSAEFKTQIIELIRNAKKRIYVTALYWQKDEAGQEILDEIYRVKQENPHLDVKILIDWHRAQRNLLGAEKSATNADWYCEQRQTYQLPDDPNMFFGVPINTREVFGVLHVKGFVFDDTVLYSGASINNVYLHQFEKYRYDRYQKITHAELADSMVNFINDYLLDFSAVYPLDVTNRPRTKEIRGNIRAYRKDLAQNGEYSLKSAVKLPNVLSVSPLFGLGASGNELNQVIEDLFLQVQEKLVICTPYFNFPRTLQHKIATLLESGKQVEIIVGDKVANDFYIPPEQPFKMAGALPYLYESNLRRFCEKFETQIENGQLVVRLWRDGDNTYHLKGVWVDDRYILLTGNNLNPRAWRLDAENGLLIYDPQQQLLAQVEKEQNQIRQHTKVLKHYSELEELNQYPEPVQKLLKKFARIKADKLVKMIL

SEQ ID NO: 4313 - DNA, 603 bp, Haemophilus influenzae
  Name: NTH2412
atgaacgacaaacgcaaaccgtcttttcaatccgcaggcaaaacctttcaagaacgctcagtaggtgaaaaatacagagaaaaaccaagccaaaatcgaccgcactttaatgataaatttaatggaaatagaaacgaaaaatctcgttttcctcgtgataaacaagaagtgaaagaaactagaattaagcaactttctttatctcgcgcaccatcaaataaaaatacagaacaacctaaggttcaagtgacaataaaaagtacgggtacggtttataaaacgaaagaaaagaaaactggtgcgctttctcctcgtgcgcctgaaaaaattaagaaaaaccgtgcggaagaaatgaaggtttacggtgaaaatgcctgtttagctttatttgcagagcgtcctgaaagtattgttcgattgtgggcaaccgtgcaaatgtcacacaaaattggcgaggtattgagttatttagccgaaaacaagaaggcttatcacgttgtagatagtgaagaattagcccgagtgagcggaacagaacatcacggtggcatttgcttattggtgaagaaaccgcgtgctttcacgttgcaagggtattttaga

SEQ ID NO: 4314 - protein, 201 aa, Haemophilus influenzae
  Name: NTH2412
MNDKRKPSFQSAGKTFQERSVGEKYREKPSQNRPHFNDKFNGNRNEKSRFPRDKQEVKETRIKQLSLSRAPSNKNTEQPKVQVTIKSTGTVYKTKEKKTGALSPRAPEKIKKNRAEEMKVYGENACLALFAERPESIVRLWATVQMSHKIGEVLSYLAENKKAYHVVDSEELARVSGTEHHGGICLLVKKPRAFTLQGYFR

SEQ ID NO: 4315 - DNA, 696 bp, Haemophilus influenzae
  Name: NTH2413
atgagcggatttacctttaaacaattccatatcaatcaagattcttgtgccatgaaagtcggcactgatggcattttgttaggtgcttgggctgatgtaaagcattgtaaaaatattttagatatgggcagtggcacaggattattgactttaatgttagcacaacgaactgaagaaaactgtcaaattcaagcggttgagttggatcccattgcagcaaaacaagcacaagaaaacatcaataattcagtgtggaaaaatcgcattcaacttactcaagcggatatacaacattttttacaaaccactgaacaaacctttgatttaattgtggcaaatccaccttattttgaacaaggtatcgcttgtaaaaatgaagaacgagaattggctcgttataccaagcaaagccacttaaattggttagaatgggctgcaacacgcttgtcggaaaatgggaaaataagttttgttttgccttatgatgcaggcaaaacgctcacaaaatccaccgcacttttttgcataaaacagacgaatgtcatcactaaaataggaaaaacgccccagagaatgttgcttacctttgccaaacaacccgaagttttaatgcaagatcaattggtaatttatgatgcggataatcaatacactgaagcgtttattgaattgactaaagacttttatttgaaattt

SEQ ID NO: 4316 - protein, 232 aa, Haemophilus influenzae
  Name: NTH2413
MSGFTFKQFHINQDSCAMKVGTDGILLGAWADVKHCKNILDMGSGTGLLTLMLAQRTEENCQIQAVELDPIAAKQAQENINNSVWKNRIQLTQADIQHFLQTTEQTFDLIVANPPYFEQGIACKNEERELARYTKQSHLNWLEWAATRLSENGKISFVLPYDAGKTLTKSTALFCIKQTNVITKIGKTPQRMLLTFAKQPEVLMQDQLVIYDADNQYTEAFIELTKDFYLKF

SEQ ID NO: 4317 - DNA, 141 bp, Haemophilus influenzae
  Name: NTH2414
gtgcctttaaaagttctggagaaagatcgaattgttcaaattgggataaattcattattgtgcggttctttgttaaaatcgtcgaggattatacctgaaagtgcggtcaatttacgaaaaatttatgagcggatttacctt

SEQ ID NO: 4318 - protein, 47 aa, Haemophilus influenzae
  Name: NTH2414
VPLKVLEKDRIVQIGINSLLCGSLLKSSRIIPESAVNLRKIYERIYL

SEQ ID NO: 4319 - DNA, 366 bp, Haemophilus influenzae
  Name: NTH2415
atggaagccattcctgccgcaatggaagagcgtgatgtattaggctctgcaccaacgggaacagggaaaaccgctgcttttttattacctgcgctacaacatttattggattatccacgccgtaaaccagggccaccgtgtattttgatattaacaccaacccgagaactggcaatgcaagtggctgaacaagcggaagaattagcgcagttcacccatttaaatattgcgacaattacaggtggtgtggcgtatcaaaatatggtgatgtattcattaccaatcaagatttggtggtggctacgccaggtcgtttattgcaatacattaaggaagaaaattttgattgccgttccgttgaaatgc

SEQ ID NO: 4320 - protein, 122 aa, Haemophilus influenzae
  Name: NTH2415
MEAIPAAMEERDVLGSAPTGTGKTAAFLLPALQHLLDYPRRKPGPPCILILTPTRELAMQVAEQAEELAQFTHLNIATITGGVAYQNMVMYSLPIKIWWWLRQVVYCNTLRKKILIAVPLKC

SEQ ID NO: 4321 - DNA, 861 bp, Haemophilus influenzae
  Name: NTH2416
atgctgatttttgatgaagccgatagaatgttacaaatgggatttgggcaagatgcggaaaaaattgcagctgaaacccgttggcggaaacaaactttgttgttttctgcaaccttagaaggagagttattggtcgattttgcggagcgtttgttgaatgatcctgtgaaagtagatgcggaaccaagtcgccgtgaaagaaaaaaaatcaaccaatggtattatcacgcagacagcaatgaacataaaatcaaattgctcgcgcgttttattgaaactgaaaaagtaacccgtggaattgtatttgttcgccgtcgtgaagatgcgcgtgaagtttctgaaacattgcgtaaacgaggcattcgttccgcatatttagaaggcgaaatggcacaaactcaacgtaacaatgccattgataaattgaaatcaggtattgtgacggtattggttgcaacagatgtggctgcgcgtggtattgatattgatgatgtaagccacgtgatgaattttgatttgccctatagtgcggatacttatttgcatcgaattggacgtaccgcgcgagctggcaaaaaaggcacggcagtctcttttgtcgaagcgcatgattacaagttgctaggtaaaatcaaacgttatactgaggaaattttaaaggcgcgcattttagcaggtttagaacctcgcactaagccaccaaaagatggcgaagtgaaatctgtcagcaaaaaacaaaaggcacgcattaaaaaaaaacgtgaagaaaagaaaaaaacagaggcaaagaaaaaagtaaaattgcgtcataaggatacgaaaaatatcggcaaacgacgcaagccaagtaacagtaatgtt

SEQ ID NO: 4322 - protein, 287 aa, Haemophilus influenzae
  Name: NTH2416
MLIFDEADRMLQMGFGQDAEKIAAETRWRKQTLLFSATLEGELLVDFAERLLNDPVKVDAEPSRRERKKINQWYYHADSNEHKIKLLARFIETEKVTRGIVFVRRREDAREVSETLRKRGIRSAYLEGEMAQTQRNNAIDKLKSGIVTVLVATDVAARGIDIDDVSHVMNFDLPYSADTYLHRIGRTARAGKKGTAVSFVEAHDYKLLGKIKRYTEEILKARILAGLEPRTKPPKDGEVKSVSKKQKARIKKKREEKKKTEAKKKVKLRHKDTKNIGKRRKPSNSNV

SEQ ID NO: 4323 - DNA, 693 bp, Haemophilus influenzae
  Name: NTH2417
atgaaaaatgtagcaccaaccttaggcgatggcacagtaacagataaagtcttcctttataccgaatcacaaaagcctgacgaacaaatgacagcgtttgaagatgaacacggcacctactttatgaattcaaaagatctacgtgccgtacaacatgtggaaaaactgaccgcacttggtgtgcattctttaaaaatcgaaggccgtactaaatcattttattattgtgcaagaacggctcaagtttaccgcaaagccattgatgatgcagccgcaggcaaaccatttgatgaaagcttaatggatacgttagaatcccttgcgcatcgtggttataccgaaggtttcttacgtcgccatacgcacgatgaataccaaaactacgaatatggctattctatttctgatcgtcagcaatttgtcggtgaatttacgggcaaacgtaacgaacaaggtatggctgaagtagcagtaaaaaacaaattcttacttggcgacaatgtagaaatgatgacaccacaaggcaatattaatttcaaaattgaaaaaatgctaaatcgtaaaaatgaaacggttgatgcagcactaggtgatgggcattttgtattcttaaatgtaccacaagatattaacttaaattacgctttattaatgcgtaatttagttaataccaatacaagaaacccacattgc

SEQ ID NO: 4324 - protein, 231 aa, Haemophilus influenzae
  Name: NTH2417
MKNVAPTLGDGTVTDKVFLYTESQKPDEQMTAFEDEHGTYFMNSKDLRAVQHVEKLTALGVHSLKIEGRTKSFYYCARTAQVYRKAIDDAAAGKPFDESLMDTLESLAHRGYTEGFLRRHTHDEYQNYEYGYSISDRQQFVGEFTGKRNEQGMAEVAVKNKFLLGDNVEMMTPQGNINFKIEKMLNRKNETVDAALGDGHFVFLNVPQDINLNYALLMRNLVNTNTRNPHC

SEQ ID NO: 4325 - DNA, 609 bp, Haemophilus influenzae
  Name: NTH2418
atgacaaacacaacaatgcaaccaaaccgccttcgtattgctttgcaaaaaaaagggcgtttaagccaggattgtgccatattacttaaacaatgtggcgtgaaaattaattggaatgaacaacgtttaatcgcttatgcggaaaatttgccgattgaaattcttcgcgtacgtgatgatgatattcctggattgatttttgatggcgtagtggatcttgggattattggcgaaaatgtgttagaagaggaagagcttggtcgccgtgcagcaaatgaaacagttacatacaaaaaacttcgccaacttgattttggtgattgtcgtctatcacttgcggttgatcgcgattgtcattatgagaatgtgaaagatcttgctaataggcgtattgcaacttcttacccgcatttgctcaaacgttatatgaatgagaatggggtgtcgtttaaaagttgtttattaaatggttcagtagaagtcgcacctagtgcgggtattgcttatgcgatttgcgatttagtatcatcaggggcaacgcttgaagcaaatggcttaaaagaagtggacgtgatttatcgttctaaagcttgtttaattcaggcgtgc

SEQ ID NO: 4326 - protein, 203 aa, Haemophilus influenzae
  Name: NTH2418
MTNTTMQPNRLRIALQKKGRLSQDCAILLKQCGVKINWNEQRLIAYAENLPIEILRVRDDDIPGLIFDGVVDLGIIGENVLEEEELGRRAANETVTYKKLRQLDFGDCRLSLAVDRDCHYENVKDLANRRIATSYPHLLKRYMNENGVSFKSCLLNGSVEVAPSAGIAYAICDLVSSGATLEANGLKEVDVIYRSKACLIQAC

SEQ ID NO: 4327 - DNA, 861 bp, Haemophilus influenzae
  Name: NTH2419
atgatttacagtatgaccgcttttgcacgccttgaagtgaaaaaagattggggcgatgcggtatgggaaattcgttccgtcaatcaacgttatttagaaaactttttccgtttacccgagcaatttcgcggattagaaaacacgttgcgtgagaaacttcgtcaaagtcttactcgcgggaaaattgaatgttctttgcgtattgaaacaaaaaaacaaacaaatgctgaattgaatttaaataaagaacttgcgaatcaagtcattcaatctttgcaatggattaaaactcaagctggagaaggtgaaattaatttgacagacgtgttgcgttatccgggggtggtggaagcgcaagagcaagatttagatgcgattagtcaagatttattgacagcctttgatgatttactgaccgattttattgcaatgcgtggtcgtgaaggggaaaaactgaacgatattattcaacaacgcttagatgccattgcagtagaagcggataaagtgcgatcacaaatgccagcagttttacaatggcagcgtgaacggttattgcaacgttttgaagatgctcaacttaatcttgatccacagcgtgtggaacaagaaatgattttactcgctcaacgtgttgatgtggcggaagaactcgatcgtttacaaatgcacgtgaaagaaaccacgaatattttgaaaaaaggcggtgcagttggtcgtaaattagattttatgatgcaagaattgaatcgtgaatccaatacccttgcgtctaaatccattaatgcggatatcacggcttctgcggtggaattaaaagtgcttatcgaacaaatgcgtgagcaaattcagaatttagaa

SEQ ID NO: 4328 - protein, 287 aa, Haemophilus influenzae
  Name: NTH2419
MIYSMTAFARLEVKKDWGDAVWEIRSVNQRYLENFFRLPEQFRGLENTLREKLRQSLTRGKIECSLRIETKKQTNAELNLNKELANQVIQSLQWIKTQAGEGEINLTDVLRYPGVVEAQEQDLDAISQDLLTAFDDLLTDFIAMRGREGEKLNDIIQQRLDAIAVEADKVRSQMPAVLQWQRERLLQRFEDAQLNLDPQRVEQEMILLAQRVDVAEELDRLQMHVKETTNILKKGGAVGRKLDFMMQELNRESNTLASKSINADITASAVELKVLIEQMREQIQNLE

SEQ ID NO: 4329 - DNA, 840 bp, Haemophilus influenzae
  Name: NTH2420
atgtctcaatttatttctcttactcaatatcaactgattgaagtacagggtgcggatgtagaaaaatatttgcaagggcaattaacttctgatgttgtgcgattagcgagtggcgcaacgacgcttacagctcactgcgacccaaaaggtaaaatgaatgcaatttaccgtttgtttaaagtaagtagtgaacaagtctttttgctcgttaagaaagatattttgccaagcgctctggatgctttgaaaaaatatgcggtattttccaaagttagttttgatttacgtgattggcaaatcatcggcgtaataggtgaaaaatgtggaaaaattacaccgcacttttcattggaaattgatggacagcgttcaattttattaaatgaaactgaattacccgtgaattttaatggcgatgaaaaaatttgggaagtagccgatattcaagcaggattgccaaatttaagtccgcaaacacaaaatgaatttatcccacaagcactaaatttacaggccgttgagcaagcaatttcttttaccaaaggctgttatattgggcaagaaaccgtggcacgtgcgaaatatcgtggggcaaacaaacgtgcaatgtttatttttaaagcgcaaactcagcaggaagtggaaattggcagtgaaatcgaaatgcagcttgaagccaattggcgtaagactggcacgattacaagtgcggtcaatttagacggtattttatggttgcaagttgtgatgaataatgacatggattcagagcaacaatttagattgccgagtaatgaaatactgttagagcgagtgcagttaccttattcgattactgaa

SEQ ID NO: 4330 - protein, 280 aa, Haemophilus influenzae
  Name: NTH2420
MSQFISLTQYQLIEVQGADVEKYLQGQLTSDVVRLASGATTLTAHCDPKGKMNAIYRLFKVSSEQVFLLVKKDILPSALDALKKYAVFSKVSFDLRDWQIIGVIGEKCGKITPHFSLEIDGQRSILLNETELPVNFNGDEKIWEVADIQAGLPNLSPQTQNEFIPQALNLQAVEQAISFTKGCYIGQETVARAKYRGANKRAMFIFKAQTQQEVEIGSEIEMQLEANWRKTGTITSAVNLDGILWLQVVMNNDMDSEQQFRLPSNEILLERVQLPYSITE

SEQ ID NO: 4331 - DNA, 1230 bp, Haemophilus influenzae
  Name: NTH2421
atgacaaacaaagtttcactcgacaaatcaaaaattaaatttgtattgtttgaaggtgtgcatcaaagcgcacttgatacgctccacgcggcaggctatagcaatattgattactataaaaaagcactggatggtgatgaattaaaagaagccattaaagatgcacattttatcggattacgttctcgcacccatttaaccgcagaaatgattgaagccgcacccaaattaatcgcagtaggctgtttctgtattggcaccaaccaagtggatttaaatgcagcaaaagcacgtggtattcctgtatttaatgcgccattctcaaacactcgttccgtcgcagaacttgtattaggcgagattttattacttatgcgtaatgtgccacaggctaatgccgaagtacatcgtggtgtttggaataaatccgcgactggctcttatgaagtgcggggtaaaaaattaggcattattggttacggccacattggttcacaattaagtattattgccgaatcattaggcatggatgtgtatttctatgatattgaaaataaacttccgctcggtaatgcaaaacaggttcgtagccttgaagaattactcagttcttgcgatgtggtttcattacatgtgccagaactgccctccaccaaaaacttaatgaacgcaacgcgtatcgcacaattaaaacaaggggcaattttgatcaatgctgcgcgtggcactgtggtagatattgatgctctcgctcaagccttaaaagacgggaaacttcagggtgccgcaattgatgtattccccgttgaacctgcttcaattaatgaagaatttgtctcgccattacgcgaatttgataatgtgattttaacgccacatattggcggctcaacagcggaagcacaagaaaatatcggttttgaagtggcaggcaaatttgttaaatattcagataatggctcaaccctttcttcggtaaacttcccagaagtctctttaccagagcacgagggaacaaaacgcttattgcatattcatgaaaatcgccctggtatattgaacaaactgaaccaaattttcgtcgaagccaacctcaatattgccgcacaatatttacaaactgacccgaaaattggttacgttgtcgttgatgtagaaacgaatgatgcatcaccattactgacaaaattgaaggaaattgatggcacaattcgtgctagagtactttac

SEQ ID NO: 4332 - protein, 410 aa, Haemophilus influenzae
  Name: NTH2421
MTNKVSLDKSKIKFVLFEGVHQSALDTLHAAGYSNIDYYKKALDGDELKEAIKDAHFIGLRSRTHLTAEMIEAAPKLIAVGCFCIGTNQVDLNAAKARGIPVFNAPFSNTRSVAELVLGEILLLMRNVPQANAEVHRGVWNKSATGSYEVRGKKLGIIGYGHIGSQLSIIAESLGMDVYFYDIENKLPLGNAKQVRSLEELLSSCDVVSLHVPELPSTKNLMNATRIAQLKQGAILINAARGTVVDIDALAQALKDGKLQGAAIDVFPVEPASINEEFVSPLREFDNVILTPHIGGSTAEAQENIGFEVAGKFVKYSDNGSTLSSVNFPEVSLPEHEGTKRLLHIHENRPGILNKLNQIFVEANLNIAAQYLQTDPKIGYVVVDVETNDASPLLTKLKEIDGTIRARVLY

SEQ ID NO: 4333 - DNA, 657 bp, Haemophilus influenzae
  Name: NTH2422
atgaatcaattagaaatgaaaaaactcgccgcacaagctgcattagaatatgtaacagctgacacaattgttggcgtgggcagtggctccacagtgaactgctttattgaagctttgggtacaatcaaaaataaaattcaaggcgtagttgcggcttcaaaagcatcagaagaattattacgtaaacaagggatcgaagtatttaatgcaaatgatgtctctagcttagatatttatgtggatggtgcagatgaaatcaatccacaaaaaatgatgattaaaggcggcggtgcggcacttactcgtgaaaaaatcgttgcggcattagcgaaaaaatttatttgtattgtagattctagtaaacaagtagatgtgttaggttcgactttcccattgccagttgaagttattccaatggctcgttcacaagtgggcagaaaattagtcgcacttggtggcgcacctgagtatcgtgaaggcgtggttacagataatggcaatgtgattttagatgtacacaacttcagtattttaaatccagttgaaatggaaaaagaattaaacaatgttgcaggtgtcgtcactaatgggatattcgcattgcgtggcgcagatgttgtaatcgtcggcacgcctgaaggtgccaaaattattgac

SEQ ID NO: 4334 - protein, 219 aa, Haemophilus influenzae
  Name: NTH2422
MNQLEMKKLAAQAALEYVTADTIVGVGSGSTVNCFIEALGTIKNKIQGVVAASKASEELLRKQGIEVFNANDVSSLDIYVDGADEINPQKMMIKGGGAALTREKIVAALAKKFICIVDSSKQVDVLGSTFPLPVEVIPMARSQVGRKLVALGGAPEYREGVVTDNGNVILDVHNFSILNPVEMEKELNNVAGVVTNGIFALRGADVVIVGTPEGAKIID

SEQ ID NO: 4335 - DNA, 1149 bp, Haemophilus influenzae
  Name: NTH2423
atgctaaaacttcccccactttccctttatatacacattccttggtgcgttcaaaaatgcccttattgtgattttaattcgcacgcacaaaaaggcgatataccagaacaagactatatttatcatcttctgcaagatttgcaggctgatttgcaacgctttaaagattctattcaacaacgaaaactccattcaatttttattggtggcggtacaccaagtttgttctcggcagaaagcattgcgtatctcttaaaagaaataaaaaaacagattgattttgaagataatattgaaatcacattagaagctaatcctggcacggtagaagctgaacgttttaaaggttatgtatccgcaggcattatgcgaatttctatgggaattcaaagtttcaatgatgataaattacaacgtcttgggcggattcataatgcagcagaggcaaaaagtgcggtcaatttagcgaaagtttctgggctaaaaagtttcaatttagatttaatgcacggtttgcctaaccaaacgttggaagaagccttagatgatcttcgtcaagcaattgagctatctcctccccatatttcttggtatcagctgactattgaaccaaatacgatgtttgcttatcgcccacctaaattaccagatgatgacgcactttgggacatttttgagcaaggtcaccaacttttaacgatggcaggctaccagcaatatgaaacgtctgcttacgcaaaagcgggttttcaatgtaaacataatttgaattattggcgatttggggattatttagccattggctgtggcgcacacgggaaattgacgtttccgactggcgagattactcgcttttctaaaaccaagcacccgaaaggttatttgcgtggcgaatatctttacgaagaaaaaaacgtgccagaaattgaccgcccttttgagttttttatgaatcgctttcgtttgttagaagcggttcccaaacaagaatttgaagattacacaggcttgtcgcaaagtgcggtgaaaaatcaaattgattttgccattcaacaaaactatattgtggaaaacgctgattcttggcaaatcactgagcacggcaagttatttctcaatgaactattggaattatttttaactgaagaa

SEQ ID NO: 4336 - protein, 383 aa, Haemophilus influenzae
  Name: NTH2423
MLKLPPLSLYIHIPWCVQKCPYCDFNSHAQKGDIPEQDYIYHLLQDLQADLQRFKDSIQQRKLHSIFIGGGTPSLFSAESIAYLLKEIKKQIDFEDNIEITLEANPGTVEAERFKGYVSAGIMRISMGIQSFNDDKLQRLGRIHNAAEAKSAVNLAKVSGLKSFNLDLMHGLPNQTLEEALDDLRQAIELSPPHISWYQLTIEPNTMFAYRPPKLPDDDALWDIFEQGHQLLTMAGYQQYETSAYAKAGFQCKHNLNYWRFGDYLAIGCGAHGKLTFPTGEITRFSKTKHPKGYLRGEYLYEEKNVPEIDRPFEFFMNRFRLLEAVPKQEFEDYTGLSQSAVKNQIDFAIQQNYIVENADSWQITEHGKLFLNELLELFLTEE

SEQ ID NO: 4337 - DNA, 1974 bp, Haemophilus influenzae
  Name: NTH2424
gtgcctacagatattctcaatgcccttcaacgtattgatgatgttgatcgcttagctgacacaatggctgcccatctccctgtaagcattcgccataaacaaaatgcgttagaactcgctaatgtgcaagaacgtttagaatatttgcttggtatgatggaatcagaggctgatattctccaagtggaaaaacggattcgcggtcgtgtaaaaaaacaaatggagaaaagccagcgtaactattatttgaacgagcaaattaaagccattcgtaaagaaatggatggtggcgaaaatgaagataccattgatgaagttgaacaactgcatcaaaaggtggaagcggcaggcatgccagctgatgtgcgtgacaaagtagaaaatgaattacaaaaacttaaaatgatgtctgccatgtcttctgaagcaacggtaatacgcagttatattgaatggatgatccaagtgccttggcatcaacgttctaaagtgaaaaaagacattgttaaagcacagcaagttttagataccgatcactatggtttagatcgcgtaaaagaacgcattcttgaatatttagcagtacaagcgcgtttaaacaaagtgaaaggcccgattctttgtttagttggccctccaggtgtaggtaaaacttctcttggtcagtctattgccaatgctactggtcgtaaatatgtacgtatggcattaggcggcgtgcgtgatgaagcagaaatccgtggtcaccgtaaaacctatattggtgcattgccaggtaaattaattcaaaagatggcaaaagtgggcgtaaaaaatccattattcttgcttgatgaaatcgacaaaatggcatccgatatgcgaggtgatcctgcatcagcgttgcttgaagtattagatcccgagcaaaacaccacgtttaacgatcactatttagaagtggattatgatctttctgatgtgatgtttgtggcaacatcaaactctatgaatattccaggcccattattggatcgtatggaagttattcgtctttctggttatacagaagatgaaaaacttaatatcgcaatgcgccatttattagcaaaacaaattgaacgtaatggtttgaagaaaggcgaacttaccgtaaaagaaagtgcaattttagatattatccgctattacacacgtgaagcgggcgtacgtggattagaacgtgaaatttcaaaaatctgccgtaaagccgtgaaaaatttattagtaaatccaaaacttaaatctatcacggtaaattcagataatctgcacgattatcttggcgtaaaacgttttgaatttggtaaagctgacacgcaaaaccgtattggcgaagtaactggtttagcttggacagaagtgggcggcgatttactcactattgaaactgcctctgttgtgggcaaaggaaaactttctttcactggttcattaggcgatgtgatgaaagaatccattcaagcggcaatgaccgttgtgcgtgctcgtgcggataaactgggtatcaatgctgaattccacgaaaaacgtgacattcacattcacgtgccagatggtgcaacaccaaaagatggcccaagtgcaggtattgcaatgtgtactgcattaatttcttgtttaacaggtaatcctgtgcgtgctgatgtggcaatgacaggagaaatcagtttacgtggtaaagtattaccaatcggtggattaaaagaaaaacttcttgcggcacatcgtggcggaattaaaaccgtattaattccaaaagagaacgttaaagatcttgaaaaaattccagaaaacgtaaaacaaaatcttgcaattcatgcggtagaaaccattgatgaagtgcttggttttgcattggaaaatccaccagagggcattgagtttgttaaagtgaaggctaaacctaaagcaccacgccgtaaagtgacgagtaaatcagaaagagcggtcaat

SEQ ID NO: 4338 - protein, 658 aa, Haemophilus influenzae
  Name: NTH2424
VPTDILNALQRIDDVDRLADTMAAHLPVSIRHKQNALELANVQERLEYLLGMMESEADILQVEKRIRGRVKKQMEKSQRNYYLNEQIKAIRKEMDGGENEDTIDEVEQLHQKVEAAGMPADVRDKVENELQKLKMMSAMSSEATVIRSYIEWMIQVPWHQRSKVKKDIVKAQQVLDTDHYGLDRVKERILEYLAVQARLNKVKGPILCLVGPPGVGKTSLGQSIANATGRKYVRMALGGVRDEAEIRGHRKTYIGALPGKLIQKMAKVGVKNPLFLLDEIDKMASDMRGDPASALLEVLDPEQNTTFNDHYLEVDYDLSDVMFVATSNSMNIPGPLLDRMEVIRLSGYTEDEKLNIAMRHLLAKQIERNGLKKGELTVKESAILDIIRYYTREAGVRGLEREISKICRKAVKNLLVNPKLKSITVNSDNLHDYLGVKRFEFGKADTQNRIGEVTGLAWTEVGGDLLTIETASVVGKGKLSFTGSLGDVMKESIQAAMTVVRARADKLGINAEFHEKRDIHIHVPDGATPKDGPSAGIAMCTALISCLTGNPVRADVAMTGEISLRGKVLPIGGLKEKLLAAHRGGIKTVLIPKENVKDLEKIPENVKQNLAIHAVETIDEVLGFALENPPEGIEFVKVKAKPKAPRRKVTSKSERAVN

SEQ ID NO: 4339 - DNA, 276 bp, Haemophilus influenzae
  Name: NTH2425
atgaaaatgatgaaaccgccccgacaaatcggcacacaaaataattttactcaaaccataaaaatgagtgaaatggagcggcacatttttaataaagccttgcatatcaaaggaaaaaatagtcaatctttatttcatttcgatcgcttgcaaagcaaactcaacattcaaaatcgcaatgaattgcaaaataacttgttaaaagattggcaaattgaatttttgggattagggcaagataaacagattagcccagatgacaacttgcaggctgcc

SEQ ID NO: 4340 - protein, 92 aa, Haemophilus influenzae
  Name: NTH2425
MKMMKPPRQIGTQNNFTQTIKMSEMERHIFNKALHIKGKNSQSLFHFDRLQSKLNIQNRNELQNNLLKDWQIEFLGLGQDKQISPDDNLQAA

SEQ ID NO: 4341 - DNA, 594 bp, Haemophilus influenzae
  Name: NTH2426
ttggaaatggttgaaaaacgtctcaatgaaagtgatatgccatttatcggtacaaaagaatttacgcctaaaaaattgtgggaaatttttggcacaccaaaacaaaaatgggtcaaaaaagatgatgtaaaaactgctattgccatgcaaaatgattggtatgtgatggataattttgctggaacgagtttggaagaagcgttaattcaatttatttcagagcgtttgggcgatttgaaatctaaatatgacgttcatttaatccgcaatgaagaagtgtttaaattgaataactttgccgatggtgaaggatttatgccggactttgttttattgctgaaagataaacaaaaatcttcttccaatggtgtgaacgactttttgcattaccaaattttcattgaacccaaaggcgaacatttagtggaaactgataggtggaaagaagcttttttaaaatcaatcacagtggaatatgggaaggataagatcctgcaaaaagatacaccgcattatcgtttgatcggtttgccgttttttactgatcatcagaaaaatggacaatttacggagttattccctttaggagagaca

SEQ ID NO: 4342 - protein, 198 aa, Haemophilus influenzae
  Name: NTH2426
LEMVEKRLNESDMPFIGTKEFTPKKLWEIFGTPKQKWVKKDDVKTAIAMQNDWYVMDNFAGTSLEEALIQFISERLGDLKSKYDVHLIRNEEVFKLNNFADGEGFMPDFVLLLKDKQKSSSNGVNDFLHYQIFIEPKGEHLVETDRWKEAFLKSITVEYGKDKILQKDTPHYRLIGLPFFTDHQKNGQFTELFPLGET

SEQ ID NO: 4343 - DNA, 339 bp, Haemophilus influenzae
  Name: NTH2427
atgtttgcagattggaaagaacacacatctcacgttaaaaaatcatttggcgcattgggtaaacaacaccctaaaatgttacaagcttaccaagcattaggctcagccgcggaagagggcaatgtgcttgacgctaaaactcgcgaacttatcgcattagcagttgctgtaacaactcgttgtgaaagctgcattagcgtacacgcagaagaagcagtaaaagctggtgcaagtgaagctgaggttgctgctgcattagcaacagctatcgcattaaatgcaggtgcagcttatacttattctttacgtgcattagaagcatatagcgtacagaaaggt

SEQ ID NO: 4344 - protein, 113 aa, Haemophilus influenzae
  Name: NTH2427
MFADWKEHTSHVKKSFGALGKQHPKMLQAYQALGSAAEEGNVLDAKTRELIALAVAVTTRCESCISVHAEEAVKAGASEAEVAAALATAIALNAGAAYTYSLRALEAYSVQKG

SEQ ID NO: 4345 - DNA, 894 bp, Haemophilus influenzae
  Name: NTH2428
atggactatttagataaacttacccatttagcacaagtgcgtggagaaattaatattcgctgtgaatttcaaggcgaatggcaaatatctcatcaagaaaaggatgcaggaaaaggcatattccatcttattgaacaaggcgagtgccagcttacactaaatgaaaaacaatttcatttaaaagagggagatattttttttcttcctcaaaatcaaccgcactttatgcattattcagtaaataaaagggcagatattcctacaaaaaaaagtcatcaaggattatttgagttacatcagattggacgaggtacaccagatttaaaaatgttctgcggtaatttttattatcaacaagatgcacttcttacggcatcaatgcctgaatatttacatataaatttatgcgacacgcccattcatcctttagtgcagctttttttgcaagaagcacaaaaaaatgatgcgggtacgaaatcggtcgttgatgcactttcaaatgtacttttaatttatattttacgtcacgccattcaacaaaatttaattgaacaaggcatcttattcgccttacaagataagcgattaaatactgcactgatagcaatattacaacaacctcaaaatgattggcatattgaacaattagctgaacttgcaacaatgtctcgtgcaaactttattcgtgtttttcaacaacaacttggtatgtcgccaggacgttttctcacgaaagtgcggttacaatctgcggcgtttttattaaaacaatcacaacaatctgtgcttgccattgctttagaagtggggtatcaatcagaagcgcatttttgtaaagtttttaaaaattactaccaactttctccaagccaatacagaaaatctgtcagccta

SEQ ID NO: 4346 - protein, 298 aa, Haemophilus influenzae
  Name: NTH2428
MDYLDKLTHLAQVRGEINIRCEFQGEWQISHQEKDAGKGIFHLIEQGECQLTLNEKQFHLKEGDIFFLPQNQPHFMHYSVNKRADIPTKKSHQGLFELHQIGRGTPDLKMFCGNFYYQQDALLTASMPEYLHINLCDTPIHPLVQLFLQEAQKNDAGTKSVVDALSNVLLIYILRHAIQQNLIEQGILFALQDKRLNTALIAILQQPQNDWHIEQLAELATMSRANFIRVFQQQLGMSPGRFLTKVRLQSAAFLLKQSQQSVLAIALEVGYQSEAHFCKVFKNYYQLSPSQYRKSVSL

SEQ ID NO: 4347 - DNA, 114 bp, Haemophilus influenzae
  Name: NTH2429
atgtttaacaaaattttttcgtggtttgaaaatcgtttgaatccctatccagaaagcaatccaacaacacctaaaaaggtttgttccgttttatttggtctagtattacaggaa

SEQ ID NO: 4348 - protein, 38 aa, Haemophilus influenzae
  Name: NTH2429
MFNKIFSWFENRLNPYPESNPTTPKKVCSVLFGLVLQE

SEQ ID NO: 4349 - DNA, 1728 bp, Haemophilus influenzae
  n 16: n is any nucleotide
  Name: NTH2430
atgaaaggctggattnttttgctcgcaattttaaccgtaggtacaggtgtaatggaagctgtattattccaatttatgggaacgcttgtagattggttaggcacatttacacctgaaagattatggcaagaaaaaagtcatttattaattggaatggctgctctattacttattagtattgtgtggggatttttagcttcggccgtgcatttacaaaccttacaaggcgtatttccaatgcgattacgttggaatttccatcgtttaatgcttggacaaagtttaagtttttatcaagacgaatttgcaggtagagtatccgcaaaagtaatgcaaaccgcccttgcagtacgtgacacagtacttacacttgcagatatgttcgtttatgtattgggatattttattacctctggcgtagtgctagtggcattagattcttggttcttattaccatttattacttggattatactcttcggtttgatcctacgaacccctattcctaaactatcaaaaaccgcacaacgacaagctgatgctcgttctttaatgacaggacgcattacagatgcttattctaatattgctacagtaaaattattttctcacggctcacgcgaagctacttatgccaagcgttctatgcaagattttatggtaacagtacacgcccaaatgcgcttagcaacatcactagatacactcacttacgctacaaatattctacttacgttaagtactgcaatacttggtattattttatggaaaaatggtcaagttggcgtgggtgcaatagcaacggcaacggccatggcattacgcgtaaatgggctttctcgctggattatgtgggaatctgcccgtttgtttgagaatatcggaaccgtaaacgacggaatgaatactttaactaaaccccacaccattgtggacaaaccacaagcgtcaccgttacaagtgaaacaaggggaaattaagtttaacgatattacctttgcttacgatccgacaaaaccattactcaatcatttcaatctcactatcaaaccaggggaaaaggttgggttaatcggtcgttctggtgcaggaaaatctacgattgtgaacttattacttcgcttttatgaagcacaacaaggcgaaattaccattgatggacaaaatgtactcaatgtgcaacaagaaagcttacgtcgccaaatcggtttagtcactcaagacacttcgttgctacatcgctctgtacgtgacaatattatttatggtcgcccgaatgctactgatgaagaaatggttttagctgctgaacgagcggaagccgctgatttcatcccatttctcagtgattctcaaggtagaaaaggctatgatgcccatgtgggagaacgcggggtaaaactttctggtggtcagcgtcagagaattgccattgctcgtgtaatgttaaaagacgcaccaattctattgttagatgaagccacaagtgcattggattcagaagtggaagtggcaatacaagaaagtctagataagatgatggaaaataaaactgtgattgccattgcccatcgtttatccaccatcgcagcgatggatcgcctgattgtgcttgataaaggacaaattgtcgaacaaggtacgcacgccgaattactagagctcaatggtctgtacgctaaactttggaatcatcaaagtggcggatttttaagcggaagtgctgaa

SEQ ID NO: 4350 - protein, 576 aa, Haemophilus influenzae
  Xaa 6: Xaa is any amino acid
  Name: NTH2430
MKGWIXLLAILTVGTGVMEAVLFQFMGTLVDWLGTFTPERLWQEKSHLLIGMAALLLISIVWGFLASAVHLQTLQGVFPMRLRWNFHRLMLGQSLSFYQDEFAGRVSAKVMQTALAVRDTVLTLADMFVYVLGYFITSGVVLVALDSWFLLPFITWIILFGLILRTPIPKLSKTAQRQADARSLMTGRITDAYSNIATVKLFSHGSREATYAKRSMQDFMVTVHAQMRLATSLDTLTYATNILLTLSTAILGIILWKNGQVGVGAIATATAMALRVNGLSRWIMWESARLFENIGTVNDGMNTLTKPHTIVDKPQASPLQVKQGEIKFNDITFAYDPTKPLLNHFNLTIKPGEKVGLIGRSGAGKSTIVNLLLRFYEAQQGEITIDGQNVLNVQQESLRRQIGLVTQDTSLLHRSVRDNIIYGRPNATDEEMVLAAERAEAADFIPFLSDSQGRKGYDAHVGERGVKLSGGQRQRIAIARVMLKDAPILLLDEATSALDSEVEVAIQESLDKMMENKTVIAIAHRLSTIAAMDRLIVLDKGQIVEQGTHAELLELNGLYAKLWNHQSGGFLSGSAE

SEQ ID NO: 4351 - DNA, 276 bp, Haemophilus influenzae
  Name: NTH2432
atgaagaaattatgtaccgcacttttgctttcgctgtttgcaatttctttcgctcatgcgaatgaaaccaaacaaattgtgctaaaagtaaaggaaatgaattgccagctttgtgcttacttagtcaataaagaactgcgtaatattgatggcgttatttcaacaaaagcatctattaaagatggtttagtgacggttgtggaagatccaaaagtcacaaaccaacaattattcgatgcaattcacaagctgaaatatactgctgaagtcgtgaat

SEQ ID NO: 4352 - protein, 92 aa, Haemophilus influenzae
  Name: NTH2432
MKKLCTALLLSLFAISFAHANETKQIVLKVKEMNCQLCAYLVNKELRNIDGVISTKASIKDGLVTVVEDPKVTNQQLFDAIHKLKYTAEVVN

SEQ ID NO: 4353 - DNA, 360 bp, Haemophilus influenzae
  Name: NTH2433
atgactacgtatctaaaaaactctaataaatccttttgggttgccatagccgccgcactaagtgctgcggtggcatcaaccttgtgctgcatcgcaccattaatttatttagtatttggtgtgtcgtccacttggttgattggcttaggcgaatatgattatttgcgtattcctatgcttatcatttcattatgtgcctttgcctatggattttggctgttgatgttttccaaaaaaatcatttgtagcaaatatatttcccgtaaaaaacttatcgttttatattggattgtatttatcgtgatgatttttttcttaacctatccaacaattttaccttggattttagaattagctaat

SEQ ID NO: 4354 - protein, 120 aa, Haemophilus influenzae
  Name: NTH2433
MTTYLKNSNKSFWVAIAAALSAAVASTLCCIAPLIYLVFGVSSTWLIGLGEYDYLRIPMLIISLCAFAYGFWLLMFSKKIICSKYISRKKLIVLYWIVFIVMIFFLTYPTILPWILELAN

SEQ ID NO: 4355 - DNA, 1107 bp, Haemophilus influenzae
  Name: NTH2434
atgaagaaacttatcgcggttgcggtgttttctgcgtgtggctcgttagctcatgcaaacaccattattccaaactacaatacagacgcccatctttacgaattcacgcaaacctatgatttagttgtgccaaaaggctcgcaaggacaaaccaatttatgggttccattaccatttaatggggaataccaacaagtgaaatcgattcactttgaaggtaattacatgaatgcctatgtaacagaaaacaataaatacggagcgaaaaccttatttgccacttgggataaagatgcacaaaaacgtgatttaaaagtcacgatggtcattgaaacaaaagaccgtgaaccgatggtgaaaggtgctttagagaattatactccgccaaaagatattcagtattccgtggatgtacaagaatacttaaaagctactccacatattaaaactgatggcattgtgaaagaatttgctgacaaaatcctaggtaaagaaactaatccattgaagaaagcagaacttattcaccactggatcgtaaaaaatatggaacgtgataattctgtattaggttgtggtgacggcgatgtagaaaaaattcttaccactggcgtgttaaaaggtaaatgtaccgatattaactctgtatttgtggcacttgctcgtgctgcaggcatccctgctcgtgaaatttttggtattcgcttaggtacggcagagaaaatgggcaaatattcaaaaggtgccttcggtagtgcaaatgaacaaggcatcgtaaacgtaagtggcggtcagcactgccgcgctgaattctaccttgcaggatttggatgggtaccagttgattccgcagacgttgccaaaatgcgtttagcagagaaaaaatctgttgaagataaagatacacaagccgtagcaaaatatttgtttggtaactgggaagcaaactgggtgggatttaatcatgcccgtgacttcgatttatatccacaaccagaactggctccaatcaataacttcggctatccatatgcagaagtaggtggcgatccgttaaattcctttgacccaaaagaatttaaatatgactacgtatctaaaaaactc

SEQ ID NO: 4356 - protein, 369 aa, Haemophilus influenzae
  Name: NTH2434
MKKLIAVAVFSACGSLAHANTIIPNYNTDAHLYEFTQTYDLVVPKGSQGQTNLWVPLPFNGEYQQVKSIHFEGNYMNAYVTENNKYGAKTLFATWDKDAQKRDLKVTMVIETKDREPMVKGALENYTPPKDIQYSVDVQEYLKATPHIKTDGIVKEFADKILGKETNPLKKAELIHHWIVKNMERDNSVLGCGDGDVEKILTTGVLKGKCTDINSVFVALARAAGIPAREIFGIRLGTAEKMGKYSKGAFGSANEQGIVNVSGGQHCRAEFYLAGFGWVPVDSADVAKMRLAEKKSVEDKDTQAVAKYLFGNWEANWVGFNHARDFDLYPQPELAPINNFGYPYAEVGGDPLNSFDPKEFKYDYVSKKL

SEQ ID NO: 4357 - DNA, 1416 bp, Haemophilus influenzae
  Name: NTH2435
gtgggggacgatattatgagtaactttaatcaaataagtcgccgagattttgtcaaggcgtcatctgcgggagctgcactggcagtttcaaatcttactttacctttcaatgtaatggctaaagagacacaacacctcaatgaaaatagtcaggaacgtattgtttggagtgcttgtacagtaaactgtggtagccgttgtccattacgaatgcacgtaaaagataaccgaatcacttatgtggaaaccgataatacggggacagaaacatataatcttgatcatcaggttcgtgcttgtctacgtggacgttctatgcgtcgtcgagtgtataacccagaccgtttaaaatatccaatgaaacgtataggtaaacgcggagaaggtaaattcaaacgaatcagttgggatgaggctttaactgaaattgcagacgcattgaaacgcaatatcaaaaaatatggcaatgaatcaatttatttaaactatggtacgggaacactcggtggcacaatggctaaatcttggcctcctgcatccactatgatcgctcgttttatgaattgtattggtggatatttaaaccattatggtgattacagcaccgcacaaattgcagtcggtttagattatacctatggtggtggttgggcattgggaaatggaatggctgacattgaaaacaccaaattaatagtgttattcggtaataatcctgcagaaactcgtatgagtggaggtggtttaacttattgtattgaacaagccaaagctcgttccaatgccaaaatgattattatcgatcctcgttataatgatactggtgcagggcgtgaagatgagtggatcccaattcgtccaggcactgatgcagccctcgtttctgcccttgcttatgtaatgattcaagaaaatctcgtggatcaacctttcttagataaatattgtgttggttatgatgaaaaaacattacctgcggatgcccctaaaaatggtcattataaagcctatattttaggttatggtaatgatggtatcgctaaaaccccagaatgggcggctaaaatcacgggtattccggcggagagaattattaaactcgcacgtgaaattggcagcacaaaacctgcctttatttcccaaggttgggggcctcaacgtcgtagtaatggagaattaatctctcgtgccattgcgatgttgccaatcttaacaggtaatgttggaattcacggcggtaacactggtgcacgtgaaagtgcgtatagcattccatttgtgcggatgccaacgctaaaaaatcctgtgaaagcaagcattccaatgtttttatggacagatgcaattattcgtggcacagaaatgaccgcacttacagatggtattcgtggtgttgataaattatcgtcccccaat

SEQ ID NO: 4358 - protein, 472 aa, Haemophilus influenzae
  Name: NTH2435
VGDDIMSNFNQISRRDFVKASSAGAALAVSNLTLPFNVMAKETQHLNENSQERIVWSACTVNCGSRCPLRMHVKDNRITYVETDNTGTETYNLDHQVRACLRGRSMRRRVYNPDRLKYPMKRIGKRGEGKFKRISWDEALTEIADALKRNIKKYGNESIYLNYGTGTLGGTMAKSWPPASTMIARFMNCIGGYLNHYGDYSTAQIAVGLDYTYGGGWALGNGMADIENTKLIVLFGNNPAETRMSGGGLTYCIEQAKARSNAKMIIIDPRYNDTGAGREDEWIPIRPGTDAALVSALAYVMIQENLVDQPFLDKYCVGYDEKTLPADAPKNGHYKAYILGYGNDGIAKTPEWAAKITGIPAERIIKLAREIGSTKPAFISQGWGPQRRSNGELISRAIAMLPILTGNVGIHGGNTGARESAYSIPFVRMPTLKNPVKASIPMFLWTDAIIRGTEMTALTDGIRGVDKLSSPN

SEQ ID NO: 4359 - DNA, 1056 bp, Haemophilus influenzae
  Name: NTH2436
atggtattcgtggtgttgataaattatcgtcccccaattaaagtaatttggaattacgcaagtaactgtttgattaatcaacacgcacaaatcaatcgtactcacgatattttacaagatgatacccaatgtgaaatgatcattactattgataatcatatgacatctactgccaaatacagtgatattttattaccagattgtacaacttcagaacaaatggatttcgctttagatgcctttgtatccaatatggcctatgtcatttttgcagatcaagtgatcaaaccatcttttgaatgtagacctatttacgatatgttgagtgatttagctgagaaaatgggcgtaaaagaaaaatttactgaaggaagaacacaagaggaatggttacgccatatttatgagcaatctcgagaaaaattacctgaattacctacttttgaagaatttagacaacaaggtatttttaaaaaggttgatcctaatggctttaaagttgcatacaaagatttccgtgataatccagaagcccatccacttaaaacgccatctggcaaaattgaaatttattcttctcgtctagctgaaatagcaaacacttggaaattagcagaagatgaaataattcatcctttaccaattcacgcccaaagttttgagcattacggcgatccattaatggaaaaatatccgctacaactaagtggttttcactacaaagcaagaacccattcaacttatggcaatgtggatgtattaaaagcagctaatccacaagaagtttggatgaatcctattgatgcagaacctcgtaatattaaaaatggcgatatgattcgtatctttaatgatcgaggcgaagtacgtattaatgtaaaaattaccccccgtattattccaggggttgtggcattaagcgagggggcttggtatgcaccagataaagatcgtatcgatcattcaggttgcattaatgtacttacgacacaacgcccatcaccgcttgcgaaaggtaatccgcaacattctaatttagttcaagtggaacgtttg

SEQ ID NO: 4360 - protein, 352 aa, Haemophilus influenzae
  Name: NTH2436
MVFVVLINYRPPIKVIWNYASNCLINQHAQINRTHDILQDDTQCEMIITIDNHMTSTAKYSDILLPDCTTSEQMDFALDAFVSNMAYVIFADQVIKPSFECRPIYDMLSDLAEKMGVKEKFTEGRTQEEWLRHIYEQSREKLPELPTFEEFRQQGIFKKVDPNGFKVAYKDFRDNPEAHPLKTPSGKIEIYSSRLAEIANTWKLAEDEIIHPLPIHAQSFEHYGDPLMEKYPLQLSGFHYKARTHSTYGNVDVLKAANPQEVWMNPIDAEPRNIKNGDMIRIFNDRGEVRINVKITPRIIPGVVALSEGAWYAPDKDRIDHSGCINVLTTQRPSPLAKGNPQHSNLVQVERL

SEQ ID NO: 4361 - DNA, 615 bp, Haemophilus influenzae
  Name: NTH2437
atggaacaatatggtttttattttgattctgaacgctgcacaggctgtaaaacttgtgaattagcctgtaaggattacaaagatcttggcacagaagtcaattttcgtcgtatttatgaatatacaggtggtcagtggaatcaacaagcagatggatgctggcatcaaaatatatttgcttattatatgtctatttcttgtaatcattgtgcagatcctgcttgtacaaaagtttgcccaactggtgcaatgcacaaaaatgcagatggtttcgtgatcgtcaatgaagaaatttgtatcggttgtcgttattgccatatggcatgtccttatgatgcaccgcaatatgatgcacaaaaaggtcatatgacaaaatgtgatggatgttattctcgcgtaaaatcaggtcaaaaaccgatttgtgctgatgcctgcccactacgagcattggatttcgctcctattgatgaacttcgagcaaaatacggcactcaagcctccatcgcaccactaccaccggctgatatcactcaaccaaatttagttgtaaaacccaataaacacgctcgtttaagtggcgatacaagtgggttcttaggaaacccaagagaggtg

SEQ ID NO: 4362 - protein, 205 aa, Haemophilus influenzae
  Name: NTH2437
MEQYGFYFDSERCTGCKTCELACKDYKDLGTEVNFRRIYEYTGGQWNQQADGCWHQNIFAYYMSISCNHCADPACTKVCPTGAMHKNADGFVIVNEEICIGCRYCHMACPYDAPQYDAQKGHMTKCDGCYSRVKSGQKPICADACPLRALDFAPIDELRAKYGTQASIAPLPPADITQPNLVVKPNKHARLSGDTSGFLGNPREV

SEQ ID NO: 4363 - DNA, 837 bp, Haemophilus influenzae
  Name: NTH2438
atgaatacaggattatatgaactgccactagtattttttacagttttggcacaaagtgcggtcggtgcttggcttgttttcacatttgtactattaaatgagaaaaatacaaaaagtcgcacttatattcataaagtaatgtttgtgattttggctttgctaggtattggatttattgcttccattatgcatcttggcttacctatacgtgcatttaattcacttaatagagtcggctcatcaatgatgagtaatgaaattgccactggtgcaatatttttcgcattagcaggtttctactggctgattgcaattttaggtaaaatgccagcttcacttggaaatgtatggcgaattgtgaccgcccttatcggcatactatttatgtatgtaatgaatcaggtttaccatattacaagcataccaacttggaataatgcattaacctcttggtcattctatcttaccgttgtattaggtggattaacattaagctatgcgttattaatccctaataaacaacgtgaatatcagcttcagcatctgccaagtttatttgccattggagtattattggtcgcaatagtagccatatatcaaggcttcaatttacacaatattcacagtgctattcaaaatgccgctgacctcgtaccaaattatgccataatgaccgtaactcgcttatgtttactttccattgtagctttcctcttattccgagtgaaaaacataggactattaggtatttccgttctattaacgttagtagctgaaggcatcggtcgcgtattattttatggattacatatgacttacggcatggcgattggtggt

SEQ ID NO: 4364 - protein, 279 aa, Haemophilus influenzae
  Name: NTH2438
MNTGLYELPLVFFTVLAQSAVGAWLVFTFVLLNEKNTKSRTYIHKVMFVILALLGIGFIASIMHLGLPIRAFNSLNRVGSSMMSNEIATGAIFFALAGFYWLIAILGKMPASLGNVWRIVTALIGILFMYVMNQVYHITSIPTWNNALTSWSFYLTVVLGGLTLSYALLIPNKQREYQLQHLPSLFAIGVLLVAIVAIYQGFNLHNIHSAIQNAADLVPNYAIMTVTRLCLLSIVAFLLFRVKNIGLLGISVLLTLVAEGIGRVLFYGLHMTYGMAIGG

SEQ ID NO: 4365 - DNA, 609 bp, Haemophilus influenzae
  Name: NTH2439
atgcaaaatactcttcaacaaatttctatttatgggcgtttactcggtgcagtattttactatgagcctaatgatgcacgacttactgatattttgacattctttcgccaaccaaattggatgcaagaatgggaaatttcatttgatgtaaaaacacataaaaaaattaccgcacttattgaaaaagggctgcaacaaaatatcaatgaacaatatcagtatttatttattggtccaaatgaattacctacgccaccttggggatccgtatatcttgatcctgaatgtgttatttttggtaattctctcttagcattacgcgatttcttacaacaacatcaaatcgcatttcaaacacaacaagatgaaccagaagatcatattggcttaatgttaatgcttgctgcatatttagcagaaaatcgaccgcacttattaatcgaatttctacgtgaacacttcttaacttgggcgtatcatttccttgaacaactaagcaaaatagaaaattctgatttttatcaagctcttgcattacttaccctaaaaactttacaacaatggcaagtagatttacatattaatataccgacagtaagattttatcga

SEQ ID NO: 4366 - protein, 203 aa, Haemophilus influenzae
  Name: NTH2439
MQNTLQQISIYGRLLGAVFYYEPNDARLTDILTFFRQPNWMQEWEISFDVKTHKKITALIEKGLQQNINEQYQYLFIGPNELPTPPWGSVYLDPECVIFGNSLLALRDFLQQHQIAFQTQQDEPEDHIGLMLMLAAYLAENRPHLLIEFLREHFLTWAYHFLEQLSKIENSDFYQALALLTLKTLQQWQVDLHINIPTVRFYR

SEQ ID NO: 4367 - DNA, 498 bp, Haemophilus influenzae
  Name: NTH2440
atgaaaaacgaagcctattatcaggcttatttaagccaccatcacatttctcgtagaggactattgcgtcatatatttccagctacaaaatcaacaatagaaaaaacgcaatctcgtcctcccttttcagcacgagaagatttattttccgccgtctgcaatggttgtggggaatgtgcttcagcttgccctaatggtttaattcaactaaaacagcaacaagccacccttgaaattgactacgcaccttgtgatttgtgtggtaaatgcgcagaagtttgtccgacaaatgcactacatcctaattttccagcggatacattacttcgtccacaattttcctcagcctgtttaatcctacaaaatcaaacctgtccagactgccaaaccgcttgcacacaacaagcaatctccagcactttagagattgataatgaacgttgcaatgggtgcggagaatgtaaaattacctgttttgtcgcagccattacacttaaa

SEQ ID NO: 4368 - protein, 166 aa, Haemophilus influenzae
  Name: NTH2440
MKNEAYYQAYLSHHHISRRGLLRHIFPATKSTIEKTQSRPPFSAREDLFSAVCNGCGECASACPNGLIQLKQQQATLEIDYAPCDLCGKCAEVCPTNALHPNFPADTLLRPQFSSACLILQNQTCPDCQTACTQQAISSTLEIDNERCNGCGECKITCFVAAITLK

SEQ ID NO: 4369 - DNA, 180 bp, Haemophilus influenzae
  Name: NTH2441
ttgtcaattatccgaggaaaagttaagcctgatagcattgtgtacacggatacctttcgtagttatgatgtgcttgatgtcaatgaatttagccattttcggcatcaatcacaggtcgcattgatgaagaccaagctcaagattatgccaaacgtaaaggttgggatgagagagagatgt

SEQ ID NO: 4370 - protein, 60 aa, Haemophilus influenzae
  Name: NTH2441
LSIIRGKVKPDSIVYTDTFRSYDVLDVNEFSHFRHQSQVALMKTKLKIMPNVKVGMRERC

SEQ ID NO: 4371 - DNA, 1179 bp, Haemophilus influenzae
  n 1090, 1144: n is any nucleotide
  Name: NTH2442
atgggagaaaattttatgtccttaaataattcgctaacaacttttaatagtcagttacccgatttatcagttaatactattcccgcaattaatcaactagtttctgctcttcgcattccaagagacgttttagcaagtgatgaagaaattagatatgcttggaatgatttacctagagaattaagaaatataccagtccagaatgtgaatcctgagcttattgctcgtatgtgcattgcaattagctcaggattatttgatggtgcaatcaactatatatggaatgcttctattttgagattgcgtgataaagttagaacctttggtcttccaattgttgctcaagtattggaaagggattttgaagaaggccatttaatagcattacaggatagtcagttactagatttatgtttgcaattaaacattcttaacgaagaaggctttctttttctaggccaatgtagaaatatccgtaataatttttctgctgctcacccttcacttggcaatttgaatgatagagaattcattacattcttaaatcgttgtataaaatatgctttaggtgattcttcttcacctaaaggagtcaatattagtgattttattcaatcgattaaaggtggaagatttaatcaagaacaaagggaatattggattgataggctatctaaaactcacgaagcacagaaacaattattgattattatggcacacggtatttattgtgacccaaactcacaggaaacaactagattaaatgctttagatatttgtgctttctttcaaaatagtttttctgcttcactaaaatcttcattaattgataaacactctgaatatatcgcaaaaggagatgaacaaagattaagagcatctagtcaattttttgagaaattaagtttattagggttgctatcagctccacaacaacatgcgattttttcagcagcaattaacaggttgcaaatcgctcatgatgggctaaacaatttttataatgagcctccctatgctgaaagattagcagaattgtctaaaatacagcagtccctgaaacagccaagggattttgagaacgatagtntctgttatttggaaacaatatgggagttcatggggagcattccattttatgaanaaatattagaaacttttctccaaagaattaaccta

SEQ ID NO: 4372 - protein, 393 aa, Haemophilus influenzae
  Xaa 364, 382: Xaa is any amino acid
  Name: NTH2442
MGENFMSLNNSLTTFNSQLPDLSVNTIPAINQLVSALRIPRDVLASDEEIRYAWNDLPRELRNIPVQNVNPELIARMCIAISSGLFDGAINYIWNASILRLRDKVRTFGLPIVAQVLERDFEEGHLIALQDSQLLDLCLQLNILNEEGFLFLGQCRNIRNNFSAAHPSLGNLNDREFITFLNRCIKYALGDSSSPKGVNISDFIQSIKGGRFNQEQREYWIDRLSKTHEAQKQLLIIMAHGIYCDPNSQETTRLNALDICAFFQNSFSASLKSSLIDKHSEYIAKGDEQRLRASSQFFEKLSLLGLLSAPQQHAIFSAAINRLQIAHDGLNNFYNEPPYAERLAELSKIQQSLKQPRDFENDSXCYLETIWEFMGSIPFYEXILETFLQRINL

SEQ ID NO: 4373 - DNA, 399 bp, Haemophilus influenzae
  Name: NTH2443
atgcaccaaggggatgaagatcgtttggtattagataaactttctgcgcattcaaccaaagaatatccagcaacagcctttgttcaattgaaattagatggcgaaaaattaagcacttcgtcaattggtggtaacggcccagtagatgcggtttataacgccatcttaaatttaacaggcttagaaatcaaaatgtctcactataacttaaccgctaaaggcgagggcgcagaagcattagggcaagtggatattgtggtggaacacaaagggcgtaaattccacggtgttggtttagcaacagacatcgttgaatcttccgcacttgctttagtccacgctatcaatgccatttatcgcgcacataaagtggcagacattaaaagccataaacatcac

SEQ ID NO: 4374 - protein, 133 aa, Haemophilus influenzae
  Name: NTH2443
MHQGDEDRLVLDKLSAHSTKEYPATAFVQLKLDGEKLSTSSIGGNGPVDAVYNAILNLTGLEIKMSHYNLTAKGEGAEALGQVDIVVEHKGRKFHGVGLATDIVESSALALVHAINAIYRAHKVADIKSHKHH

SEQ ID NO: 4375 - DNA, 1074 bp, Haemophilus influenzae
  Name: NTH2445
atgcaatcatacaatgtagcagtattagcaggcgatggtattggccctgaagtaatggcggaagccatgaaagtattaaataaagttcaagaaaaatttggttttaaacttaacttcaacgagttttttgtcggcggtgctgccattgatcattgcggttatccattaccagcagaaaccttaaaaggctgtgatgaagcggatgccattttgtttggctctgtgggcggccctaaatggacaaatttaccgccagatcaacagccagaacgtggtgcattattgcctttacgtaaacactttaaattattctgtaatcttcgccctgctaccctttataaaggactcgaaaaattctgtccattacgtgcagatattgccgcaaaaggctttgatatggtagtggtgcgtgaattaacgggcgggatttatttcggtcagcctaaagggcgtgaaggcgaaggctcacaaaccaaagcatttgatacggaagtgtattacaaatatgaaattgaacgcattgcacgtgcggcttttgaggcagcaatgaaacgcaataaaaaagtcacttctgtagataaagcgaacgtattacagtcttctattttatggcgtgaaactgtgacagaaatggcaaaagactatcctgaagtgactttagagcatatctatatcgataacgccacaatgcaattaatcaaagcaccagaatcttttgatgttttactttgctctaatattttcggggacattatttctgacgaagcggcaatgatcacgggttctatgggaatgttgccatctgccagcttaaatgaagccggttttggtttatacgagcctgcaggcggttcagcaccagatattgcgggcaaaggcattgccaacccaatcgcacaaattctttctgctgcgatgatgttgcgttatagcttcaacttaaacgaagcagcagatgccattgaaagtgcggttcaaaaagtcttggcaagtggtcatcgcaccgctgatttagcagatgattccacaccagtttcaacggcagaaatgggtacattgattacacaagcaatt

SEQ ID NO: 4376 - protein, 358 aa, Haemophilus influenzae
  Name: NTH2445
MQSYNVAVLAGDGIGPEVMAEAMKVLNKVQEKFGFKLNFNEFFVGGAAIDHCGYPLPAETLKGCDEADAILFGSVGGPKWTNLPPDQQPERGALLPLRKHFKLFCNLRPATLYKGLEKFCPLRADIAAKGFDMVVVRELTGGIYFGQPKGREGEGSQTKAFDTEVYYKYEIERIARAAFEAAMKRNKKVTSVDKANVLQSSILWRETVTEMAKDYPEVTLEHIYIDNATMQLIKAPESFDVLLCSNIFGDIISDEAAMITGSMGMLPSASLNEAGFGLYEPAGGSAPDIAGKGIANPIAQILSAAMMLRYSFNLNEAADAIESAVQKVLASGHRTADLADDSTPVSTAEMGTLITQAI

SEQ ID NO: 4377 - DNA, 1407 bp, Haemophilus influenzae
  Name: NTH2446
atggcaaaaacactttacgaaaaattatttgattcccacattgtttatgaagcagagggcgaaacgccaattttgtatattaaccgtcatttgattcacgaagtaactagtccgcaggcttttgatgggttacgcgtcgcaaatcgccaagtacgccaagtaaacaaaacttttggcacaatggatcacagcatttctactcaagtacgagacgtcaataaacttgaaggtcaagcgaaaattcaagtgttagaattggataaaaataccaaagcaacaggtattaaattatttgatataacaaccaaagagcaaggcattgtacacgttatggggcctgaacaaggtttaaccttaccgggtatgacaattgtttgtggtgattcacacaccgcaacgcacggtgcatttggtgccttggcttttggtattggtacttctgaagtagaacacgtattagccactcaaactttaaaacaggctcgagcaaaaagtatgaaaattgaagtgcgtggtaaagttgcatcaggtattacggcaaaagatattattcttgccattatcggtaaaaccactatggcaggcggaacaggacacgttgtagaattctgcggcgaagcgatccgagacctttctatggaggggcgtatgactgtatgtaatatggcgattgaaatgggtgcaaaagcaggcttgattgcgccagacgaaaccacatttgcatatttgaaagatcgtccacacgcaccgaaaggcaaagattgggatgatgccgtagcttattggaaaaccttaaaatctgacgatgatgcacaatttgacactgtggtaacgctagaagcaaaagacatcgcaccacaagtcacttgggggacaaacccagggcaggtaatttctgtgaatgaaactataccaaatccgcaagaaatggcagatcctgtacaacgtgcttcggcagaaaaagccttacattatattggcttggaagctggcactaatttaaaagatattaaagttgatcaggtgttcatcggatcttgcaccaactcgcgtattgaagatttacgcgcagcagcggctgtaatgaaaggtcgtaaaaaagcggataatgtaaaacgtattttagtagtaccaggttctggcttagtgaaagaacaagcggaaaaagagggcttggataaaatctttattgccgcaggtgcagaatggcgtaatccaggttgttcaatgtgtttaggaatgaacgacgaccgtttaggcgaatgggaacgttgtgcttccacgtcaaaccgtaactttgaggggcgtcaaggtcgtaatgggcgtacccatttagtaagtcctgcaatggcggcagcagcaggaatgttcggtaaatttgttgatattcgtgaagtggcattaaat

SEQ ID NO: 4378 - protein, 469 aa, Haemophilus influenzae
  Name: NTH2446
MAKTLYEKLFDSHIVYEAEGETPILYINRHLIHEVTSPQAFDGLRVANRQVRQVNKTFGTMDHSISTQVRDVNKLEGQAKIQVLELDKNTKATGIKLFDITTKEQGIVHVMGPEQGLTLPGMTIVCGDSHTATHGAFGALAFGIGTSEVEHVLATQTLKQARAKSMKIEVRGKVASGITAKDIILAIIGKTTMAGGTGHVVEFCGEAIRDLSMEGRMTVCNMAIEMGAKAGLIAPDETTFAYLKDRPHAPKGKDWDDAVAYWKTLKSDDDAQFDTVVTLEAKDIAPQVTWGTNPGQVISVNETIPNPQEMADPVQRASAEKALHYIGLEAGTNLKDIKVDQVFIGSCTNSRIEDLRAAAAVMKGRKKADNVKRILVVPGSGLVKEQAEKEGLDKIFIAAGAEWRNPGCSMCLGMNDDRLGEWERCASTSNRNFEGRQGRNGRTHLVSPAMAAAAGMFGKFVDIREVALN

SEQ ID NO: 4379 - DNA, 600 bp, Haemophilus influenzae
  Name: NTH2447
atggcaggatttaaacaactttcaggcttagtcgtaccattggatgcggcgaatgtagataccgatgcaattatcccaaaacaatttttacaagccattactcgcgtgggtttcggcaaacacttattccatgaatggcgttatttagatgtggacggcaccaagccaaatccagaatttgtcttaaattatccgcaatatcaaggtgcaaccattttgctcgcacgtaaaaatcttggttgtggttcttctcgtgaacacgccccttgggcattggcagactacggctttaaagtaatgatcgccccaagttttgcagatattttctataacaacagcttaaataatcatatgttaccgattcgtttaagcgaagaagaagtagaagaaatcttccaatgggtgtgggcaaatgatggcaaacaaatccacgtagatttagaagcgatgacggtcactgttggggataaagtttatcactttgaactggatgaattccgccgtcattgtttgttaaacggtttggacaatatcggtttaacccttcagcacgaagaaaaaatctcagcatacgaaaaaaatattccagcgtttttacgt

SEQ ID NO: 4380 - protein, 200 aa, Haemophilus influenzae
  Name: NTH2447
MAGFKQLSGLVVPLDAANVDTDAIIPKQFLQAITRVGFGKHLFHEWRYLDVDGTKPNPEFVLNYPQYQGATILLARKNLGCGSSREHAPWALADYGFKVMIAPSFADIFYNNSLNNHMLPIRLSEEEVEEIFQWVWANDGKQIHVDLEAMTVTVGDKVYHFELDEFRRHCLLNGLDNIGLTLQHEEKISAYEKNIPAFLR

SEQ ID NO: 4381 - DNA, 5382 bp, Haemophilus influenzae
  n 1159, 1216, 1259: n is any nucleotide
  Name: NTH2448
atgctaaataaaaaattcaaactcaattttattgcgcttactgtcgcctacgcattaaccccttatacagaagccgcgttagtgagaaacgatgtggattatcaaatatttcgtgattttgcagagaataaagggaagttttctgttggtgcaacaaatgtggaagtgagagataacaaaaataataatttgggcagtgcgctacctaaagatattccgatgattgattttagtgctgtggatgtagataagagaattgccacgttggtaaatccacaatatgttgtgggggtaaaacacgttggtaacggtgtgggtgaactacattttgggaatttaaatgggaattggaaccctaaatttggaaattctattcagcatcgagatgtatcttgggaggaaaacagatattacactgttgaaaaaaataatttttcttctgaattaaacggaaaaacacaaaataacgaaaaagataaacagtatacatctaataaaaaagatgttccttccgaattatatggacaagccttagttaaagaacagcaaaaccaaaaacgccgtgaagattattatatgccacgccttgataaatttgttaccgaagttgcaccgatagaggcttcaactacaagtagtgatgctggaacatataatgatcagaataaatatcctgcttttgtgagattaggaagtggctctcaatttatctataaaaaaggaagccattatgaattaattttagaagagaaaaacgagaaaaaggaaataatacacagatgggatgtaggtggagataatcttaaattagttggtaacgcttatacctatggtattgcaggcacgccttataaagtgaatcatacagacgatggactcattgggtttggtgattcaaccgaagatcataacgatccaaaagagatattatctcgtaaaccgcttactaattatgctgtcttgggagatagtggctcaccgttatttgtttatgataaatctaaagagaaatggcttttccttggtgcttatgatttttggggagggtataagaaaaaatcttggcaagaatggaatatttataaaccacaatttgctgaaaatattctcaaaaaagacagtgctggtttactgaaaggtaatacgcaatataactggncaagcaaaggtaatacaagcttgatatctggaacatctgaatcattaagtgttgatntagtggataataaaaatctcaatcatgggaaaaatgttacgtntgaaggaagtggaaacctacccttaaataataatatcgatcaaggtgcaggcggattgttctttgaaggtgattatgaagttaaaggcacttcagaaaatacgacttggaaaggggctggtatatctgttgctgaaggaaaaacagtaaagtggaaagtgcataaccctcaatttgatcgtttagctaaaattggtaaaggaaagctaattgttgaaggaagaggagataataaaggttcgctaaaagtgggcgatggcacagttgttttaaaacaacaaacaactacaggacaacacgcttttgcttctgtaggaattgtaagtggtcgctcaactgttgtacttaatgatgataaccaagtagatccaaattcaatttactttggttttagaggcggtcgattagatgccaatggcaataatctcacttttgaacatatccgtaatattgatgatggtgcaagactagttaatcataatatgactaatgcctcaaatataacgattactggagcaggattaattacaaatccaagtcaggtcactatatatacaccagcaataaccgccgatgatgataattattactatgtgccatctattccaagaggaaaagatctttactttagtaatacctgttataaatactatgcgttaaagcaaggtggaagccctactgcagaaatgccttgctatagctctgaaaaatcagatgctaattgggaattcatgggcgacaatcaaaatgatgcacaaaagaaagccatggtgtacatcaataacagacgtatgaatggctttaatggttattttggcgaggaagcaactaaggcagatcaaaacggtaaattaaatgttacctttagtggcaaaagtgatcaaaatcgctttttattgactggcggaacaaaccttaacggtgaattaaaagttgaaaaaggtacattattcctttctggcagaccaacaccacacgcaagagatattgcaaatatttcttcaacagaaaaagataaacactttgctgaaaataatgaagtggtggtagaagacgactggattaaccgcacttttaaagcaacaaatattaatgtaaccaataacgcaaccctttattcaggtcgcaatgttgaaagtattacttcaaatatcacagcctctaataaagcaaaagtgcatatcggctataaagcaggcgataccgtttgtgtacgttctgactatacgggctatgtgacttgccataatgacactttatctacaaaagcactcaatagttttaatccaactaatttgcgcggtaatgtaaatttaaccgaaagtgcaaactttaccttaggcaaagctaacttatttggcacaattaacagcacggaaaatagccaagttaatttaaaagaaaacagccattggtatttaacaggaaatagtgatgttcatcaattagatctagcaaatgggcatattcatttaaataatgtctcagatgcaacaaaagaaacaaaataccacacgctcaatattagcaatttatcaggtaatggttctttctattattgggttgattttaccaaaaatcagggcgacaaagttgttgtaaccaaatcagccaaaggtacctttacattacaagtggcaaataaaacaggcgagccaaatcataatgaacttacgctttttgatgcgtcaaatgcaactgaaagaagtggcttaaatgtttcactggctaatggcaaagttgatcgaggtgcttggagctatactttgaaagaaaatagtggacgttattacttgcataacccagaagtagaaagaagaaatcaaactgtcgatacgccaagtattgcaacagctaataatatgcaagctgatgtacctagcgtatcaaataaccatgaagaaaccgctcgtgttgaagcaccaattccactgccagcaccacctgcacctgctactggatcagcaatggcaaacgagcaaccagaaactcgtcctgcagaaaccgttcaacctacaatggaagatacaaatactactcacccatcgggatctgaaccacaagctgatacaacacaggctgatgatccaaattcagaaagtgttccatcagagacaattgaaaaagtggctgaaaatagtccgcaagaaagtgaaacagtagcgaaaaacgagcaaaaagcaaccgagacaacagctcaaaatgatgaagttgcaaaagaagctaaaccaactgtggaagctaacactcaaacaaatgaactcgcccaaaatggaagcgaaaccgaggaaactcaagaggctgaaactgctcgtcagtctgaaataaattctactgaagaaacagtagtagaagatgatcctacaatcagtgaaccaaagagcagacctagaagaagtattagctcgtcttctaataatataaatctagcaggaacagaagatactgctaaagtagaaacagagaaaactcaagaagcccctcaagtggcttttcaagcgtctccaaaacaagaagaaccagaaatggctaaacagcaagaacagcctaaaactgttcaatcgcaagcacagccagaaactaccacacagcaagcagagcctgctcgtgaaaatgtttcgactgttaataatgtaaaagaagctcaaccgcaagcaaaacctacaactgttgctgcgaaagagacaactgcatcaaacagtgaacagaaagaaactgctcaacctgtagctaatccaaaaacagctgaaaataaagcagaaaatcctcaatcaacagaaacgacagatgaaaatattcatcagcctgaagcccacactgctgttgcttcaacagaagttgttacacctgaaaatgctacaacacctattaaacctgttgagaataaaactacagaagctgaacaacctgtgacagaaaccacaacagtaagcactgaaaaccctgtagtgaaaaatccagagaatacaacacctgctacaactcaatctacggttaattcagaggcagttcaatcagaaacagcgacaacagaagctgttgttagccagtctaaagtgacttctgctgaagaaacaacagtagcttctactcaagaaacaacagtggataattcaggatctactccacaaccacgaagcagaagaactcgtagatcagctcagaatagttacgagccagtggaactacatactgaaaatgcggagaatccgcaatcgggaaatgatgtggctacacaactagtattgcgcgatctcacaagtacaaacaccaatgcggtaatttctgatgccatggcaaaagcacaatttgttgcattaaatgtagggaaagccgtttctcaacatattagccagttagaaatgaataacgaggggcaatataacgtttgggtatctaatacttcaatgaaagaaaattattcctcaagtcaatatcgtcattttagttctaaaagtgcgcaaactcaacttggttgggatcaaacaatctcaagcaatgttcagttaggtggtgtgtttacttatgttcgcaatagtaacaactttgataaggcaagcagtaaaaataccttagcacaagcaaatctctattctaaatattatatggataatcattggtatttagcggtggatttaggctatggtaatttccaaagcaacttacaaactaatcataatgcgaaatttgctcgccatactgcacaatttggtttaaccgcaggcaaagcatttaatcttggcaattttgctgttaaaccaactgtaggggttcgttatagttacttatcaaacgctaattttgcattagctaaagatcgcattaaagtaaatccaatatctgtcaaaacagcctttgctcaagttgatttaagttatacttatcacttaggcgagttttccattacgccaattttgtctgctcgatatgatgcaaatcaaggcagcggcaaaattaatgtagatagatatgattttgcttacaatgtggaaaaccaacagcaatataacgcaggacttaaattgaaatatcataatgtgaaattaagtctaattggcggattaacaaaagcaaaacaagcggaaaaacaaaaaactgcagaagtgaaactaagttttagtttt

SEQ ID NO: 4382 - protein, 1794 aa, Haemophilus influenzae
  Xaa 387, 406, 420: Xaa is any amino acid
  Name: NTH2448
MLNKKFKLNFIALTVAYALTPYTEAALVRNDVDYQIFRDFAENKGKFSVGATNVEVRDNKNNNLGSALPKDIPMIDFSAVDVDKRIATLVNPQYVVGVKHVGNGVGELHFGNLNGNWNPKFGNSIQHRDVSWEENRYYTVEKNNFSSELNGKTQNNEKDKQYTSNKKDVPSELYGQALVKEQQNQKRREDYYMPRLDKFVTEVAPIEASTTSSDAGTYNDQNKYPAFVRLGSGSQFIYKKGSHYELILEEKNEKKEIIHRWDVGGDNLKLVGNAYTYGIAGTPYKVNHTDDGLIGFGDSTEDHNDPKEILSRKPLTNYAVLGDSGSPLFVYDKSKEKWLFLGAYDFWGGYKKKSWQEWNIYKPQFAENILKKDSAGLLKGNTQYNWXSKGNTSLISGTSESLSVDXVDNKNLNHGKNVTXEGSGNLPLNNNIDQGAGGLFFEGDYEVKGTSENTTWKGAGISVAEGKTVKWKVHNPQFDRLAKIGKGKLIVEGRGDNKGSLKVGDGTVVLKQQTTTGQHAFASVGIVSGRSTVVLNDDNQVDPNSIYFGFRGGRLDANGNNLTFEHIRNIDDGARLVNHNMTNASNITITGAGLITNPSQVTIYTPAITADDDNYYYVPSIPRGKDLYFSNTCYKYYALKQGGSPTAEMPCYSSEKSDANWEFMGDNQNDAQKKAMVYINNRRMNGFNGYFGEEATKADQNGKLNVTFSGKSDQNRFLLTGGTNLNGELKVEKGTLFLSGRPTPHARDIANISSTEKDKHFAENNEVVVEDDWINRTFKATNINVTNNATLYSGRNVESITSNITASNKAKVHIGYKAGDTVCVRSDYTGYVTCHNDTLSTKALNSFNPTNLRGNVNLTESANFTLGKANLFGTINSTENSQVNLKENSHWYLTGNSDVHQLDLANGHIHLNNVSDATKETKYHTLNISNLSGNGSFYYWVDFTKNQGDKVVVTKSAKGTFTLQVANKTGEPNHNELTLFDASNATERSGLNVSLANGKVDRGAWSYTLKENSGRYYLHNPEVERRNQTVDTPSIATANNMQADVPSVSNNHEETARVEAPIPLPAPPAPATGSAMANEQPETRPAETVQPTMEDTNTTHPSGSEPQADTTQADDPNSESVPSETIEKVAENSPQESETVAKNEQKATETTAQNDEVAKEAKPTVEANTQTNELAQNGSETEETQEAETARQSEINSTEETVVEDDPTISEPKSRPRRSISSSSNNINLAGTEDTAKVETEKTQEAPQVAFQASPKQEEPEMAKQQEQPKTVQSQAQPETTTQQAEPARENVSTVNNVKEAQPQAKPTTVAAKETTASNSEQKETAQPVANPKTAENKAENPQSTETTDENIHQPEAHTAVASTEVVTPENATTPIKPVENKTTEAEQPVTETTTVSTENPVVKNPENTTPATTQSTVNSEAVQSETATTEAVVSQSKVTSAEETTVASTQETTVDNSGSTPQPRSRRTRRSAQNSYEPVELHTENAENPQSGNDVATQLVLRDLTSTNTNAVISDAMAKAQFVALNVGKAVSQHISQLEMNNEGQYNVWVSNTSMKENYSSSQYRHFSSKSAQTQLGWDQTISSNVQLGGVFTYVRNSNNFDKASSKNTLAQANLYSKYYMDNHWYLAVDLGYGNFQSNLQTNHNAKFARHTAQFGLTAGKAFNLGNFAVKPTVGVRYSYLSNANFALAKDRIKVNPISVKTAFAQVDLSYTYHLGEFSITPILSARYDANQGSGKINVDRYDFAYNVENQQQYNAGLKLKYHNVKLSLIGGLTKAKQAEKQKTAEVKLSFSF

SEQ ID NO: 4383 - DNA, 1134 bp, Haemophilus influenzae
  Name: NTH2449
ttgaaaactgtgaagacagcagctgcgaatacgtcattatgccaatgcgtttataatatggcgatttctcgtttactggtcgaaaaatttcgtaatttaacagcagtggatcttgattttgatccctgctttaactttttaatcggcaacaacggcagcggaaaaaccagcttattagaagccattttttatcttggtcacggacgttcatttaaaagtgcggtcacaaaccgcatcatttcttacgacgaaccgcactttaccctatttggacaaatccaagaaagccaacatcaatggtctgtcggcttacaaaaacttcgtcaaggcaacaccttagtaaaaattaacggcgaagatggcaataaaatttccgatctagcccatcttttaccaatgcaattaatcacgccagagggcttaaccttactcaacggtgggccaagttatcgtcgtgcgtttttagattggggattattccaccaccaaacaagtttctattccgcttggagcaatctcaaccgattacttaaacaacgaaatgccgcactcgcacaaaatcagccttactctgccataaaaatttgggacgttgaacttgccaaacttgcccaccaagtaagtcaatggcgtgccgaatatgcagaagctctccgccctgaaattgaacaaacttgccaactttttctgcctgaattagaaattaatgtcagctttcatcaagggtgggaaaaaaatgctgattattatgaaattcttcaacaaaattttgaacgagatcgtgccttaaattacaccttttctggccctcaaaaagcggattttcgtttcaaagcacaaggattgcctgttgaagatgtgctttctcgtggacagcttaaacttttaatgtgtgtattaagactagcgcagggcgagcatttaatgaaagaaaagcaacgccattgtatttttttgatcgatgattttgcctcggaattagatcaatacaaacgtgccttgttggcagaacgattacaacaaagcggttcgcaagtatttgttaccgccatcactcaaagacaactaaaagaaatgcaagtggaaaacaaaaaaatgttttctgtccataatggcatcattaacgccttaaat

SEQ ID NO: 4384 - protein, 378 aa, Haemophilus influenzae
  Name: NTH2449
LKTVKTAAANTSLCQCVYNMAISRLLVEKFRNLTAVDLDFDPCFNFLIGNNGSGKTSLLEAIFYLGHGRSFKSAVTNRIISYDEPHFTLFGQIQESQHQWSVGLQKLRQGNTLVKINGEDGNKISDLAHLLPMQLITPEGLTLLNGGPSYRRAFLDWGLFHHQTSFYSAWSNLNRLLKQRNAALAQNQPYSAIKIWDVELAKLAHQVSQWRAEYAEALRPEIEQTCQLFLPELEINVSFHQGWEKNADYYEILQQNFERDRALNYTFSGPQKADFRFKAQGLPVEDVLSRGQLKLLMCVLRLAQGEHLMKEKQRHCIFLIDDFASELDQYKRALLAERLQQSGSQVFVTAITQRQLKEMQVENKKMFSVHNGIINALN

SEQ ID NO: 4385 - DNA, 1098 bp, Haemophilus influenzae
  Name: NTH2450
atgcaatttagcatttcaagagaaaatttattaaaaccgttgcaacaagtatgtggcgtattgagtaatcgtccaaatattcctgtattaaacaacgtattgttgcaaattgaagacaatcgtctgactatcactggtacagatttagaagtcgaattatcgagtcaaactcagctttcatcgtcttctgaaaatggcacttttaccattccagcaaaaaaattcttagatatttgccgcactttatctgatgattcagaaatcacggtgacttttgaacaagaccgtgctttagtgcagtctgggcgtagccgttttacgctgacaacccaacctgccgaagaatatccaaacctcacggattggcagtctgaagtggattttcaactaccgcaaaataccttacgccgtttaattgaagccactcaattttctatggcaaaccaagatgcgcgctatttcttaaatggtatgaagtttgaaacagaaggcaatttattgcgaacggtggcaacagatggtcatagacttgcggtgtgtaccatttcccttgaacaagaattacaaaatcattctgtgattttaccgcgtaaaggtgtgttagagctggttcgtttattagaaacaaacgatgaaccagcgcgtttacaaattggcaccaacaatttacgtgtccatttaaaaaacacggtatttacatcaaaattaattgatggtcgctttcctgactatcgccgagtattgcctcgtaatgccacaaaaactgtcgaaggcaattgggaaatgctgaaacaggcttttgttcgtgcgtccattttatctaatgaacgagcgcgcagcgtgcgtttaagcttaaaggaaaaccagcttaaaattactgcctcaaacacagaacacgaagaagcagaagaaattgtcgatgtcaattacaatggcgaagaattagaagtgggctttaatgtcacctatattcttgatgtgctgaatgcacttaaatgtaatcaagtgcgaatgcgcttaactgatgcgttctccagttgcttaattgaaaactgtgaagacagcagctgcgaatacgtcattatgccaatgcgttta

SEQ ID NO: 4386 - protein, 366 aa, Haemophilus influenzae
  Name: NTH2450
MQFSISRENLLKPLQQVCGVLSNRPNIPVLNNVLLQIEDNRLTITGTDLEVELSSQTQLSSSSENGTFTIPAKKFLDICRTLSDDSEITVTFEQDRALVQSGRSRFTLTTQPAEEYPNLTDWQSEVDFQLPQNTLRRLIEATQFSMANQDARYFLNGMKFETEGNLLRTVATDGHRLAVCTISLEQELQNHSVILPRKGVLELVRLLETNDEPARLQIGTNNLRVHLKNTVFTSKLIDGRFPDYRRVLPRNATKTVEGNWEMLKQAFVRASILSNERARSVRLSLKENQLKITASNTEHEEAEEIVDVNYNGEELEVGFNVTYILDVLNALKCNQVRMRLTDAFSSCLIENCEDSSCEYVIMPMRL

SEQ ID NO: 4387 - DNA, 162 bp, Haemophilus influenzae
  Name: NTH2451
atgctaaattgcattgcgttctccttttatgcaggatttattgtatttcttggctccacccatttctggggggagctgccgaaggctgaggggggattaaccagcccccttccgccctatgggcaccttcccccgcaagcaggggaaggcaaggtatttgtc

SEQ ID NO: 4388 - protein, 54 aa, Haemophilus influenzae
  Name: NTH2451
MLNCIAFSFYAGFIVFLGSTHFWGELPKAEGGLTSPLPPYGHLPPQAGEGKVFV

SEQ ID NO: 4389 - DNA, 1362 bp, Haemophilus influenzae
  Name: NTH2452
gtgaatctctcaaatctttggcaaagttgcctgttacaacttcaagatcaagtttcagccagcgatcttagcacttggcttcgtcctttacaggctgatgtggtggcggataaccacattgttttatatgcttctaatatgtttgtgaaaggttgggtggaaacccattatctcgcacaaatccagcaaatttgtcaaacacttacacaaaatcctgaactgcgtatttctttaaaagaaggggtcaagcctgcacctaaagtagtagaaaatacgccaaatatatcacttagatcagaaagtgcggtagattttcaagctgaatctagtgcttcagtaaaatttgaatctcatctcaatactaaacacttatttgataactttgttgaaggtaaatcgaaccaactcgcacgtgcagtcggtcaaaaacttgctcaagcaccaggcgaaccatcggctaatcctttctttttatatggcggcactggtttagggaaaactcacttgttacacgccattggcaacggcattttagccgataaaccgaatgcgcgagtgctttatattcacgcaaataactttatgcaacatatggtaaaagcagtgcgtgataataaaatggatcagttcaaaaaattctatcgttctcttgatgcgcttttagtggatgatattcaatttttcgctgaaaaagaaaaaactcaagaagaattcttccatatattcaataacttatttgaaacgggtcgccaaattatcttaacttcggatcgttaccctaaagaaattgaaaaaattgaagaacgtttaaaatcacgttttggctggggcttaacaacagccattgaaccgcccgatcttgaaactcgcgtagcgattttattgaaaaaggcggaagaacataatatgaacttgccagaagaagttgctttcttcattgctcaacgcttgcgtaccaacgtgcgtgaacttgagggtgcattaaatcgagtgaaagcaatgcaagacttcaaaggcggtgacattgatattgatttcgtgcgtgataccttaaaagatattttggctttacaagaacgcttggttactattgaaaatattcaaaaagtggtggctgaatattatcgaattaaggtttcagatttaaaatcaaaaagtcgtgcgcgttcagtcactcgccctcgccaaattgccatggcgttagcaaaagaattaacaaaccgcagtttgcctgaaatcggtcgtgcctttgaccgtgatcacacaaccgtattaaacgcttgccgtgaagtgccaaaattccgcgagcaagacaatagcattcaagaagattgggcgaatttaatccgcactttgtccgca

SEQ ID NO: 4390 - protein, 454 aa, Haemophilus influenzae
  Name: NTH2452
VNLSNLWQSCLLQLQDQVSASDLSTWLRPLQADVVADNHIVLYASNMFVKGWVETHYLAQIQQICQTLTQNPELRISLKEGVKPAPKVVENTPNISLRSESAVDFQAESSASVKFESHLNTKHLFDNFVEGKSNQLARAVGQKLAQAPGEPSANPFFLYGGTGLGKTHLLHAIGNGILADKPNARVLYIHANNFMQHMVKAVRDNKMDQFKKFYRSLDALLVDDIQFFAEKEKTQEEFFHIFNNLFETGRQIILTSDRYPKEIEKIEERLKSRFGWGLTTAIEPPDLETRVAILLKKAEEHNMNLPEEVAFFIAQRLRTNVRELEGALNRVKAMQDFKGGDIDIDFVRDTLKDILALQERLVTIENIQKVVAEYYRIKVSDLKSKSRARSVTRPRQIAMALAKELTNRSLPEIGRAFDRDHTTVLNACREVPKFREQDNSIQEDWANLIRTLSA

SEQ ID NO: 4391 - DNA, 354 bp, Haemophilus influenzae
  Name: NTH2453
atgatcattcaagtaatacttcggggaattaatacaatgtttactcaatcaaaagcaaaatctcaaaatgaattgctaggacaacgttcattaggtaacacttcaaggggtgtaaaatcaacaagaaaacttactcgggcatggcatatcttagatgtatcgggttattacatggtgaatagaagtattttgttccgattaggagtatataatttattaaactatcgctatgtcacttgggaagcggtgcgtcaaacagcacaaggagcggtcaatcaacatcaaaatgttggtaattatactcgctacgcagcatcaggacgaaactataccttaacattagaaatgaaattc

SEQ ID NO: 4392 - protein, 118 aa, Haemophilus influenzae
  Name: NTH2453
MIIQVILRGINTMFTQSKAKSQNELLGQRSLGNTSRGVKSTRKLTRAWHILDVSGYYMVNRSILFRLGVYNLLNYRYVTWEAVRQTAQGAVNQHQNVGNYTRYAASGRNYTLTLEMKF

SEQ ID NO: 4393 - DNA, 693 bp, Haemophilus influenzae
  Name: NTH2454
gtgcggttattaagggaaaaatattatttcgcagcacgcaataatatggcattagggaaatacgttgatttaggtttaggtattcggtatgacgtatctcgtacaaaagctaatgaatcaactattagtgttggtaaatttaaaaatttctcttggaatactggtattgtcataaaaccaacggaatggcttgatctttcttatcgcctttctactggatttagaaatcctagttttgctgaaatgtatggatggcggtatggtggcaagaatgacgaggtttatgtaggtaaatttaagcctgaaacatctcgtaaccaagagtttggtctcgctctaaaaggggattttggtaatattgagatcagtcattttagtaatgcttatcgaaatcttatcgcctttgctgaagaacttaaaaatggaaagggcaagggcaattatggatatcataatgcacaaaatgcaaaattagttggcgtaaatataactgcgcaattagattttaatggtttatggaaacgtattccctacggatggtatgcaacatttgcttataaccgagtaaaagttaaagatcaaagaatcaatgctggtttagcctccgtaagcagctatttatttgatgccattcagcccagccgttatatcattggtttaggctatgatcattcaagtaatacttcggggaat

SEQ ID NO: 4394 - protein, 231 aa, Haemophilus influenzae
  Name: NTH2454
VRLLREKYYFAARNNMALGKYVDLGLGIRYDVSRTKANESTISVGKFKNFSWNTGIVIKPTEWLDLSYRLSTGFRNPSFAEMYGWRYGGKNDEVYVGKFKPETSRNQEFGLALKGDFGNIEISHFSNAYRNLIAFAEELKNGKGKGNYGYHNAQNAKLVGVNITAQLDFNGLWKRIPYGWYATFAYNRVKVKDQRINAGLASVSSYLFDAIQPSRYIIGLGYDHSSNTSGN

SEQ ID NO: 4395 - DNA, 555 bp, Haemophilus influenzae
  Name: NTH2455
atgacaaatctatcattaaatcctatttttgaaagttttgcgccaatttttaagcaattaaaaaccgtggcaatgtctgcgttatttattgcgccattggcgataaatcatcctgttcgtcacactacacacacagtcaatattttcagtgttcaaacagatgaaaataaatcgatcaatcaacaagacatagaaaagattattgatatggtgaaagctgtttctgctatcactgattttgttattgcgtcaattacggcagaatcattaagctatattgatttaagtgacgttctgagactagaaagcaaaattaataaatatgatgatctagctaacaatattatggtcaataataaaactccagaattatcaacaacgctacaatcattcagcaataaaatgcacacgctttgcaatatgatgaaatcagaaaaatacaagcaacaatcagatgaagtagtgttatcacgcctttatcgcaaatctgaagatgcagggtacacctacaaatcatcacattcttttgatgattttaaaaaagcagtgatgatg

SEQ ID NO: 4396 - protein, 185 aa, Haemophilus influenzae
  Name: NTH2455
MTNLSLNPIFESFAPIFKQLKTVAMSALFIAPLAINHPVRHTTHTVNIFSVQTDENKSINQQDIEKIIDMVKAVSAITDFVIASITAESLSYIDLSDVLRLESKINKYDDLANNIMVNNKTPELSTTLQSFSNKMHTLCNMMKSEKYKQQSDEVVLSRLYRKSEDAGYTYKSSHSFDDFKKAVMM

SEQ ID NO: 4397 - DNA, 426 bp, Haemophilus influenzae
  Name: NTH2456
atgaagattgagttatcgaaacaatttcaagaagggcgtttaaacacgcccttttttaaagacattcaagccatgtcagatgaagaattgcagctcatctttgattttatgcaatccattaaacaagggaaactattaagaggtaaaaataaaccatcttggcttgatgataatctcaatgacattccaaatacagaggtttatcaacaaaacgaaatatggcattatcactgcggcccttacaataaaggatctagatattgtcctatgagtgggctaaaaataaatttgaatggagaaacatcaggacctgtaattcattatcaaaaaatatcagatgaacatatcgtgattatcgctttttctccacaacacgaaccgttcccacgcgaatgggacactccaaacccaatcattgacagagca

SEQ ID NO: 4398 - protein, 142 aa, Haemophilus influenzae
  Name: NTH2456
MKIELSKQFQEGRLNTPFFKDIQAMSDEELQLIFDFMQSIKQGKLLRGKNKPSWLDDNLNDIPNTEVYQQNEIWHYHCGPYNKGSRYCPMSGLKINLNGETSGPVIHYQKISDEHIVIIAFSPQHEPFPREWDTPNPIIDRA

SEQ ID NO: 4399 - DNA, 597 bp, Haemophilus influenzae
  Name: NTH2457
atgcctatgtctgctgaattacaacgaaaactagacaacattatccgctttggggtaatcgctgaagtgaatcacgccactgcacgagctcgcgtaaagagcggtgacattctgacggattttttacccttcgttacatttcgagcgggtacaaccaaaacttggtcgccgccgacggtgggcgaacaatgtgtgatgttatccgttagcggtgaatttactactgcctgcatattagttgggctttacacacaaaatagcccaagccaatcgcccgacgaacacgtcattgaatttgctgacggtgccaaaatcacttacaaccaatcaagtggtgcattggttgtgacaggtatcaaaaccgccagtattactgccgctaatcaaattgatattgactgccccgctatcaatatcaaaggtaatgtgaatattgacggctctttatcaaccacaggcacaagcaccacaaaaggcaatatcagcacgcaaggcagcgtgaccgcaagcggtgatattaaaggtggctcaattagtttacaaaaccacgtccaccttgaacaaggcgatggccaacgaacctctaacgcaaaggca

SEQ ID NO: 4400 - protein, 199 aa, Haemophilus influenzae
  Name: NTH2457
MPMSAELQRKLDNIIRFGVIAEVNHATARARVKSGDILTDFLPFVTFRAGTTKTWSPPTVGEQCVMLSVSGEFTTACILVGLYTQNSPSQSPDEHVIEFADGAKITYNQSSGALVVTGIKTASITAANQIDIDCPAINIKGNVNIDGSLSTTGTSTTKGNISTQGSVTASGDIKGGSISLQNHVHLEQGDGQRTSNAKA

SEQ ID NO: 4401 - DNA, 369 bp, Haemophilus influenzae
  Name: NTH2458
atggccaacgaacctctaacgcaaaggcatagtatgaatcgatacactggcgaaacattaaaaaacgaaagcgaccacattaaacaatccatcgccgatattttgctaacgccagttggttcacgaattcagcggcgtgaatatggcagtttaatcccaatgctaatagaccgcccaattagccacacattgttattacaactggcggcttgtgccgtcactgcgattaatcgttgggaacctcgagtacagatcacacaatttaaacctgaattggttgaaggtggcattgtggcaagttatgtcgcacgcagtcgtaaagataaccaagaaatgcacaacgaaaaactatttttaggacataaacaa

SEQ ID NO: 4402 - protein, 123 aa, Haemophilus influenzae
  Name: NTH2458
MANEPLTQRHSMNRYTGETLKNESDHIKQSIADILLTPVGSRIQRREYGSLIPMLIDRPISHTLLLQLAACAVTAINRWEPRVQITQFKPELVEGGIVASYVARSRKDNQEMHNEKLFLGHKQ

SEQ ID NO: 4403 - DNA, 912 bp, Haemophilus influenzae
  Name: NTH2460
atgagcgaattagtcgatttatcaaaactagatgcaccaaaagtgctagaagatttagattttgaaagtttgctcgcagacagaaaagcggaatttatcgcacttttcccacaagatgaaagggcattttggcaagcacgattaagtttagaaagtgagcccatcacgaaattattacaagaagtggtttacttacagttgatggaaagaaaccgcatcaacaatgcggcaaaagccacaatgttagcctatgccagcggttcagatttagatgtgattgccgccaattacaatgtgaaaagacaagtcattcaagaggcgaataataatgttacgcctaaaatccccgaaattttagaagatgacacctcattaagattgcgcacgcaattagcctttgaggggctttctgtggcgggtcctcgctctgcttatatcttccacgcactctctgcacaccctgatgttgcagatgtgtctgtggtatcaccacagccagccaatgtcaccgtcacgattttaagccgtaatggacaaggtgaaacaaacgaaaaccttttaaatgtagttagagccaaacttaatgatgatgacattcgccctattggcgaccgcgttattgtccaaagtgcggtgatccaatcctacgaaatccgcgccaaattacatctttatcgtggccctgaatacgagccaatcaaagctgcagctctaaaaaaattgaccacttacaccgaagaaaaacaccgtttagggcgagatattagcctatcgggtatttatgccgcattacacttggaaggtgtacaacgagtagagcttatctcacctaccgccgaccttgtgctaccaagctcaaaatcagcctactgcacggcaattaatttggagatagtgacaagtgatgattac

SEQ ID NO: 4404 - protein, 304 aa, Haemophilus influenzae
  Name: NTH2460
MSELVDLSKLDAPKVLEDLDFESLLADRKAEFIALFPQDERAFWQARLSLESEPITKLLQEVVYLQLMERNRINNAAKATMLAYASGSDLDVIAANYNVKRQVIQEANNNVTPKIPEILEDDTSLRLRTQLAFEGLSVAGPRSAYIFHALSAHPDVADVSVVSPQPANVTVTILSRNGQGETNENLLNVVRAKLNDDDIRPIGDRVIVQSAVIQSYEIRAKLHLYRGPEYEPIKAAALKKLTTYTEEKHRLGRDISLSGIYAALHLEGVQRVELISPTADLVLPSSKSAYCTAINLEIVTSDDY

SEQ ID NO: 4405 - DNA, 537 bp, Haemophilus influenzae
  Name: NTH2461
gtgatgattactaatcatttactgccgataggcgcaactccattagaaaaacgtgcggcagaaattctaaaaagtgcggtagaaaatcccattgttattgcagatttaatcaaccctgaacgttgtcccaccgaattactgccttatttagcttgggcgttttcagtggataaatgggatgaaaactggacagaagaagttaaacgcattgcgattaaacagtcttattttgtacacaaacacaaaggcacgattggcgcagtaaagcgtgtggttgagccaataggctatcttattgaactgaaagaatggtttcaaacaaatccgcaaggcacaccaggaacatttagcctaaccgtagaagtgtctgaaagtggcttgaatgaacaaacctataacgaactagtgcgactgattaatgatgttaaacccgtctcaagacatctcaatcagctcgctatcgccctctccccaacagggtcactttgtgcctttgttggtcagcaatggggcgaaatcatcacggtatatccacaa

SEQ ID NO: 4406 - protein, 179 aa, Haemophilus influenzae
  Name: NTH2461
VMITNHLLPIGATPLEKRAAEILKSAVENPIVIADLINPERCPTELLPYLAWAFSVDKWDENWTEEVKRIAIKQSYFVHKHKGTIGAVKRVVEPIGYLIELKEWFQTNPQGTPGTFSLTVEVSESGLNEQTYNELVRLINDVKPVSRHLNQLAIALSPTGSLCAFVGQQWGEIITVYPQ

SEQ ID NO: 4407 - DNA, 2583 bp, Haemophilus influenzae
  Name: NTH2462
ttgtgcctttgttggtcagcaatggggcgaaatcatcacggtatatccacaataggaatatttatggcatcacaatattttgcaatcttaaccgactacggaacacgtgctatcgctcacgcattaagccaagggcaaccgttacagctcacccaatttgcagtgggtgatggcaatgggaaagcggtcacaccaacggcgaacgcaacagctctcgtacatcaaacgcacattgcacctgtcagtgccgtctctctcgaccctcgcaataataaacaagtcatcgttgaattaaccatccctgaaaatatcggcggtttttacataagagaaatgggcgtatttgacgcacaaaacaaactcattgcctacgcaaactgtcctgaaagttttaaaccgacagaaagtagcggaagtggtaaagtccaagtattgcggatgatcttaaaagtagaatcttctagtgcggtgacattatctattgataacagtgtgatttttgtcacccgacaacaaatgacaccaaaaaccattactgccacaacgcaaaatggatttaatgaaagcggacacagccaccaaatagccaaggcaagcaccacacaacaaggtatagtccaactcaccaacgacacagggcttgaaagtgaatctcttgcactcaccgcaaaagcagggaaaaaactcgctcaacaaacaacacaattacagttaaatgtctcgcaaaattacatccaaaacagcaaaaaatcctctgcagtaaatagcgaaagcgaagataacgtagcgacaagtaaagcagccaaaaccgcctatgacaaagcagtagaagccaaaactaccgcagatggaaaggttggtttaaatggtaacgaaagcattaatggcgagaaatcctttgaaaatcgtattgtggcaaaaagaaatatccgtatttcagacagccagcattatgcttcacgcggagactatttaaatatcggggcaaacaatggcgattgctggttcgaatataaatcaagcaaccgagagattggcacgcttcgtatgcacgctaacggcgatttaacctacaaacgccaaaaaatctaccacgctggggcaaaaccccaatttaatacggatattgaaggcaagcctaatacacttgcaggctatggtattgggaattttaaagtagaacaagggcagggcgatgccaatggctataaaaccgatggcaattattacttagcaagcggtcaaaatctacccgaaaatggggaatggcatattgaagtagttagcggtggggcaacaaatgcggtgcgtcaaattgcacgtaaagcgaatgataacaaaatcaaaacacgcttttttaatggctcaaattggtcagaatggaaagatgcaggcggcgacggcgtgcctattggtgcagtggtgtcattccctcgtgcggtaactaatcccgttggttttttaaaagcagatggctcaacatttaaccaacaatccttccccgatttataccgcactttgggcgacagcaaccaacttcctgatttaactcgtagtgatgtggggatgacagcttattttgccgtggataatatccctgcaggctggattgcctttgattcaatcagaacaaccgttacacagcaaaattaccctgagttatatcgttacttagtcggtaaatatggttctatttcaaatgtgccattagctgaagaccgatttattagaaatgcatcaaacaatttatctgttggtgaaacgcaaagtgatgagattaaaaagcacgttcacaaagtgagaacacactgggttaattcaagtgatagtaatattttttatgacaaaacgaaaacagttatagattcacgattacgcactgcaactacaactgatgataatctcagtgataatggatttatgcatccgctattagatagcccaatggctacggggggagctgaaacaagaccgcgagcgattgctctcaaactttgtataaaagcaaaaaacacatttgatgacgtgcaattctgggtgaaggctttcggtgttgttgaaaatgctggggctttagatgcgggtacacttgcgcaaaatatgcaagcgttatctgagcgtgttgaacaaaaaatagaagagaataaacaatcaactttgcgagaaatcaccaatgcaaaagctgatataaatcagcaatttttgcaggcacaagggaatttatctcaaattggcacattaaaaacagtctggcaaggtaacgtgggttctgggcaaattactatatcagagaagtgcttcggtaaaacgttaattttatatcttcaatcatcagtaaatcacagccttgatgataataacgatattgaactcgtcagttttgaagtgggtgcagaaattgaaggtaaaaaaggtggcagagttcgttggcttgatgttcgtgaagtaaatgcacacagcaatggtggtagacctatttattatgtagaagtcaagagattcgatgtgactgttgatagagacggtacaacaatacaaattcaaaatcttgctggtcgttttgtaaaacgtattgatattcga

SEQ ID NO: 4408 - protein, 861 aa, Haemophilus influenzae
  Name: NTH2462
LCLCWSAMGRNHHGISTIGIFMASQYFAILTDYGTRAIAHALSQGQPLQLTQFAVGDGNGKAVTPTANATALVHQTHIAPVSAVSLDPRNNKQVIVELTIPENIGGFYIREMGVFDAQNKLIAYANCPESFKPTESSGSGKVQVLRMILKVESSSAVTLSIDNSVIFVTRQQMTPKTITATTQNGFNESGHSHQIAKASTTQQGIVQLTNDTGLESESLALTAKAGKKLAQQTTQLQLNVSQNYIQNSKKSSAVNSESEDNVATSKAAKTAYDKAVEAKTTADGKVGLNGNESINGEKSFENRIVAKRNIRISDSQHYASRGDYLNIGANNGDCWFEYKSSNREIGTLRMHANGDLTYKRQKIYHAGAKPQFNTDIEGKPNTLAGYGIGNFKVEQGQGDANGYKTDGNYYLASGQNLPENGEWHIEVVSGGATNAVRQIARKANDNKIKTRFFNGSNWSEWKDAGGDGVPIGAVVSFPRAVTNPVGFLKADGSTFNQQSFPDLYRTLGDSNQLPDLTRSDVGMTAYFAVDNIPAGWIAFDSIRTTVTQQNYPELYRYLVGKYGSISNVPLAEDRFIRNASNNLSVGETQSDEIKKHVHKVRTHWVNSSDSNIFYDKTKTVIDSRLRTATTTDDNLSDNGFMHPLLDSPMATGGAETRPRAIALKLCIKAKNTFDDVQFWVKAFGVVENAGALDAGTLAQNMQALSERVEQKIEENKQSTLREITNAKADINQQFLQAQGNLSQIGTLKTVWQGNVGSGQITISEKCFGKTLILYLQSSVNHSLDDNNDIELVSFEVGAEIEGKKGGRVRWLDVREVNAHSNGGRPIYYVEVKRFDVTVDRDGTTIQIQNLAGRFVKRIDIR

SEQ ID NO: 4409 - DNA, 600 bp, Haemophilus influenzae
  Name: NTH2463
atgaaagtctattttttaaaagaaaatttgaatagttatcaaattttccctattcctcaaaacttaaatgattttgtggaaatggaagtagaaaacgaatcagagcttgagactaaacaacttattgattttaaaagtcaatacattctagttgatagacaaccaacagaattacacaaatggaacggaaacagctgggttgttgataaaaaaaagaaaactgaaattaagcgtgaactcattaaaaatctagttgatagcattgatgatacagcagctaacattagtgcaagatggacaaggtttgccgaagagtataaggagcgagaagctgccgctattgcctttaaagaagcaaattttgctggagaagtaagcgtttatatcagcagttttgcaacggttgcaggtcttgataatcagtctgcgtcacttttgattcttcagcaagcagaaagcttgcgtacattgcaacaacaattagcagtgcaaagaatgcgtaagtatgagttaaagcatgaggcgttgagtgatgaagaactgcaacgtattcatgacgatattataggtaaaatgcaaacattagcggaggcacaacaa

SEQ ID NO: 4410 - protein, 200 aa, Haemophilus influenzae
  Name: NTH2463
MKVYFLKENLNSYQIFPIPQNLNDFVEMEVENESELETKQLIDFKSQYILVDRQPTELHKWNGNSWVVDKKKKTEIKRELIKNLVDSIDDTAANISARWTRFAEEYKEREAAAIAFKEANFAGEVSVYISSFATVAGLDNQSASLLILQQAESLRTLQQQLAVQRMRKYELKHEALSDEELQRIHDDIIGKMQTLAEAQQ

SEQ ID NO: 4411 - DNA, 498 bp, Haemophilus influenzae
  Name: NTH2464
atgataggcgctaaaatctatctcgcattatacaaaggtaaaaaaacgggtaaaaacccgagcgcacttttggcacgtttgagtgactggctcactcgtaaattgacaaaaggcgtgtattcgcattgtgaaattgcagtaatgaaagaagtatttgtcagtgggcatcactatgaaacagaagtgatgtacgagtgttattcgtcttcaattcgagacggcggtgtacgttgtaagcaaattgatgtttatgatagagaaaaatgggatttaattgagctagagggagttactgaagcacaaatcaaagcttattttgaccgcactttgggctgtaaatatgactggtggggtgcgttagggattgtgctaggcatcaaacaaaaacgctcaaaatatttttgcagtgaatggtgttttaatgcgatttgcggtagcgagagcggttggagatttagcccaaatcaactagcggctatatttaataaagagaaaagt

SEQ ID NO: 4412 - protein, 166 aa, Haemophilus influenzae
  Name: NTH2464
MIGAKIYLALYKGKKTGKNPSALLARLSDWLTRKLTKGVYSHCEIAVMKEVFVSGHHYETEVMYECYSSSIRDGGVRCKQIDVYDREKWDLIELEGVTEAQIKAYFDRTLGCKYDWWGALGIVLGIKQKRSKYFCSEWCFNAICGSESGWRFSPNQLAAIFNKEKS

SEQ ID NO: 4413 - DNA, 447 bp, Haemophilus influenzae
  Name: NTH2465
ttgttcagtgggcaacaagtggcaacgtttgatgacttattccaacataatttctggcattgtattcgtcagtctgattatccaaaggctgatggctatttggacggcgtagagattgtgaaagaatcattccacacgcttttgcctaagtttagcgatgatccgaaagcgttatttgtgttagatccgccttacctttgtaccaagcaggaaagctacaaacaagccaaatattttgacctgattgacttcttgcgattggtcaatatcacgcgaccgccgtatgttttctttagctcaacgaagtcggagtttattcgctttatgaattatatgctggaagataaggtggataattggcaggcgtttgaaaacgccaaacggattacggtcaatgccaagctgaactaccaagtggcgtacgaggacaatttagtctataaattt

SEQ ID NO: 4414 - protein, 149 aa, Haemophilus influenzae
  Name: NTH2465
LFSGQQVATFDDLFQHNFWHCIRQSDYPKADGYLDGVEIVKESFHTLLPKFSDDPKALFVLDPPYLCTKQESYKQAKYFDLIDFLRLVNITRPPYVFFSSTKSEFIRFMNYMLEDKVDNWQAFENAKRITVNAKLNYQVAYEDNLVYKF

SEQ ID NO: 4415 - DNA, 261 bp, Haemophilus influenzae
  Name: NTH2466
atgacaaattttcaaatgagaaccgagcaggaaatgatgatggaattagcccttattgcagtgaaagaacacgacggttttattgtagacggttcgcaatattcactgcctaacgaatgcgggcaaacttttgtctataacacggcatttttagatgtgcgttttgtggaagacggacgcaaagattgcgtggtgagatttacgtccacgctcgcccctttcgccccaccgttttattgcttgctttccgaattagaagac

SEQ ID NO: 4416 - protein, 87 aa, Haemophilus influenzae
  Name: NTH2466
MTNFQMRTEQEMMMELALIAVKEHDGFIVDGSQYSLPNECGQTFVYNTAFLDVRFVEDGRKDCVVRFTSTLAPFAPPFYCLLSELED

SEQ ID NO: 4417 - DNA, 141 bp, Haemophilus influenzae
  Name: NTH2467
gtgccaacgcttgccattcttgataattgtcgccattgtttattccataaaaatgtgtgcaatacacgtgtgcaaaaatatgtgcaatggagtatagaacagatcgaaatcgatcccaatcggtataaaaatactaccttt

SEQ ID NO: 4418 - protein, 47 aa, Haemophilus influenzae
  Name: NTH2467
VPTLAILDNCRHCLFHKNVCNTRVQKYVQWSIEQIEIDPNRYKNTTF

SEQ ID NO: 4419 - DNA, 111 bp, Haemophilus influenzae
  Name: NTH2468
gtgtattgcacacatttttatggaataaacaatggcgacaattatcaagaatggcaagcgttggcacgcacaagtgcgcaagtttggcgtgagcaaatcagctactttttt

SEQ ID NO: 4420 - protein, 37 aa, Haemophilus influenzae
  Name: NTH2468
VYCTHFYGINNGDNYQEWQALARTSAQVWREQISYFF

SEQ ID NO: 4421 - DNA, 258 bp, Haemophilus influenzae
  Name: NTH2469
gtgagcaaatcagctactttttttgactcaagcagacgcaaaaaatgggcagaaatgctcgaaaaacagctcgaatcaggaaagtataatgaaatccctgatattacattggatgaactgattgataagtatctaaaagaagtcactgtaaccaagcacgggaaacgtgaagagcgcataagactactgcgtctttctcgaactccgcttgccgcaatatctttacaagaaataggaaaagcacactttcgtgagtgg

SEQ ID NO: 4422 - protein, 86 aa, Haemophilus influenzae
  Name: NTH2469
VSKSATFFDSSRRKKWAEMLEKQLESGKYNEIPDITLDELIDKYLKEVTVTKHGKREERIRLLRLSRTPLAAISLQEIGKAHFREW

SEQ ID NO: 4423 - DNA, 696 bp, Haemophilus influenzae
  Name: NTH2470
atgggattttataacagcccccccctaaaatatcttgagaaaccaaaagcaccagcgccaagaactcgtcgatataatgaacatgaaattgagcgtctgatttttgtgtcaggttatgatgtcgaacatattgaaccgccaaaaaccttacaaaattgcacgggggcggcatttctttttgctatagagacagcaatgagagcaggggaaatagcaagtttaacttggaataatatcaattttgaaaagcgcaccgcctttttgccaattactaaaaatggacattcaagcacggtgcctctttcggtaaaagcaatagcgattttacaacatcttacttcggtaaaaacagaaagtgatctgcgagtattccaaatggaagcacgccaactggatcacaacttccgcaagctcaaaaagatggaagggcttgaaaatgccaatttacattttcacgacacccgccgtgaacgattggcagaaaaagtggatgtaatggtattagccaaaatatcgggccatagagatctcagtattctgcaaaatacttattacgcacctgatatggcagaaggctataaaacaaaggcgggttatgatctgaccccaaccaaaggcttgagccaacggaattttttcttctttaatgaaaacttcatcgttttcacaacaaatccaccgatagtcattaagctg

SEQ ID NO: 4424 - protein, 232 aa, Haemophilus influenzae
  Name: NTH2470
MGFYNSPPLKYLEKPKAPAPRTRRYNEHEIERLIFVSGYDVEHIEPPKTLQNCTGAAFLFAIETAMRAGEIASLTWNNINFEKRTAFLPITKNGHSSTVPLSVKAIAILQHLTSVKTESDLRVFQMEARQLDHNFRKLKKMEGLENANLHFHDTRRERLAEKVDVMVLAKISGHRDLSILQNTYYAPDMAEGYKTKAGYDLTPTKGLSQRNFFFFNENFIVFTTNPPIVIKL

SEQ ID NO: 4425 - DNA, 279 bp, Haemophilus influenzae
  Name: NTH2471
atgacaaaacgttgtgatcagcctatttgtattgagtatgaagaatgcgaaccgaataaatacggtgagattcgtaagaaaattgtgggggtaaaaaacagattcacagaaaagaaaatcatcaccaaattaaaaaactgggtgattaaatcagcgaaaagtgcgttgggttccaccgcacttaattcggagaccaccgaacaaacaaggcgcatcgagccgcttggacttgtgtcaataactgtaaccgttcaaaaattgaacatcaagctaatctat

SEQ ID NO: 4426 - protein, 93 aa, Haemophilus influenzae
  Name: NTH2471
MTKRCDQPICIEYEECEPNKYGEIRKKIVGVKNRFTEKKIITKLKNWVIKSAKSALGSTALNSETTEQTRRIEPLGLVSITVTVQKLNIKLIY

SEQ ID NO: 4427 - DNA, 237 bp, Haemophilus influenzae
  Name: NTH2472
ttgtcattgcgccaccttgcgcaaactatcactcaacaaatcattttgccgtatttgcaaattaatgttgatccgaatattgcgccacatcgtatcccttattttgagtttgacacaaaagaatatgaagacttatcggtatttgcagatgccatccctaaacttacgggcattggcgtgcagatttcggaaagttgggtgtgggataaattagggattcctgaaccgcaggaaggt

SEQ ID NO: 4428 - protein, 79 aa, Haemophilus influenzae
  Name: NTH2472
LSLRHLAQTITQQIILPYLQINVDPNIAPHRIPYFEFDTKEYEDLSVFADAIPKLTGIGVQISESWVWDKLGIPEPQEG

SEQ ID NO: 4429 - DNA, 714 bp, Haemophilus influenzae
  Name: NTH2473
ttgaaacgccgtgggattgataagcctgacgacagttctgaatttttggtggaagtagaacgcccagcagataagcaaggtaatcgtgaaaagacggtagggtttaaattgcctgatggcacgatacgtgtgacggataaaggctttgattacaatgtagggcgattaaactacaagcctaatttggatctttatcctgaaaaactggcgcatgcgtttgcgaaggttgagatgaaaggtggggagtttaagcacgattttgagttgttggcaaagcatatggcggagatgaaacaaacgctcagcctagatggaaaaaaactcactgttgatcaaatgttacaggtgcgagatagtcttaccaaaaattttaaatttgcggcaggtgtcttgagtgcggaaagtaaggatttattgaaaagcaaaactggcacagtgtggctttctgatgatactttaattaaacagtttaatagccgtgatgggcaagattttggactggaaagctatgcacttttccctgatttatttaatcagcctgatattgttctacaagataatgatcgtttttattttatcaaaaactttgagaaacagcgtattttaggtgtaataaagcacttatctaaatttaatgaaatttttgtgctttcggcaagggagattaatatcaaggaagtagaaaaaatgaaaggtaaattggcagttatcaag

SEQ ID NO: 4430 - protein, 238 aa, Haemophilus influenzae
  Name: NTH2473
LKRRGIDKPDDSSEFLVEVERPADKQGNREKTVGFKLPDGTIRVTDKGFDYNVGRLNYKPNLDLYPEKLAHAFAKVEMKGGEFKHDFELLAKHMAEMKQTLSLDGKKLTVDQMLQVRDSLTKNFKFAAGVLSAESKDLLKSKTGTVWLSDDTLIKQFNSRDGQDFGLESYALFPDLFNQPDIVLQDNDRFYFIKNFEKQRILGVIKHLSKFNEIFVLSAREINIKEVEKMKGKLAVIK

SEQ ID NO: 4431 - DNA, 144 bp, Haemophilus influenzae
  Name: NTH2474
ttgcatgaatatacccccttaaattttaaaaatcaacaattacttcctcaaatttttatgcgagcaaaagggcgatcgattcgtttgattgggttacatgtcaatttacccgaagaaaataaacaagaacaaatgagcctctgg

SEQ ID NO: 4432 - protein, 48 aa, Haemophilus influenzae
  Name: NTH2474
LHEYTPLNFKNQQLLPQIFMRAKGRSIRLIGLHVNLPEENKQEQMSLW

SEQ ID NO: 4433 - DNA, 534 bp, Haemophilus influenzae
  Name: NTH2475
atggaacataaattagaagatattattgcaatttttaatcaatgttttgaagaggaatacaacactcgcttagtcaaaggcggtgatgagcccatttatttacccgcaaatgatgaagtgccttataacgcgatttattttgcgcgaggcttttacagcagtgcattgcacgaaattgcccattggttagtggcaggcaaagaacgccgtaaactagaagattttggttattggtatgagccagatggacgttcagaagaacgtcagcgtgattttgaaaaagttgaagttaaaccgcaagcattagagtggattttggcaacggcggcaggtttccgttattttgccagtgcggataatttgaatggcaatccgggcgatacacagccttttaaacaagccgtgtatgaacaagtgaaaatctatgcggaaaaaggtttaccaaaacgagcggaaatgttacgcaaggcgttagtggcattttatggcacagaagatgaaattgatctggcgaagtttgatgtcgtgcgtatt

SEQ ID NO: 4434 - protein, 178 aa, Haemophilus influenzae
  Name: NTH2475
MEHKLEDIIAIFNQCFEEEYNTRLVKGGDEPIYLPANDEVPYNAIYFARGFYSSALHEIAHWLVAGKERRKLEDFGYWYEPDGRSEERQRDFEKVEVKPQALEWILATAAGFRYFASADNLNGNPGDTQPFKQAVYEQVKIYAEKGLPKRAEMLRKALVAFYGTEDEIDLAKFDVVRI

SEQ ID NO: 4435 - DNA, 207 bp, Haemophilus influenzae
  Name: NTH2476
gtggcgattgcacaaggatctagcgaacgttcaatttctgcggttgtgccgcaaaataaagccattgaagcggtgaaggctacccatcaggcgcttttcaataataaaaaagtcgtggatatgtttttagtgggcgttggtggagtaggccggagaattaatagagcaggtaaagcgtcaaaaggagtatctagcaaagaagaatgt

SEQ ID NO: 4436 - protein, 69 aa, Haemophilus influenzae
  Name: NTH2476
VAIAQGSSERSISAVVPQNKAIEAVKATHQALFNNKKVVDMFLVGVGGVGRRINRAGKASKGVSSKEEC

SEQ ID NO: 4437 - DNA, 921 bp, Haemophilus influenzae
  Name: NTH2477
atgttgcttgatgaaaatggattaaatttagaggattggaaaaacgatttagaaaatgcgactcagccatcagattttgatgtattgctttctttcattaaattacatcatgtggtgaatccagtatttgtagattgtacttcagccgaatctgtagcagggctttatgctcgtgcgttaaaagaaggtttccatgtggttacgccaaacaaaaaagcgaatacacgagaattagtttattacaatgagttacgccaaaatgcccaagcaagccagcataaatttttatatgaaaccaatgtaggtgcgggcttgccagttattgaaaatctccaaaacttacttgcagcaggtgatgagcttgaatattttgaagggattttatctggctcgctttcctttatttttggtaagttggaagaaggactttctctttcagaagtaaccgcacttgcgcgtgaaaaaggctttactgagccagatcctcgagatgatctttctggacaagatgtagcgcgcaaattattaattcttgctcgtgaagcgggaattgaacttgaactttcagatgttgaagttgaaggtgtattgccgaaaggcttctctgaaggaaaatctgcagatgagtttatggcaatgttgccacagcttgacaaggagtttaaaactcgcgttgccacagctaaagcagaaggcaaagtattgcgttatgttggaaaaattagtgaaggaaaatgcaaagtatccatcgttgcggtagatctgaataatccactttataaagtgaaagatggtgaaaatgccttggcattttatactcgttattatcaaccgattccacttttattacgtggttatggcgcaggtaatgcagttactgcggcaggtatctttgcagatattttaagaacattacaacat

SEQ ID NO: 4438 - protein, 307 aa, Haemophilus influenzae
  Name: NTH2477
MLLDENGLNLEDWKNDLENATQPSDFDVLLSFIKLHHVVNPVFVDCTSAESVAGLYARALKEGFHVVTPNKKANTRELVYYNELRQNAQASQHKFLYETNVGAGLPVIENLQNLLAAGDELEYFEGILSGSLSFIFGKLEEGLSLSEVTALAREKGFTEPDPRDDLSGQDVARKLLILAREAGIELELSDVEVEGVLPKGFSEGKSADEFMAMLPQLDKEFKTRVATAKAEGKVLRYVGKISEGKCKVSIVAVDLNNPLYKVKDGENALAFYTRYYQPIPLLLRGYGAGNAVTAAGIFADILRTLQH

SEQ ID NO: 4439 - DNA, 942 bp, Haemophilus influenzae
  Name: NTH2478
atgttaagaatttacgctcctgcatctagcgcgaatattagcgtaggtttcgatactttaggtgctgcgatctctcctattgatggttctttgttaggcgatgtggttcaaatagaatctatttcaagtggttttgagttagaaagtgcgggctattttgttcgtaaattaccgaaagaaccacaaaaaaatattgtttaccaagcttatgtgctatttagcgagcaattaaaattacgcggagcaaatgttaaacctttacgtttaacgctcgaaaaaaatatgcctattggctctggtttaggctctagtgcttgttctattgttgctgcattagtggcattaaatcagtttcataatgaacctttttcgaaaatggaattgcttgaaatgatgggagaattggaaggtcgtatttctggttcaatccattatgataacgtcgcaccttgctatcttggcggtgtgcaatttatggtgcaatcgctcggcaatatttgtcaaaaattgccattttttgataattggtattgggtgttagcctatccagggattgaagtttctactgctgaagctcgtgcaattttaccgaaaagctatactcgacaaaacgtgattgcccatggtcgtcatttaggtggctttgtgcatgcttgccatacccatcaggaaaatcttgccgcgattatgatgaaagatgtcattgccgagccttatcgtgaatctctgttacctaattttgctgaagtaaaacaagctactcgagacttaggcgcacttgccacaggtatttcaggctcagggccaactattttctctattgcccctgatttacaaactgcaattaaactttcaagttatttagaaagccattatttacaaaataatgaaggttttgtgcatgtatgtaaagttgataacgaaggcacaagagaaattaaa

SEQ ID NO: 4440 - protein, 314 aa, Haemophilus influenzae
  Name: NTH2478
MLRIYAPASSANISVGFDTLGAAISPIDGSLLGDVVQIESISSGFELESAGYFVRKLPKEPQKNIVYQAYVLFSEQLKLRGANVKPLRLTLEKNMPIGSGLGSSACSIVAALVALNQFHNEPFSKMELLEMMGELEGRISGSIHYDNVAPCYLGGVQFMVQSLGNICQKLPFFDNWYWVLAYPGIEVSTAEARAILPKSYTRQNVIAHGRHLGGFVHACHTHQENLAAIMMKDVIAEPYRESLLPNFAEVKQATRDLGALATGISGSGPTIFSIAPDLQTAIKLSSYLESHYLQNNEGFVHVCKVDNEGTREIK

SEQ ID NO: 4441 - DNA, 1275 bp, Haemophilus influenzae
  Name: NTH2479
atgaatttatacaatatcaaacacccagaagaacaagtcactttttctcaggctgttcgtcaaggtcttgggtgggatcaaggtctattctttccagaagttattcctaaacttaataacattaatgaattacttgaattgcctcttgttgagcgtagtcaaaaaattctaggtgcattaattgatggcgagttaccacaagcaacgttagatgcaatggtaaaaaatgcgtttactttcactgcaccgttagaaaaagtggaagataatatttatgcacttgaattatttcacggtccaacgctagcatttaaagattttggtgggcgttttatggcacaggcacttgctgcggtacgtggcgatggcaaaattactattttaacggcaacctcaggcgatactggagccgctgtagcacatgcgttttatggattagaaaatattaatgtagttatcctttatccaaaaggcaaaattagcccattacaagaaaagctattctgtactttaggtgggaatattcgtactgttgcgattaacgctgatttcgatgcgtgtcaggctttggttaagcaagcctttgatgatgttgaattgcgccaagctatcgggctgaactctgcaaattctattaatatcagccgtttattagctcaagtttgttattactttgaggctgtcgcacaattgccaaaagaaaaacgtgataatgtcgtggtttctgtgccaagtggtaattttggtaacttaacggcgggattaattgcaaaaaccttaggcttgccgataaaacgctttgtcgcctcaacaaacgcaaatgatactgtgccacgttatttgaaatcgggtaattgggatcctaaaacgacagttgcaaccctttctaatgcaatggatgtaagtcgcccaaacaattggccgagagtggaagaattgtttaaacgaaatggttgggatttaactgatttaggttcggggatgctaagtgatagcgaaacagaagataccttaaaagcgatgcagtcgaaaggttatttatgtgaacctcacggtgcgatagcttatcaggtgttgaaagagcaacttaaagcgagtgaaacaggaatcttcttgtgtacggcgcatcctgcgaaatttaaagaatccgtagaacgtattcttggtattcagcttccattacctgaaacactggataaacataatcagctaccattgctttcagatgaaatggataatgattttgcacaactacgggcttacttattgaagtca

SEQ ID NO: 4442 - protein, 425 aa, Haemophilus influenzae
  Name: NTH2479
MNLYNIKHPEEQVTFSQAVRQGLGWDQGLFFPEVIPKLNNINELLELPLVERSQKILGALIDGELPQATLDAMVKNAFTFTAPLEKVEDNIYALELFHGPTLAFKDFGGRFMAQALAAVRGDGKITILTATSGDTGAAVAHAFYGLENINVVILYPKGKISPLQEKLFCTLGGNIRTVAINADFDACQALVKQAFDDVELRQAIGLNSANSINISRLLAQVCYYFEAVAQLPKEKRDNVVVSVPSGNFGNLTAGLIAKTLGLPIKRFVASTNANDTVPRYLKSGNWDPKTTVATLSNAMDVSRPNNWPRVEELFKRNGWDLTDLGSGMLSDSETEDTLKAMQSKGYLCEPHGAIAYQVLKEQLKASETGIFLCTAHPAKFKESVERILGIQLPLPETLDKHNQLPLLSDEMDNDFAQLRAYLLKS

SEQ ID NO: 4443 - DNA, 714 bp, Haemophilus influenzae
  Name: NTH2480
gtgacttggaacagctatattcgtcagctaaagactattttcaaatttggaattgaaaaacaactcctcccatttacaaagaaccctttcgatggtttgttcattagagaaggaaagaagaaaaggaaagtatatacttcttcagatttaaaaaaacttagctttggaattactgaatcaaagcatcttccttctattcttcgcccattatggtttactaaaactataattatgactttccgctatacggcaattcgacgctctcagttaaataaattaagaattaaagatgtagatttgctaaatcaagttattcatattccatctgagataaataaaaatcacgagtatcatatacttcctatatcaactacactttatccttatctaaagaaattattaactgaactaagtaaattgaatcagcctgtagaatctcaactatttaacattaatttattttcaaatgcagttaaacgaaagggagagaaaatgaccaatgaccaggtgagctatatcttcaaagttatttcaaaatatacaggaattattagctccccacacagatttaggcatacagcagcaacaaatctaatgaaaaaacctgaaaacctatatatagccaaacaattactaggacataaagatgtcaaagttacattgagttatattgaagataatattgattcaataagagaatatacagaattactt

SEQ ID NO: 4444 - protein, 238 aa, Haemophilus influenzae
  Name: NTH2480
VTWNSYIRQLKTIFKFGIEKQLLPFTKNPFDGLFIREGKKKRKVYTSSDLKKLSFGITESKHLPSILRPLWFTKTIIMTFRYTAIRRSQLNKLRIKDVDLLNQVIHIPSEINKNHEYHILPISTTLYPYLKKLLTELSKLNQPVESQLFNINLFSNAVKRKGEKMTNDQVSYIFKVISKYTGIISSPHRFRHTAATNLMKKPENLYIAKQLLGHKDVKVTLSYIEDNIDSIREYTELL

SEQ ID NO: 4445 - DNA, 1926 bp, Haemophilus influenzae
  Name: NTH2481
ttgcaaaaatttatgggttatttttttatgttttcatcaattttttatcgattaaaagggaaaaaacaagattcctttactattccagttctagattcccataaccattcaatgtcaaagattgatagtgagggatggataactccgttctctgcgtcagaattactcaattctgaattacgccaaaaatacttaaatttactttggcaacaagtatcaatgacgcaagatatgtttaatgagctctataaaaaacctatcgagcgctacgctgaaatggttcaattactacctgcctcagaatcacatcatcactcacatttaggtggtatgcttgatcatggcctagaagttctttcatttgcagctaaattacgacaaagttatgtattgccacaaaatgctgctccggaagaacaatctaagcaacgtgatgcttggactgctgctgttatttatgctgcattggttcatgacattggtaaagttattgttgatatagatatacaattaaaagatggttctcgttggtttccttggttaggagtgccaactcaaccttataaattcaaatatattaaagggcgagattatgatcttcacccggttatgggtagttttcttgcaaactatttaattcctaaagaagcatttgcatggttagcagaatacccggaagctttttcagctttaatgtatgccatggctgatcataaagataaagctggtttattatctgaaatagtacaaaaagcagaccaaaacagtgtaactcttgcactaggtggagacgtatcaaaactgactcagaaacctataacatcatttgcaaaacagctagtcatggctttacgtcatttactgcaacataaatttaaaattaatacacctaaaggcccatctgatggttggcttacagaggatgcgctatggttaatgagcaaacccactgcagaccaaattcgagcttatttattggagcaagggatatcagctccagcagacaatcctaaattatttagtgaaatgcaatcgctggggattattgaaagtacaaatgatggtacagcaatttggcattgtcgaattaaagctgattcaggctggtgcccacctaaagcattttctttactcagaattaaaccggaagtagcttgggaaaatcttaatgacagacctggtatatttttaggtcgagtcgatattgaaaatgaagaacaattaaattcaggtgaagatactaaagaagaaaattcagtgattatggaatctgaaatgccacttcctgcaataacaggtacactgaataaaccggatttatctgaaaatacatcctctcaaaacactcaaatcaatacccaaaactcagaaaccgagacggatatgactgatttggtaatgaatttattttcacctgtagaagaatctcaagactctactgataaaaaaccatctcaagaaagtgaaataaataaaatcgcctctaccccatctatagcaacggatgatgatacaaaggaaactgaggctgtctcaggagagatttttgttgaatggctaaaatctggaattatcgggaataccctaactattaataattcaaatgctaaattacatatagtcaaaggcaaacttttccttgtaacacctggaatctttcagctatttttcaatagtaagggcattactaactttactaaaaaagatatcgaaaatttgcaatatagtttccaagaccttaaattacacaagaaataccgtcaatcaaacaatgatagtattaatttttggcgctgtaaggttattggcccaagaagaacctctcaattgattgggtatttgattgataaaaccgactattttttcggtaatagaattccaattgataatttgcatttatcacttattgaggaaaatgaaagtgaa

SEQ ID NO: 4446 - protein, 642 aa, Haemophilus influenzae
  Name: NTH2481
LQKFMGYFFMFSSIFYRLKGKKQDSFTIPVLDSHNHSMSKIDSEGWITPFSASELLNSELRQKYLNLLWQQVSMTQDMFNELYKKPIERYAEMVQLLPASESHHHSHLGGMLDHGLEVLSFAAKLRQSYVLPQNAAPEEQSKQRDAWTAAVIYAALVHDIGKVIVDIDIQLKDGSRWFPWLGVPTQPYKFKYIKGRDYDLHPVMGSFLANYLIPKEAFAWLAEYPEAFSALMYAMADHKDKAGLLSEIVQKADQNSVTLALGGDVSKLTQKPITSFAKQLVMALRHLLQHKFKINTPKGPSDGWLTEDALWLMSKPTADQIRAYLLEQGISAPADNPKLFSEMQSLGIIESTNDGTAIWHCRIKADSGWCPPKAFSLLRIKPEVAWENLNDRPGIFLGRVDIENEEQLNSGEDTKEENSVIMESEMPLPAITGTLNKPDLSENTSSQNTQINTQNSETETDMTDLVMNLFSPVEESQDSTDKKPSQESEINKIASTPSIATDDDTKETEAVSGEIFVEWLKSGIIGNTLTINNSNAKLHIVKGKLFLVTPGIFQLFFNSKGITNFTKKDIENLQYSFQDLKLHKKYRQSNNDSINFWRCKVIGPRRTSQLIGYLIDKTDYFFGNRIPIDNLHLSLIEENESE

SEQ ID NO: 4447 - DNA, 1251 bp, Haemophilus influenzae
  Name: NTH2482
atggttataagtacaggattaaaatgtgagttatgcggacatcgctacagaataagggttggagttgggtttgattcttatcagaaacactattttgattgttctaattgcaatattaatatagtctttgctataaggactaagcctccaagagctgatgtagaagccgtagaaaattgctctcttttttcgggagagcctaatattgaactcgaagtcttaaattttcacccaaattgtgcatttaataaacatgatttacataatcctttttgttttcctacattaatttcggggcctctaataattccacatatgaggtatataccaggtagaatgcaaagttttgataatcaatttgatataccaaatgcaccacacaaatggtctttgattaaaggaatgataactaatatccaagataacaaaaaagcttcaaattttgttttgcaatacactaaacatagaaacaaggatatgaacccatcatcatctaattttatgcgcgataaagaaattatagtttataaatcaggtagtgtttatagtgaatttcatatcattcatgaattttttgattcccttttttaccctatgttagaaaacattgtagaaccgataattaatacgattaaaaatattcctgaaagcaagctttctagttttattaggtattggcagagtgagttaaaacaagaaaatcaatatcgctatttaaatacattctctgaatattttcgccatagagatcacttcggtcaaatagtaatgtattctagaatcggacataatgttgatgatttaatagtgtcatctaatgggtttgagcagataaagctatattatggagatgcctatgaagcgctaacttcaaatatgactattattgcttgtttgaataatatcatggacggtagagagtttgatgaatttaagtcaatgaagctatcaaaatacctagaaataaataaagcaaataaatcaaatccatttaaattaactcctatattttcggtctttgcagaaaatgatattgaatcttctattcgaaatggttctcatcatgcgtcaatatggcgtgatggtgaaaaaataatgtataaaagtggagggactggagctgaacattgcattccatacactcgatatctggattattgtaacaggttgaccattaaattagccgctttatttataatagaatgctaccttagtgaatacgttaatgattcaaaaagttttgtagtaaat

SEQ ID NO: 4448 - protein, 417 aa, Haemophilus influenzae
  Name: NTH2482
MVISTGLKCELCGHRYRIRVGVGFDSYQKHYFDCSNCNINIVFAIRTKPPRADVEAVENCSLFSGEPNIELEVLNFHPNCAFNKHDLHNPFCFPTLISGPLIIPHMRYIPGRMQSFDNQFDIPNAPHKWSLIKGMITNIQDNKKASNFVLQYTKHRNKDMNPSSSNFMRDKEIIVYKSGSVYSEFHIIHEFFDSLFYPMLENIVEPIINTIKNIPESKLSSFIRYWQSELKQENQYRYLNTFSEYFRHRDHFGQIVMYSRIGHNVDDLIVSSNGFEQIKLYYGDAYEALTSNMTIIACLNNIMDGREFDEFKSMKLSKYLEINKANKSNPFKLTPIFSVFAENDIESSIRNGSHHASIWRDGEKIMYKSGGTGAEHCIPYTRYLDYCNRLTIKLAALFIIECYLSEYVNDSKSFVVN

SEQ ID NO: 4449 - DNA, 711 bp, Haemophilus influenzae
  Name: NTH2483
atgaatttaagtattactaattttatcacatctttttctagagagcggatttctgtttatcaaaactacattcattcttctgaacctaatctatctcctgctgatattagcttgaaatcactaaaattatatttgtggaatattcagatttcatcagcactttttgaagtaataaacttatatgaagttacgttaagaaacaaaatctttgctgtagtgaatagtgaatttagcgattcaattaatgattactacttcaagaagcgcttaagctccttctttagagataagttgaatgaattgggagcttcaactatcagtgcaccaatgatcgtatctagattaaacttcgctttttggaccgaagtattgaataaacatttctattattctggtagtgtaggtaagtctgggcatccactataccctcgcttatataatttcaatagttccttgttttcaataaataggaagctaactagagaagattataacaagctaacccaaaaactaatcaaaattaatgatgaggtgaatgaattaagaaatagaatttgtcatcacgagcctattttcaagtctaaactaagagctatttatataaagatgctatttgttctcagatgtttggatacgaatgtctataaattggcaaaagaaattgaacgcgtaaataaattactaaaaaaatttgaagatgagataaatccc

SEQ ID NO: 4450 - protein, 237 aa, Haemophilus influenzae
  Name: NTH2483
MNLSITNFITSFSRERISVYQNYIHSSEPNLSPADISLKSLKLYLWNIQISSALFEVINLYEVTLRNKIFAVVNSEFSDSINDYYFKKRLSSFFRDKLNELGASTISAPMIVSRLNFAFWTEVLNKHFYYSGSVGKSGHPLYPRLYNFNSSLFSINRKLTREDYNKLTQKLIKINDEVNELRNRICHHEPIFKSKLRAIYIKMLFVLRCLDTNVYKLAKEIERVNKLLKKFEDEINP

SEQ ID NO: 4451 - DNA, 276 bp, Haemophilus influenzae
  Name: NTH2484
atgttaaatgtctttttaaaattactaccattctttttaataagcttaatggttgaagcaaatatcagagaaccgcacatcgggggaatctgtcatgtagaagccgaatatttttaccctggagtgtgggaaaaatatggagaaagtgaattaatctgtaactattggaaatttctaggagacgaagatcggcaagtattagagtcgcaactatcaggtgatgagtcagatggtgaatatggtgattacgatagcttaaatgaaatggatagtgaa

SEQ ID NO: 4452 - protein, 92 aa, Haemophilus influenzae
  Name: NTH2484
MLNVFLKLLPFFLISLMVEANIREPHIGGICHVEAEYFYPGVWEKYGESELICNYWKFLGDEDRQVLESQLSGDESDGEYGDYDSLNEMDSE

SEQ ID NO: 4453 - DNA, 252 bp, Haemophilus influenzae
  Name: NTH2485
ttgaacaaaggagtatttatgaaaggctatgaaattgaacttgaggacaaaggacaggatttcacaaagttaagaacggatgaacaaggtatagtgatagcagccgaaccatatcaaacagatgtatggaaaggggctttaattcctatttctcaacaaaaaataggtgatttatgtatgattcatcatttaccgcatattgaatatggttatctgaaatacaaagtgttagccattaaagagattaactat

SEQ ID NO: 4454 - protein, 84 aa, Haemophilus influenzae
  Name: NTH2485
LNKGVFMKGYEIELEDKGQDFTKLRTDEQGIVIAAEPYQTDVWKGALIPISQQKIGDLCMIHHLPHIEYGYLKYKVLAIKEINY

SEQ ID NO: 4455 - DNA, 303 bp, Haemophilus influenzae
  Name: NTH2486
ttgaacaaaggagtaaaaatgcagtttaaaagtgtttctttcaaggtttttgtgtctgccaacatgcttatgctggggttatttgctttttttcttgctcctgcaattttacttaaacagcttgaatttaatggagctgaaatagttgaacttttaagtatttatatgggaatgaccgctgttatctctgctgtttgttttcttacaaagaagatcggtatcgcaaagtattttttagtggaatttatattgctagcgataatttttgcatatttaggatataaatttaatgttttgaatttt

SEQ ID NO: 4456 - protein, 101 aa, Haemophilus influenzae
  Name: NTH2486
LNKGVKMQFKSVSFKVFVSANMLMLGLFAFFLAPAILLKQLEFNGAEIVELLSIYMGMTAVISAVCFLTKKIGIAKYFLVEFILLAIIFAYLGYKFNVLNF

SEQ ID NO: 4457 - DNA, 189 bp, Haemophilus influenzae
  Name: NTH2487
atggactatgattatcaaaaaggctttgaagaaggttatagaatgattatgggagcatccgcattgctacctttagcacctattcaaccattgacgccgcttggaagcactccatttagagagggtttaaaagctggtataaatttagctaaaagaaataaccaacagtcatttaataacatttttaaa

SEQ ID NO: 4458 - protein, 63 aa, Haemophilus influenzae
  Name: NTH2487
MDYDYQKGFEEGYRMIMGASALLPLAPIQPLTPLGSTPFREGLKAGINLAKRNNQQSFNNIFK

SEQ ID NO: 4459 - DNA, 597 bp, Haemophilus influenzae
  Name: NTH2488
atggcattaataggatttgctcgagtatcaactcaacagcaggatctaagtgaacagattcaagtattaaaagaatacggctgtaagaaaattttttcagggaagcattccggtaaagctgagaaaaataaagcacaattggatgaactactggattatgtccgagagggtgatgttgttgcagtaactaagcttgaccgcctaggaaggagccttgctcagtgtttgaatacacttgaactatttaagaataaaaatattggttttgttgcaatacaacaaggaatagatacccgaacccaaaacaatcctatggggatggccttaattcaattgttaggtatttttgctgaattggaaagaagttttattgtcgagcgtactcaggaagggaagcgaacaaaacttgcttcaggtcataaaaatgcattaggcggccgcccacctaaagtgacagataaaatacgtaaaaagatttatgcggattttaaagctggtgattctatttcaacagtaatgaaacgatatgatttatctaaatcaacggtggcgagactaaaaggtatttataatagggaaaatttaatggctgaagag

SEQ ID NO: 4460 - protein, 199 aa, Haemophilus influenzae
  Name: NTH2488
MALIGFARVSTQQQDLSEQIQVLKEYGCKKIFSGKHSGKAEKNKAQLDELLDYVREGDVVAVTKLDRLGRSLAQCLNTLELFKNKNIGFVAIQQGIDTRTQNNPMGMALIQLLGIFAELERSFIVERTQEGKRTKLASGHKNALGGRPPKVTDKIRKKIYADFKAGDSISTVMKRYDLSKSTVARLKGIYNRENLMAEE

SEQ ID NO: 4461 - DNA, 366 bp, Haemophilus influenzae
  Name: NTH2489
gtgatttgccacgatgcaacggaaattttacgagacagtattgctgatggtgcgcttggcggtttgcagttatttttccccgatccttggcataaagcaaaacatcataaacgtcgtattgttcaaccgcactttgtgacacaagttatacaaaaattaggtaaaaatggttttatccatatggcgacagactgggaaaattatgcagagcaaatgctagaagtattaagcgcaaacaccgatttagtgaacacctcgaaaaatggcgattatattccaagaccagattttagacctttaactaaatttgaagccagaggttacaaacttggacatggtgtttgggatttatattttgtgaagaaa

SEQ ID NO: 4462 - protein, 122 aa, Haemophilus influenzae
  Name: NTH2489
VICHDATEILRDSIADGALGGLQLFFPDPWHKAKHHKRRIVQPHFVTQVIQKLGKNGFIHMATDWENYAEQMLEVLSANTDLVNTSKNGDYIPRPDFRPLTKFEARGYKLGHGVWDLYFVKK

SEQ ID NO: 4463 - DNA, 342 bp, Haemophilus influenzae
  Name: NTH2490
atgtctaaatcttacaatcaacgccaacgcaaaaaacttcatcttgcggaatttcaagaactgggttttcttgtaaatttccaatttgcagaaggcactgcgattgaaactgtagatgaaatcgttgatcgttttattaacgaagtgatccaaccaaatggtctagcttatgaaggtagcgggtatttacattgggaaggtttagtttgcctagaaaaaattggcaaatgcgatgaaagccaccgtgaaactgtgaaaaaatggttagaaacaaatggtttgcaacaaattgaagtaagcgaattatttgatatttggtgggaatatccagcaaaagctgaa

SEQ ID NO: 4464 - protein, 114 aa, Haemophilus influenzae
  Name: NTH2490
MSKSYNQRQRKKLHLAEFQELGFLVNFQFAEGTAIETVDEIVDRFINEVIQPNGLAYEGSGYLHWEGLVCLEKIGKCDESHRETVKKWLETNGLQQIEVSELFDIWWEYPAKAE

SEQ ID NO: 4465 - DNA, 528 bp, Haemophilus influenzae
  Name: NTH2491
atgaccgttgaaaatttacctcgcagacaatttttacgcggtaaattttcaacattgagctgtttagaaaataatcaaaaacagaattttgtgggtattagaccgccttggtctgtggaaaattctatttttgtagcacaatgtacgcgctgtggcgactgtctttctgtctgtgaaaccaatattttggtaaaggacgatgctggttttcctgaagtgcgctttgataatggcgaatgtactttttgtgggaaatgtgtagatgcctgtaaacagcctattttttatcctcgtgaccagttaccttggtcacataaaatcgacattggcgtagcttgtttaacattgcaccgtattgaatgccgaacttgccaagataattgtccagctaatgcgattcgtttcaaattacaaatgggtggcgtagcacaacctttagttaatttcgatgcttgtaatggctgtggggcttgtgtacaaggctgccctgtgaatgcaataacaatgaacgatctaaaacaaaatgaa

SEQ ID NO: 4466 - protein, 176 aa, Haemophilus influenzae
  Name: NTH2491
MTVENLPRRQFLRGKFSTLSCLENNQKQNFVGIRPPWSVENSIFVAQCTRCGDCLSVCETNILVKDDAGFPEVRFDNGECTFCGKCVDACKQPIFYPRDQLPWSHKIDIGVACLTLHRIECRTCQDNCPANAIRFKLQMGGVAQPLVNFDACNGCGACVQGCPVNAITMNDLKQNE

SEQ ID NO: 4467 - DNA, 279 bp, Haemophilus influenzae
  Name: NTH2492
atgaataatacaaatttaatattagaaaatgcgagggattggcacgttgttggattgatcgtgcaaggtaatccaaaaaaattatcagcaattcaaaccgcacttttagcgattgagcatactgaaattccgacttttgatgaaaaacttggaaaatttgtggtggtaatgcaatcgaacgatcagcatctcttgcttgaaaaaatggaaagtgtgaaagatatcgacggtgtgattaatgtatcgttggtgtatcacgagcaagatgaacaaaataaa

SEQ ID NO: 4468 - protein, 93 aa, Haemophilus influenzae
  Name: NTH2492
MNNTNLILENARDWHVVGLIVQGNPKKLSAIQTALLAIEHTEIPTFDEKLGKFVVVMQSNDQHLLLEKMESVKDIDGVINVSLVYHEQDEQNK

SEQ ID NO: 4469 - DNA, 2496 bp, Haemophilus influenzae
  Name: NTH2493
gtgggggaaaacgcgatgaatttaagtcgtcgagactttatgaaagccaatgcggctatggcagccgcaacggcagcggggctaaccatcccagtcaaaaatgtggttgcggctgaatccgaaattaaatgggataaagcagtatgtcgtttctgtggtactggttgtgcagtattagttggtactaaagatggacgtgttgtggcatctcaaggcgatcctgatgcagaagtaaaccgtggtttaaactgtattaaaggttacttcttgccaaaaattatgtacggtaaagaccgtttaacgcagccgcttttacgtatgacaaacggaaaatttgataagaacggcgattttgcgccagtttcttgggattttgcgttcaaaacaatggctgaaaaattcaaagaagcgttcaaaaagaacggtcaaaatgcagtaggtatgtttagttctggtcagtctaccatttgggaaggctatgcgaagaacaaactttggaaagcaggttttcgttctaacaacgtagacccgaatgcgcgtcactgtatggcatctgcagcggttgcatttatgcgtacttttggtatggatgaaccaatgggttgttatgatgatattgaacaggcagatgcttttgttctttggggctcaaatatggcggaaatgcacccaattttgtggtcgcgtattactgatcgccgtatttctaatcctgatgttcgtgttactgtgctttctacttacgaacatcgtagttttgaacttgccgatcacggtttgatatttacaccgcaaactgatttggcaattatgaactacatcatcaattatcttattcaaaataatgcgattaattgggattttgttaataaacataccaaatttaaacgcggagaaacgaatattggctatggtttacgtccagagcatccattagaaaaagacacgaatcgtgcaacagctgggaaaatgcacgattcttcttttgaagaattaaagcaacttgtatcagaatatacagtggaaaaagtatcgaaaatgtctgggttagataaagtccagttagaaactttagcgaaactttatgctgatccaacgaagaaagtggtttcctactggacaatgggctttaaccaacatacacgtggtgtgtgggtaaaccaattaatctacaatattcatttacttactggaaaaatttcaatcccaggttgtgggccattttcattaactggtcagccttctgcttgtggtacggcgcgtgaagtaggttcattccctcatcgtttacctgccgacttagtggtaactaatcctaaacaccgtgaaacagcggaacgtatttggaaattaccaaaggggacggtttctgaaaaagtggggttacacacaattgcacaagaccgtgcaatgaatgatggcgaaatgaatgtgttatggcaaatgtgtaacaataatatgcaagcaggaccaaacattaatcaagagcgtttgccaggctggcgtaaagaaggcaacttcgtgattgtttcagatccttacccaactgtatccgcactttctgctgacttaattcttccaacggcaatgtgggtggaaaaagaaggggcttacggcaatgcagaacgtcgtacccaattctggcgtcagcaagtcaaagcaccgggcgaagcaaaatcagacttatggcaattaatggagttcgcaaaatacttcacgacggatgaaatgtggacagaagacttacttacacaaatgcctgaatatagaggtaaaactttatatgaagtgcttttcaaaaatggtcaagtagataaattcccattgagcgaacttgctgaaggccaattaaacgatgaatcagaatattttggttactacgttcacaaaggtttatttgaagaatacgctgaatttggtcgcggtcacggtcacgatttagctccatttgatatgtatcataaagcgcatggtttacgttggccagttgtggagggtaaagaaaccttatggcgttaccgtgaaggctatgatccgtatgttaaagaaggggaaggcgtggctttctacggttatcctgataagaaagcgattattcttgcggtgccttatgaaccaccagctgagtcacccgataatgaatacgatttatggttatcaacaggtcgtgttcttgaacattggcatacggggacaatgacacgccgtgtaccagaattgcatcgagcatttccaaataatttagtatggatgcacccattagatgcacaagctcgtggtttacgtcatggcgataaaattaagatttcatctcgtcgaggcgaaatgatttcttatttagatactcgcggacgtaataaaccacctcgtggcttagtatttaccactttctttgatgcaggtcagcttgcaaatagcttaacactagatgcgacagacccaatttcaaaagaaaccgacttcaaaaaatgtgcggtaaaagtggaaaaggctgcg

SEQ ID NO: 4470 - protein, 832 aa, Haemophilus influenzae
  Name: NTH2493
VGENAMNLSRRDFMKANAAMAAATAAGLTIPVKNVVAAESEIKWDKAVCRFCGTGCAVLVGTKDGRVVASQGDPDAEVNRGLNCIKGYFLPKIMYGKDRLTQPLLRMTNGKFDKNGDFAPVSWDFAFKTMAEKFKEAFKKNGQNAVGMFSSGQSTIWEGYAKNKLWKAGFRSNNVDPNARHCMASAAVAFMRTFGMDEPMGCYDDIEQADAFVLWGSNMAEMHPILWSRITDRRISNPDVRVTVLSTYEHRSFELADHGLIFTPQTDLAIMNYIINYLIQNNAINWDFVNKHTKFKRGETNIGYGLRPEHPLEKDTNRATAGKMHDSSFEELKQLVSEYTVEKVSKMSGLDKVQLETLAKLYADPTKKVVSYWTMGFNQHTRGVWVNQLIYNIHLLTGKISIPGCGPFSLTGQPSACGTAREVGSFPHRLPADLVVTNPKHRETAERIWKLPKGTVSEKVGLHTIAQDRAMNDGEMNVLWQMCNNNMQAGPNINQERLPGWRKEGNFVIVSDPYPTVSALSADLILPTAMWVEKEGAYGNAERRTQFWRQQVKAPGEAKSDLWQLMEFAKYFTTDEMWTEDLLTQMPEYRGKTLYEVLFKNGQVDKFPLSELAEGQLNDESEYFGYYVHKGLFEEYAEFGRGHGHDLAPFDMYHKAHGLRWPVVEGKETLWRYREGYDPYVKEGEGVAFYGYPDKKAIILAVPYEPPAESPDNEYDLWLSTGRVLEHWHTGTMTRRVPELHRAFPNNLVWMHPLDAQARGLRHGDKIKISSRRGEMISYLDTRGRNKPPRGLVFTTFFDAGQLANSLTLDATDPISKETDFKKCAVKVEKAA

SEQ ID NO: 4471 - DNA, 837 bp, Haemophilus influenzae
  Name: NTH2494
atgaaagtgcggttaaaatctaaaaagaaaatgaagaaacccgcccttaatcctgaacgtagaaaatttcttaaagaagcaacccgtactgcgggtggtttagctggcgttgggattttgttgggattgcagcaaaatcaaagtcttgcgcgcgaaggtgtgccattacgccctccatttgctttgcaagatgcgaaagcgttttctgccgcttgtattcgttgcggacaatgtgttcaagcctgtccttatgacatgctgcatttagcctctttattatcgccagtagaagcgggaacgccgtattttattgcgcgtgataaaccttgtgaaatgtgtcctgatattccttgtgcaaaagcctgtcctagtggtgcattagatcgtcaagcaacagatattaatgaatcgcgtatggggctgtcagtactgttagatcacgaaacttgcttaaattatcaaggattacgttgtgatgtttgttatcgagtttgtccattaatcgataaagcgattacattggaaacacaacataatccacgttctgataagcatgccttatttattccaacagtacattctgatgcctgcacgggatgtggaaaatgtgagcaagcttgtgtgttagaagaagcagcgattaagattttaccaatggatctggcaaaaggtatgttaggtaaacattatcgtttaggttgggaagaaaaagcgaaagctggccattctcttgcacctaaagatatgatttcattgccaactcgaacaccagaagggacaactgtaattcctgaaccagcagaacccgtgctcgcaccaattttagggggcggaaaa

SEQ ID NO: 4472 - protein, 279 aa, Haemophilus influenzae
  Name: NTH2494
MKVRLKSKKKMKKPALNPERRKFLKEATRTAGGLAGVGILLGLQQNQSLAREGVPLRPPFALQDAKAFSAACIRCGQCVQACPYDMLHLASLLSPVEAGTPYFIARDKPCEMCPDIPCAKACPSGALDRQATDINESRMGLSVLLDHETCLNYQGLRCDVCYRVCPLIDKAITLETQHNPRSDKHALFIPTVHSDACTGCGKCEQACVLEEAAIKILPMDLAKGMLGKHYRLGWEEKAKAGHSLAPKDMISLPTRTPEGTTVIPEPAEPVLAPILGGGK

SEQ ID NO: 4473 - DNA, 861 bp, Haemophilus influenzae
  Name: NTH2495
atggcaaatgcaccaaaatttgcagggaaagaggctcgagaaaaatggggctggtggtatgcaaaccgctttttgttttggcgtcgattaagccaacttagcattcttgcgatgtttttgagtggcccttattttggcgtgtggattttaaaaggtaattatagtggtagtttattactcgatactattccactaagtgatcctctaattaccgctgaaagcttggctgcaagacatttaccagatgctctcactttaattggtgctgcaattattgtgttattttacgcagtacttggtagtaaagtgttttgtggttgggtatgcccactaaatgttgtgactgactgtgcagcgtggcttcgccgtaagttaggcattcgccaaacagcaaaaatttcgcgcggtttacgttatggtattcttgtgcttattttactaggcagtagtgtcagcggaatgttgctttgggagtgggttaatccagtggctgctcttggtcgcgcctttgtatttggttttggtgcaacaggctggttattacttgttatttttctttttgatttattgattgctgaacacggctggtgtggacatctttgcccaattggtgctgcttatggtgtgattggtgcaaaaagtttaatccgtattaaagtgattgatcgtgctaaatgcgataattgtatggattgttacaatgtttgtcccgaagcccaagtgttacgttcgcctttacacggaaaaaaagacgaaagcctactagtgctttccaaagattgcatcagctgcggacgttgtattgacgtttgcgctgaaaaagtttttaaattttcgaccagattcgatcattcaggggag

SEQ ID NO: 4474 - protein, 287 aa, Haemophilus influenzae
  Name: NTH2495
MANAPKFAGKEAREKWGWWYANRFLFWRRLSQLSILAMFLSGPYFGVWILKGNYSGSLLLDTIPLSDPLITAESLAARHLPDALTLIGAAIIVLFYAVLGSKVFCGWVCPLNVVTDCAAWLRRKLGIRQTAKISRGLRYGILVLILLGSSVSGMLLWEWVNPVAALGRAFVFGFGATGWLLLVIFLFDLLIAEHGWCGHLCPIGAAYGVIGAKSLIRIKVIDRAKCDNCMDCYNVCPEAQVLRSPLHGKKDESLLVLSKDCISCGRCIDVCAEKVFKFSTRFDHSGE

SEQ ID NO: 4475 - DNA, 450 bp, Haemophilus influenzae
  Name: NTH2496
gtgattaatatgactaaacaggtatctaaaattttagcgggattatttaccgcactttttgctggctcactgatggcatctgatgcaccagcagtgggaaaagatttaactcaagcggcagaaaatattccacccgcatttcataatgcaccgcgtcaaggcgaattacccgcattgaactatgtaaatcagcctccaatggttccacatagtgtggcaaactatcaagtgacaaaaaatgtaaatcaatgtttaaattgccacagcccagaaaattctcgtttgagcggtgcaactcgaatcagcccaactcactttatggatcgtgatggaaaagtaggttcaagttcatcgccacgtcgttatttctgtttacaatgtcacgtttctcaagcaaacgtagatcctattgttccaaatgatttcaaaccgatgaaaggttacggaaac

SEQ ID NO: 4476 - protein, 150 aa, Haemophilus influenzae
  Name: NTH2496
VINMTKQVSKILAGLFTALFAGSLMASDAPAVGKDLTQAAENIPPAFHNAPRQGELPALNYVNQPPMVPHSVANYQVTKNVNQCLNCHSPENSRLSGATRISPTHFMDRDGKVGSSSSPRRYFCLQCHVSQANVDPIVPNDFKPMKGYGN

SEQ ID NO: 4477 - DNA, 600 bp, Haemophilus influenzae
  Name: NTH2497
atgtctgagaaaaaaccaaatatcttaaagcgtttctggcaatggtttagaaaaccaagccgtatggcgataggtacaattattatcttatcggctattggcggtattctttcttgggttggttttaactatggtttagaaaaaaccaacactgaacagttctgtgcaagctgccatatgcaagatgcttatccagaatatttacatagcgtgcattatcaaactcgtactggtgtgggggcaagttgtccagattgtcacgtaccacacgaatttggtgcaaaaatgaaacgtaaaattattgcagctaaagaagtatatgcgcactatactggaaaagtggataccttagaaaaattcaatgcgcatcgtttagaaatggctcaaaatgaatgggcgcgtatgaaagctaacgattctaaagaatgtcgtaattgccataatgtagatcgtatgaacttcaatgatcaacgttctgtggcggcacgtatgcaccaaaaaatgaaaactgaaggtaaaacttgtatcgactgtcacaaaggtattgcacaccaattacctgatatgagtggcgttgagtcaggcttcaaagacgagaag

SEQ ID NO: 4478 - protein, 200 aa, Haemophilus influenzae
  Name: NTH2497
MSEKKPNILKRFWQWFRKPSRMAIGTIIILSAIGGILSWVGFNYGLEKTNTEQFCASCHMQDAYPEYLHSVHYQTRTGVGASCPDCHVPHEFGAKMKRKIIAAKEVYAHYTGKVDTLEKFNAHRLEMAQNEWARMKANDSKECRNCHNVDRMNFNDQRSVAARMHQKMKTEGKTCIDCHKGIAHQLPDMSGVESGFKDEK

SEQ ID NO: 4479 - DNA, 642 bp, Haemophilus influenzae
  Name: NTH2498
atgaaaattattcttttaggtgcaccgggtgcaggtaaaggcactcaagcacaatttattatgaacaaatttggtatcccgcaaatttcaactggtgatatgttccgtgctgcaatcaaagcggggactgaacttggcaaacaagctaaagcattaatggatgaaggtaaattagtgccagatgaattaaccgttgcccttgtaaaagatcgtattgctcaagctgactgcacaaatggtttcttgttagatggtttccctcgtactattccacaagcggatgcactgaaagattcaggtgttaaaattgactttgttttagaatttgatgtgccagacgaagtgattgttgaacgtatgagtggccgtcgcgtacaccaagcgtctggccgttcttaccacatcgtttataatccaccaaaagtggaaggtaaagatgatgtaacaggcgaagatttaattattcgtgcagacgataaaccagaaactgtattagatcgtttagccgtatatcataaacaaactagcccattaattgattattaccaagcagaagcgaaagcggggaatactcaatatttccgtttagacggtacacaaaaagtagaagaagttagccaagagttagataaaatcttaggc

SEQ ID NO: 4480 - protein, 214 aa, Haemophilus influenzae
  Name: NTH2498
MKIILLGAPGAGKGTQAQFIMNKFGIPQISTGDMFRAAIKAGTELGKQAKALMDEGKLVPDELTVALVKDRIAQADCTNGFLLDGFPRTIPQADALKDSGVKIDFVLEFDVPDEVIVERMSGRRVHQASGRSYHIVYNPPKVEGKDDVTGEDLIIRADDKPETVLDRLAVYHKQTSPLIDYYQAEAKAGNTQYFRLDGTQKVEEVSQELDKILG

SEQ ID NO: 4481 - DNA, 1236 bp, Haemophilus influenzae
  Name: NTH2499
atgttaatttgcgccttcacaggttttaattctggtttgccattatttgtattgtcgcaaatgttgcctgtttggctgacagataaacatctttcaattgagcttattggtgcagtaacgggtgtgatgttgccttatggattgaaatttttgtgggcaccattattagatcgttatttcccgagttttttagggcgtcgtcgtagctggatgttgctttcacaagtggcattattgattttactttacatcattagcctgtttgatccgctcacacaactgggtacagtagcaaatattgcgttgcttatcgcctttttttcagctacacaagatatcgtgttggatgcgtatcgtcgtgaaattttgagtgatcatgaattaggtttaggaaacactattcatattaatgcttatcgaattgcgggattaattccagggggattatcgctatatttggcggcgatttatccttgggaaaccgtctttttatggaccgcactttgtatgttagcaggcatcttcatgacattatttttagcaaaagagccgaaaatcaacgtgcagcaaactaatcagccgttctatcaagcattttggattccattacaagaatttttccagcgtaagggcgtcattcaggctatcggttttttactatttttgtttttgtataagttcggggattcttttgccacaacgttacaaaccaaatttatttatgacatgggatttagcaaagaggatattgctattgttgtaaaaagtaacgcactttggtcaagcattttatctgggcttgctggtggtatgataatgctaaaactgggtattaaccgtgcattgtggctatttgggcttgtacaaatggtaacaattggtgggtttatttggttgtctgctttcggtcattttgatgttattacatctgccgagttatggaaactaggtgttgtgattgccgcagaatatatcggcgttggacttggtaccgcagcttttgtggcttttatggcacgtgagagtaatcctctttatactgcaacacagcttgcactttttacaagcctttcagctttgccaagtaaagttttaggtatactttctggttatgttgtgggagcagtggggtattatcagtatttttggttttgtttatttttagcgattcccggcatgctttgtttattttgggtagcacctttgaagcaagaaaataataagaccagctcagta

SEQ ID NO: 4482 - protein, 412 aa, Haemophilus influenzae
  Name: NTH2499
MLICAFTGFNSGLPLFVLSQMLPVWLTDKHLSIELIGAVTGVMLPYGLKFLWAPLLDRYFPSFLGRRRSWMLLSQVALLILLYIISLFDPLTQLGTVANIALLIAFFSATQDIVLDAYRREILSDHELGLGNTIHINAYRIAGLIPGGLSLYLAAIYPWETVFLWTALCMLAGIFMTLFLAKEPKINVQQTNQPFYQAFWIPLQEFFQRKGVIQAIGFLLFLFLYKFGDSFATTLQTKFIYDMGFSKEDIAIVVKSNALWSSILSGLAGGMIMLKLGINRALWLFGLVQMVTIGGFIWLSAFGHFDVITSAELWKLGVVIAAEYIGVGLGTAAFVAFMARESNPLYTATQLALFTSLSALPSKVLGILSGYVVGAVGYYQYFWFCLFLAIPGMLCLFWVAPLKQENNKTSSV

SEQ ID NO: 4483 - DNA, 111 bp, Haemophilus influenzae
  Name: NTH2500
ttgaaaggcgaaatttctaaaatacaactaaaattaaccgcactttatgtcaaattccctttcttctcaaatttttacgcgcaagatgttaatttgcgccttcacaggttt

SEQ ID NO: 4484 - protein, 37 aa, Haemophilus influenzae
  Name: NTH2500
LKGEISKIQLKLTALYVKFPFFSNFYAQDVNLRLHRF

SEQ ID NO: 4485 - DNA, 723 bp, Haemophilus influenzae
  Name: NTH2501
atgaacaatgtcgctggcacccttgtattaattcaagaaatgaaaaaagcgggtgtttggaactttgtatttagctcatctgcaacggtttacggcgatccaaaaattattccaattacagaggattgtgaggtcggcggtacaaccaatccttatggtacatctaaatatatggttgagcagattttatgcgatacagcaaaagcggaaccaaaatttagcatgactatcttgcgttattttaatccagttggggcgcatgaaagtggcttgattggtgaagatccaaatggtattccaaataatttattaccttatattagccaagttgctatcggtaaattagcacaactttctgtatttggtagtgattacgacactcatgatggaacaggtgtgcgtgattatattcatgtagtggatttagctgtggggcatttaaaagcgcttcaacgtcatgaaaatgacgctggcttacatatttataaccttggtacgggccatggttattccgtattagatatggtaaaagcctttgaaaaagccaacaatattacaattgcatataaacttgtagaacgccgcgctggcgatattgctacttgctattctgatcctagtttagctgcaaaagagcttggttgggtggcagaacgtggtcttgaaaaaatgatgcaagacacgtggaactggcagaaaaataatccaaaagggtatagagat

SEQ ID NO: 4486 - protein, 241 aa, Haemophilus influenzae
  Name: NTH2501
MNNVAGTLVLIQEMKKAGVWNFVFSSSATVYGDPKIIPITEDCEVGGTTNPYGTSKYMVEQILCDTAKAEPKFSMTILRYFNPVGAHESGLIGEDPNGIPNNLLPYISQVAIGKLAQLSVFGSDYDTHDGTGVRDYIHVVDLAVGHLKALQRHENDAGLHIYNLGTGHGYSVLDMVKAFEKANNITIAYKLVERRAGDIATCYSDPSLAAKELGWVAERGLEKMMQDTWNWQKNNPKGYRD

SEQ ID NO: 4487 - DNA, 246 bp, Haemophilus influenzae
  Name: NTH2502
atggccattttagtgacaggtggcgccggttatatcggttctcacacagttgtagaattattaaatgctggcaaagaggtggtggtattagataatctttgcaattcatcgccaaaatcccttgagcgtgtaaaacaaattacaggcaaagaagcaaagttttatgaaggcgatattttagatcgtgctttgttacaaaaatttttgcagaaaatgagattaactcggttattcactttgcagggt

SEQ ID NO: 4488 - protein, 82 aa, Haemophilus influenzae
  Name: NTH2502
MAILVTGGAGYIGSHTVVELLNAGKEVVVLDNLCNSSPKSLERVKQITGKEAKFYEGDILDRALLQKFLQKMRLTRLFTLQG

SEQ ID NO: 4489 - DNA, 960 bp, Haemophilus influenzae
  Name: NTH2503
atgtcaatcaatcaatcaatcaatcaatcaatcaatcaatcaatcaatcaatcaatcaatcaatcaatcaatcaatcaaagtctgtcattattgcaggtaatggaacaagtttaaaatcaattgactatagtttattacctaaagattatgatgttttccgttgcaatcaattttattttgaagatcattattttcttggcaagaaaataaaaaaggtattttttaattgttctgtaatttttgaacaatactatacgtttatgcaattaattaaaaataatgaatataaatatgaatatgctgatattatcttagcatcttttctgaatttaggggattcaacattaaagaaaatccagcatttagaaaaattactgccacaaattgatcttggtcattgctatttgaaaaaactacgagcttttaatgctcatttacaatatcacgaattatatgagaataagaggattacatcaggcgtttatatgtgtgcagtggcgactgcaatgggttataaagatctttatttaacaggtattgatttttatcaagaaaaagggaatccttacgcatttcatcatcaaaaagaaaatattattaaattattaccttctttttcacaaaataaaagtcaaagcgatatccattctatggaatatgatttaaatgcactttattttttacaaaaacattatggagtaaatatttattgcatttcgccagaaagtcctctatgtaattattttcctttatcaccactgaataacccaattgcttttattccagaagaaaagaaaaattacacacaagatattttaattccgccgaagtttgtatataaaaaaattggtatatattccaaaccaagaatttaccaaaatctgatttttcggttgttctgggatatattacgtttacctaatgatataaaacacgccttaaaatcaagaaaatgggat

SEQ ID NO: 4490 - protein, 320 aa, Haemophilus influenzae
  Name: NTH2503
MSINQSINQSINQSINQSINQSINQSKSVIIAGNGTSLKSIDYSLLPKDYDVFRCNQFYFEDHYFLGKKIKKVFFNCSVIFEQYYTFMQLIKNNEYKYEYADIILASFLNLGDSTLKKIQHLEKLLPQIDLGHCYLKKLRAFNAHLQYHELYENKRITSGVYMCAVATAMGYKDLYLTGIDFYQEKGNPYAFHHQKENIIKLLPSFSQNKSQSDIHSMEYDLNALYFLQKHYGVNIYCISPESPLCNYFPLSPLNNPIAFIPEEKKNYTQDILIPPKFVYKKIGIYSKPRIYQNLIFRLFWDILRLPNDIKHALKSRKWD

SEQ ID NO: 4491 - DNA, 732 bp, Haemophilus influenzae
  Name: NTH2504
ttgaggcgagcaatggtgcgtattcaagatttgagtcttgcctttaatgggcaaacgttatttgagcatcttaatttaaccctgttgccgaacgaatgggtgagcttattgggcagttcaggcgtgggaaaatcgacacttttgcgactactggcgggcattgaaacgcaaggtgtggtgcaggggaaaatcctatttgaaccgaaaattcgtattgcgtggttgcctcaaaaagagaccctttatccgtggttgtcaattgtcgataacgtgcagttgcaagcggtcttatttgggcgaaaatctgcaaaaaccactgaaaaagctaaaatgttgcttgaaaaagtgggaatggcagcacattggcacaagccttgttcgcagctttcgggcgggcaaaaacagcgggttgccttggcacgcaccttaatgcaagaggcggatttgattttgcttgatgagcctttttccgctcttgatgccatcagtcgccatcaacttcaagatttagcctttgaactgctagaagataaatcagtgctgctcgtgacccacgatccgcaagaggcattacggctaagtcagcgtatttttgtgttgcgttcgcctgaatctcatcaaacagcattatcggcggtgattctgcccgaaggtaacgcccctcgtgagttgcatcaagccaatttatgggcgttgcagcaacaattattgcaggaattagggggcgaacaa

SEQ ID NO: 4492 - protein, 244 aa, Haemophilus influenzae
  Name: NTH2504
LRRAMVRIQDLSLAFNGQTLFEHLNLTLLPNEWVSLLGSSGVGKSTLLRLLAGIETQGVVQGKILFEPKIRIAWLPQKETLYPWLSIVDNVQLQAVLFGRKSAKTTEKAKMLLEKVGMAAHWHKPCSQLSGGQKQRVALARTLMQEADLILLDEPFSALDAISRHQLQDLAFELLEDKSVLLVTHDPQEALRLSQRIFVLRSPESHQTALSAVILPEGNAPRELHQANLWALQQQLLQELGGEQ

SEQ ID NO: 4493 - DNA, 528 bp, Haemophilus influenzae
  Name: NTH2505
atgggcgttgcagcaacaattattgcaggaattagggggcgaacaatgaaaattcgcctacttaaaccgcttttaattgttggcgtgttgttgatgatctggcaaatggtcgcaaccttgggcagcttcccacactacatttttccctcaccgcaagctgtagggcagcagttattcacacacgctgaactgctttggcagcatacgcaagtcacgttgttagaaatttgcttagggctgttgttaggctttctatttgggttgatttcggcgttgttgctctcattttctcgtcaaatttctgccgtcttattgccgattttggtcatttcgcaagcgattcccgtgtttgctattgcgccgttgttggtgttgtggtttggctatggaatggcatccaaaattgtgatgtcggtgctgattatctacttccccgtcacggccgcctgttatgatggactacgcatatccctcaagcggggtttgattggcgaatacctttacattttccccttgtgttcattgctt

SEQ ID NO: 4494 - protein, 176 aa, Haemophilus influenzae
  Name: NTH2505
MGVAATIIAGIRGRTMKIRLLKPLLIVGVLLMIWQMVATLGSFPHYIFPSPQAVGQQLFTHAELLWQHTQVTLLEICLGLLLGFLFGLISALLLSFSRQISAVLLPILVISQAIPVFAIAPLLVLWFGYGMASKIVMSVLIIYFPVTAACYDGLRISLKRGLIGEYLYIFPLCSLL

SEQ ID NO: 4495 - DNA, 378 bp, Haemophilus influenzae
  Name: NTH2506
atgcgctatgttatcgccgtcaaaagccctatttacggaaagcaaggggcatttttagcttatcaatttgcaaatgccttaatcaaaaaaggacacgaaatctcacagatttttttcttccaagatggagtgagtaacggaaatgcattagtgtatccagccaatgatgaagttaatttacaaaaacattggcaaatgttttccatcacccacaatgttcctttacatttatgtgttgcagcatctcaacgacgaggtgttgttgataacttaactacaccaactacagctcactacaatcttgcagaaggatttataattgcaggtcttggagaatttatagcagcaagtttaaacgcagatcgagtaataacccta

SEQ ID NO: 4496 - protein, 126 aa, Haemophilus influenzae
  Name: NTH2506
MRYVIAVKSPIYGKQGAFLAYQFANALIKKGHEISQIFFFQDGVSNGNALVYPANDEVNLQKHWQMFSITHNVPLHLCVAASQRRGVVDNLTTPTTAHYNLAEGFIIAGLGEFIAASLNADRVITL

SEQ ID NO: 4497 - DNA, 663 bp, Haemophilus influenzae
  Name: NTH2507
atgacattaaacgataaatatcctttcactgatgaagatcaagctatcataaattcctacaaagcagtcgttgatggtgtcagcgcactgattggcgagcactgcgaaatagtgcttcattctctggaaaatattgaacattctgctatttgtattgccaacggacataacactaatcgacaagttggttcgccaattactgatcttgccttacgttcgctacgaaatatgcaaagcgaaagtgtttcaaaaccttattttacacgagcaaaaggcagcgtactgatgaaatcagttactatcgctattcgtaataaaactcaacgtattattggtttgctttgcatcaatatcaatttagatgtacccatgtctcaatttttgcaatgctttatgccaacggagcatacgaatgaaacatcttcagtgaactttgcgaattcagtggaagacttggttgcgcagactattgaaaaaacaatagaagaagtcaatgcggatcgcgctgttgccaataatactaaaaaccgacaaatcgtcctttctctttacgaaaaaggtatttttgatattaaagatgcgattaatttagtcgctgaacgtttagatatttcccgacatacggtttacctgtacatccgtcaaatcaaacaagagcaagaa

SEQ ID NO: 4498 - protein, 221 aa, Haemophilus influenzae
  Name: NTH2507
MTLNDKYPFTDEDQAIINSYKAVVDGVSALIGEHCEIVLHSLENIEHSAICIANGHNTNRQVGSPITDLALRSLRNMQSESVSKPYFTRAKGSVLMKSVTIAIRNKTQRIIGLLCININLDVPMSQFLQCFMPTEHTNETSSVNFANSVEDLVAQTIEKTIEEVNADRAVANNTKNRQIVLSLYEKGIFDIKDAINLVAERLDISRHTVYLYIRQIKQEQE

SEQ ID NO: 4499 - DNA, 723 bp, Haemophilus influenzae
  Name: NTH2508
atgttaaaaattcaaaaattatctatcgcagcattaatggtaagtgcggtaatttctggtcaagtttttgcagaagataacacattcgatgaaaaagcggcatcttatgcagtaggtacgctcatgggcagtcaaatgaaagatcttgttgattcccacaaagaagttattaaatatgataatgcgcgtattttagatggcttaaaagatgctttagaaggcaaagtggatgttcgtaaagatgaaaaaatccaaaaaaccttagaatctattgaagcaaaattagtggctgcatcaaaagcaaaagcagaagcgattgctaaacaagcaaaagaagaaggcgataaattccgtgctgaatttgctaaagggaaagatgtaaaaacgacgcaatctggtttaatgtataaaattgaaagtgcaggtaaaggcgatacaatcaaatcaacggatacggttaaagtacattacacgggtaaattaccaaatggaaaagtatttgatagctctgtcgagcgcggacaacctgtagaattccaacttgatcaagtaattaaaggctggactgaaggtcttcaattagtgaaaaaaggcggaaaaattcaattagttattgcacctgaattaggctatggcgaacaaggtgctggcgcatctattccaccaaattcaacattaatttttgatgtggaagtattagacgtcaatccgaaatctgaaaaa

SEQ ID NO: 4500 - protein, 241 aa, Haemophilus influenzae
  Name: NTH2508
MLKIQKLSIAALMVSAVISGQVFAEDNTFDEKAASYAVGTLMGSQMKDLVDSHKEVIKYDNARILDGLKDALEGKVDVRKDEKIQKTLESIEAKLVAASKAKAEAIAKQAKEEGDKFRAEFAKGKDVKTTQSGLMYKIESAGKGDTIKSTDTVKVHYTGKLPNGKVFDSSVERGQPVEFQLDQVIKGWTEGLQLVKKGGKIQLVIAPELGYGEQGAGASIPPNSTLIFDVEVLDVNPKSEK

SEQ ID NO: 4501 - DNA, 219 bp, Haemophilus influenzae
  Name: NTH2509
atgcaaattcaacaaatgttagaaaatcgcatcgaagaacttgaaatgaaaattgcatttcaggaacagttattagatgaattaaatcacgctttagttcaacagcaatttgatattgataaaatgcaagtccaattgcgttatatggcaaataaattaaaagactttcaaccgtctaacattgcaagtcaatctgaagaaacgccaccgccccattat

SEQ ID NO: 4502 - protein, 73 aa, Haemophilus influenzae
  Name: NTH2509
MQIQQMLENRIEELEMKIAFQEQLLDELNHALVQQQFDIDKMQVQLRYMANKLKDFQPSNIASQSEETPPPHY

SEQ ID NO: 4503 - DNA, 123 bp, Haemophilus influenzae
  Name: NTH2510
ttgcctgcttatgcaaagtatttttccaaatcgtcgctaccgccaatgtgtttaccaccgataaacacttgtggaacagtagcacgacctgaaactgcacgtacgctcacgattgttgcatcg

SEQ ID NO: 4504 - protein, 41 aa, Haemophilus influenzae
  Name: NTH2510
LPAYAKYFSKSSLPPMCLPPINTCGTVARPETARTLTIVAS

SEQ ID NO: 4505 - DNA, 99 bp, Haemophilus influenzae
  Name: NTH2511
gtgagcgtacgtgcagtttcaggtcgtgctactgttccacaagtgtttatcggtggtaaacacattggcggtagcgacgatttggaaaaatactttgca

SEQ ID NO: 4506 - protein, 33 aa, Haemophilus influenzae
  Name: NTH2511
VSVRAVSGRATVPQVFIGGKHIGGSDDLEKYFA

SEQ ID NO: 4507 - DNA, 144 bp, Haemophilus influenzae
  Name: NTH2512
atgcttgtgatacacggcgtagttgaaaaaatgtttatcgaaccaaacgaaccaggcgatccgttcaaagtatccgatgctgacactatgttgaaataccttgcaccacaacaccaagtgcaagagtctatttcaatctttttt

SEQ ID NO: 4508 - protein, 48 aa, Haemophilus influenzae
  Name: NTH2512
MLVIHGVVEKMFIEPNEPGDPFKVSDADTMLKYLAPQHQVQESISIFF

SEQ ID NO: 4509 - DNA, 351 bp, Haemophilus influenzae
  Name: NTH2513
atgtctagtatggaaggaaaaaaagtccctcaagtgacattccgcactcgtcagggtgataaatgggttgatgtaactacctcagagttatttgataacaaaacagtgatcgtgttctcattaccgggcgcattcactccaacttgctcatcatcacacttaccacgttacaacgaattagcgccagtattcaaaaaatacggtgtagacgatattcttgttgtatctgtaaatgatactttcgtaatgaacgcatggaaagaagatgaaaaatctgaaaacatcactttcattccagatggtaatggtgaatttaccgaaggcatgggtatgttagttggtaaagaagat

SEQ ID NO: 4510 - protein, 117 aa, Haemophilus influenzae
  Name: NTH2513
MSSMEGKKVPQVTFRTRQGDKWVDVTTSELFDNKTVIVFSLPGAFTPTCSSSHLPRYNELAPVFKKYGVDDILVVSVNDTFVMNAWKEDEKSENITFIPDGNGEFTEGMGMLVGKED

SEQ ID NO: 4511 - DNA, 903 bp, Haemophilus influenzae
  Name: NTH2514
atgaatatccgtgatctagaatatcttgttgccttatctgaatataaacatttccgccgtgctgccgattcttgtaatgtgagtcaaccaacattaagtgggcaaattcgtaagttagaagatgagcttggtattattttgttagaacgtactagccgtaaagtgttgtttactcaatctgggatgttattggttgatcaggctcgtacagttcttcgagaagtaaaattattgaaagaaatggcgagtaatcaaggtaaagaaatgaccgggccattacacatcggtttaattccaacggttggtccttatttgctcccttatattgtgccaatgttaaaagcggcattccctgatttagaagtgtttctttatgaagcgcaaacgcatcaattattagaacaattggaaacggggcgtttagattgtgctatcgttgccactgttccagaaactgaggcttttattgaagtacctattttcaacgagaaaatgttactcgccgtatcagagcatcatccttgggctcaagaaagtaaacttccaatgaaccaattaaatggtcaagaaatgttaatgcttgatgatggtcattgtttgcgtaatcaagcgctagattattgcttcactgctggtgcaaaagaaaattcccatttccaagcaactagtcttgaaactttgcgcaatatggtggcagcgaatgctggtatcacttttatgcctgaattagcggtactgaatgaaggtacgcgcaaaggtgtgaaatatattccttgttattcgccagagccatcacgcaccattgcgttggtttatcgtcctggttcgccattacgtaatcgttatgagcgtgtggcaagtgcggtcagcgatgaagttaaatctattctagatgggttgaaa

SEQ ID NO: 4512 - protein, 301 aa, Haemophilus influenzae
  Name: NTH2514
MNIRDLEYLVALSEYKHFRRAADSCNVSQPTLSGQIRKLEDELGIILLERTSRKVLFTQSGMLLVDQARTVLREVKLLKEMASNQGKEMTGPLHIGLIPTVGPYLLPYIVPMLKAAFPDLEVFLYEAQTHQLLEQLETGRLDCAIVATVPETEAFIEVPIFNEKMLLAVSEHHPWAQESKLPMNQLNGQEMLMLDDGHCLRNQALDYCFTAGAKENSHFQATSLETLRNMVAANAGITFMPELAVLNEGTRKGVKYIPCYSPEPSRTIALVYRPGSPLRNRYERVASAVSDEVKSILDGLK

SEQ ID NO: 4513 - DNA, 387 bp, Haemophilus influenzae
  Name: NTH2515
atggctggtgttcgtgctgttcaaaaagaaaagactcgtcgcgctttagtggatgcagcatttaatcaacttagcgcagaaaaaagtttttctaatttaagtttacgagaagtggcgcgcgaggctggtattgcgcctacctctttctatcgccattttagtgatatggatgaacttggcttagaaatggtggatgaagcaggtttgatgttgcgccaattaatgcgtcaagcgcgtaaacgtattgatgcgggcggtagtgttatttctgtttctgtggatacattttttgaatttattactaatagcacgaacgtttttcgcttgttattacgcgaaagttcaggcacttctcaagcttttcgtactgcggcagcacgccgaaat

SEQ ID NO: 4514 - protein, 129 aa, Haemophilus influenzae
  Name: NTH2515
MAGVRAVQKEKTRRALVDAAFNQLSAEKSFSNLSLREVAREAGIAPTSFYRHFSDMDELGLEMVDEAGLMLRQLMRQARKRIDAGGSVISVSVDTFFEFITNSTNVFRLLLRESSGTSQAFRTAAARRN

SEQ ID NO: 4515 - DNA, 102 bp, Haemophilus influenzae
  Name: NTH2516
atgagtaaagctgagcgtgagcaacttaaagctcgtgtgattttgcagttgagaatgcttgcaaaaggtgctgattttgcagcgaataaggaaagaggcaag

SEQ ID NO: 4516 - protein, 34 aa, Haemophilus influenzae
  Name: NTH2516
MSKAEREQLKARVILQLRMLAKGADFAANKERGK

SEQ ID NO: 4517 - DNA, 474 bp, Haemophilus influenzae
  Name: NTH2517
atggcaaaatcaaattatattacccgtcaaggctggcttgtgcttgaccaagaactcaagtttttgtggaaagaagaacgcccaaaagtcactcaagccgtttcagatgcagctgcgctaggcgatcgtagcgaaaatgccgaatatatttatggtaaacgtcgtttacgtgaaattgatcgccgcgtgcgttttttaactaaaagattggaagtgctacaaattgtcgattacaacccaaagcaagagggaaaagttttcttcggtgcgtgggtggaattagaaaatgaagaaggtgaaattaagcaataccgtatcgtcggttgtgatgaatttgcccctgcgaaaaattggatatccattgattccccagttgctcgagctttaatcggaaaaacattagacgacgaagtgcgggtagaaacgccatcaggatttattaccctttatataaataaaatttggtatgaaaaa

SEQ ID NO: 4518 - protein, 158 aa, Haemophilus influenzae
  Name: NTH2517
MAKSNYITRQGWLVLDQELKFLWKEERPKVTQAVSDAAALGDRSENAEYIYGKRRLREIDRRVRFLTKRLEVLQIVDYNPKQEGKVFFGAWVELENEEGEIKQYRIVGCDEFAPAKNWISIDSPVARALIGKTLDDEVRVETPSGFITLYINKIWYEK

SEQ ID NO: 4519 - DNA, 2310 bp, Haemophilus influenzae
  Name: NTH2518
atgttaaatcaacaaattagccaaattattgcggcagaattaaccgttcaaccccaacaaattcttgctgccattcaattattagatgatggcaacaccattccatttatcgcccgttatcgtaaagaagccacagggggcttagatgacacccagcttcgccattttgaaacccgtttaatttatttacgtgaattagaagaacgtcgtcaaaccatcttgaaatctattgaagagcaaggaaaattgaccgatgaattgcgtgacaaaattcatgcgacacaaagcaaaaccgaattagaagatttatatttgccgtacaaacctaaacgtcgcaccaaagggcaaattgccattgaagctggtcttgagccattggctaatttactttggaatgagccaaaaaatgatccagaatcaaccgcactttcctttgtggatgctgataaaggcgtgacagacaccaaagtagcccttgatggtgcacgctatattttaatggaacgttttgctgaagatgcaggtttattagcgaaagttcgtgattatttagcgaaaaatgccgttatcgtatccaaagtgatcgaaggcaaagaaacggaaggggcaaaattccaagattatttcgatcatcaagaattattgaaaaatgtgccttctcaccgtgcattagccatgttccgtgggcgtaatgaaggcattttacaacttagcttaaatgcggatcctgatgcagaagagggaagtcgccaaagttattgtgaagagattattcgtgattatttagatgtacgtttcactagccagcctgcggataaatggcgtgagcaagtgattgcgtggacatggaaaatcaaagtttcgttgcatttagaaacagaattaatggcgagtttacgtgaaaaagcggaagaagaggccattgatgttttcgctcgaaatctgaccgcacttttaatggctgcccccgctggcgcaaaaagcactatgggcttggacccaggcttgcgtacaggggttaaagttgcggtggtggataacacaggtaaattattagataccaccaccatttatccacacacggggcgtgaagctgaagcgcaagtggcgattttcagcttaatccgcaaacataacgtagaattaattgccattggtaatggtacggcttctcgtgaaaccgaacgctttgcgaaagaagtgattaaagaaattaaagaaaataaacctcaaaccgttgtagtgagcgaagcaggtgcatccgtttattctgcttctgaatttgccgcaaatgaattccctaatttagatgtatctttacgtggtgcggtatcaattgcgcgtcgtttacaagatccattggcagaattagtgaaaatcgaacccaaagccattggtgtagggcaatatcagcacgatgtaaaccaaagccaacttgcacgtaaacttgatgcggtggtggaagattgtgtaaacgcggtaggtgtggatttgaatacagcatccgcgccattgcttgctcgtgtggctgggatgactaaaaccttagcgcaaaacattgtggaatatcgtgatgaaaatggtcgttttgaaagccgtagagaattgaaaaaagtgcctcgtttagggccaaaagcctttgaacaatgtgcaggttttatgcgtattgcaggcgggaaaaatccacttgatgcttcaggtgttcacccagaggcttatcctgtggtcgaaaaaattttgcaagctaccgcgcaatctattcaagatttaatgggtaatgcgggtgtggtacgtcagcttgatgcaaaacaattcattgatgagcaatttggtttaccgaccgtccaagatattttcaaagagttggaaaaaccagggcgtgatccacgtggcgagttcaaaaccgctgtatttgctgagggcgtggaagaaataacggatttaaaatctggaatgattttagaaggaacagtgactaatgtaactaattttggcgcatttgtggatattggtgttcatcaagatggtttagtgcatatttcatcattaagcgataaattcgtggaagatcccctccaagtggtaaaaacaggcaacattgtaaaagtcaaagtgttagaagtggatgtgctgcgtaaacgcattgcattgacgatgcgattagatgaaagtgcggtcaaaaatgacggtaaatctgaccgcactttatccgcaagacctcgtggaaatacgcagcgagaggcgcgtagttcaagaggtaataatgcgatgggcaatgcctttgctgatgcgctaaaaaattggaaaaaa

SEQ ID NO: 4520 - protein, 770 aa, Haemophilus influenzae
  Name: NTH2518
MLNQQISQIIAAELTVQPQQILAAIQLLDDGNTIPFIARYRKEATGGLDDTQLRHFETRLIYLRELEERRQTILKSIEEQGKLTDELRDKIHATQSKTELEDLYLPYKPKRRTKGQIAIEAGLEPLANLLWNEPKNDPESTALSFVDADKGVTDTKVALDGARYILMERFAEDAGLLAKVRDYLAKNAVIVSKVIEGKETEGAKFQDYFDHQELLKNVPSHRALAMFRGRNEGILQLSLNADPDAEEGSRQSYCEEIIRDYLDVRFTSQPADKWREQVIAWTWKIKVSLHLETELMASLREKAEEEAIDVFARNLTALLMAAPAGAKSTMGLDPGLRTGVKVAVVDNTGKLLDTTTIYPHTGREAEAQVAIFSLIRKHNVELIAIGNGTASRETERFAKEVIKEIKENKPQTVVVSEAGASVYSASEFAANEFPNLDVSLRGAVSIARRLQDPLAELVKIEPKAIGVGQYQHDVNQSQLARKLDAVVEDCVNAVGVDLNTASAPLLARVAGMTKTLAQNIVEYRDENGRFESRRELKKVPRLGPKAFEQCAGFMRIAGGKNPLDASGVHPEAYPVVEKILQATAQSIQDLMGNAGVVRQLDAKQFIDEQFGLPTVQDIFKELEKPGRDPRGEFKTAVFAEGVEEITDLKSGMILEGTVTNVTNFGAFVDIGVHQDGLVHISSLSDKFVEDPLQVVKTGNIVKVKVLEVDVLRKRIALTMRLDESAVKNDGKSDRTLSARPRGNTQREARSSRGNNAMGNAFADALKNWKK

SEQ ID NO: 4521 - DNA, 2208 bp, Haemophilus influenzae
  Name: NTH2519
atgtcagaaacgaccaatgataactatggtgcatcgagcattaaagtattaaaaggccttgatgcggtgcgtaaacgtcctggtatgtatatcggcgataccgatgacggtactggtttgcaccatatggtatttgaagtggtggataatgccattgatgaagccctcgctggccattgttccgatattatcgtgacaattcacgatgataattctgtatcggtgcaagatgatgggcgcgggattcctgtggatattcatcctgaagaaggcgtttctgcagcagaagtgattatgactgtgcttcacgcaggcggtaaatttgacgataactcttataaagtatcgggcggtttacacggcgtgggcgtatcagtggtgaatgcgctttctgataagttacaattaaccattcgtcgtcaaggtcacgttcacgagcagttttatcatttaggggagcctcaatcgccattaacagtgattggcgaaacagaggcaacggggacaacggttcgtttctggccaagctcagatatttttgctatcacaacctttgattacaaaatcttagcaaaacgcttacgcgagctttctttcttgaattctggcgtatctattcgtttaatcgataaacgtgatggatctgaagatcatttccattacgaaggcggtattcaagcattcgtagaatatttgaacaaaaataaaaacccaattcatccaaagccattttattttaccgctgagaaagatggtattggcgtagaagttgcattgcaatggaatgatggtgtaaatgaaaacgtgtactgctttaccaataacattcctcaacgtgatggcggtactcacctagctggtttccgtggggctttaacccgtagcttaaatagctatatggaaaacgaaggcatgctgaaaaaagaaaaagtggcgacttcaggcgatgatgcgcgtgaaggtttggtggcgattatttccgttaaagtgcctgatccaaaattctcatcgcaaacgaaagacaaactcgtgtcttcagaagttaaaagtgcggtggaatcagcgatgaatgaaaaaatgcaggaatatttattagaaaatcctgcagatgcaaaaatcattgtaaatcaaattattatggctgctcgtgcgcgcgaagccgcacgtaaagcgcgtgaaatgacgcgccgtaaaggggcattagatattgcaggtttaccgggtaaacttgcagactgccaagaaaaagatcctgcgctttctgaactttacttggtggagggggactccgctggtggttctgcaaaagttggtcgtgatcgtaaaactcaagcaattttgccattgaaaggtaaaatcttaaacgtagaaaaagcacgtttcgacaaaatgttgtcttcccaagaagtgggcacattaattactgctttaggctgcggcattggtcgtgatgaatataacccagataaattacgctatcatcatattattatcatgactgatgctgatgtggatggttctcacattcgtacgttgcttttaacgtttttctatcgtcaaatgcctgagctgattgagcgtggttatgtttacattgctcagccgccactttacaaagtgaaaaaaggaaaacaagaacgctacattaaagatgcggatgaaatggagcaatatgaattaacccttgctttagatggcgcagaattacatatcagcgcaaatgcaccagcaatgaatgcccttgtatttgaaaaattggtggcagaatataacagcgtacaaaaacttatcggtcgtttaaaccgtcattacccagtgcctgtattgcaaggattaatttatcagtcgccaatttctattgaaatgatgaaagaggaaagtgcggttgaaaattggggtaaatcttttgttgaacaactgactgcaaaagaaacagaagcgcatcaatattcagtgcgtacacaatttaatgcggaacgccaagtgtatgaagcggtgattactgttcgcaaacacggtattgataccgattatttcttgaattttgattttgttcacggcaatgaatacgcaaaaattgtttctcttaataaacaactcaatggtttattagaagaaggcgcttatgtcacacgtggtgaaaaagtacaaccagtgcgtagttttgaacaagccgttgaatggctagtgaaagatctcgtaaggtct

SEQ ID NO: 4522 - protein, 736 aa, Haemophilus influenzae
  Name: NTH2519
MSETTNDNYGASSIKVLKGLDAVRKRPGMYIGDTDDGTGLHHMVFEVVDNAIDEALAGHCSDIIVTIHDDNSVSVQDDGRGIPVDIHPEEGVSAAEVIMTVLHAGGKFDDNSYKVSGGLHGVGVSVVNALSDKLQLTIRRQGHVHEQFYHLGEPQSPLTVIGETEATGTTVRFWPSSDIFAITTFDYKILAKRLRELSFLNSGVSIRLIDKRDGSEDHFHYEGGIQAFVEYLNKNKNPIHPKPFYFTAEKDGIGVEVALQWNDGVNENVYCFTNNIPQRDGGTHLAGFRGALTRSLNSYMENEGMLKKEKVATSGDDAREGLVAIISVKVPDPKFSSQTKDKLVSSEVKSAVESAMNEKMQEYLLENPADAKIIVNQIIMAARAREAARKAREMTRRKGALDIAGLPGKLADCQEKDPALSELYLVEGDSAGGSAKVGRDRKTQAILPLKGKILNVEKARFDKMLSSQEVGTLITALGCGIGRDEYNPDKLRYHHIIIMTDADVDGSHIRTLLLTFFYRQMPELIERGYVYIAQPPLYKVKKGKQERYIKDADEMEQYELTLALDGAELHISANAPAMNALVFEKLVAEYNSVQKLIGRLNRHYPVPVLQGLIYQSPISIEMMKEESAVENWGKSFVEQLTAKETEAHQYSVRTQFNAERQVYEAVITVRKHGIDTDYFLNFDFVHGNEYAKIVSLNKQLNGLLEEGAYVTRGEKVQPVRSFEQAVEWLVKDLVRS

SEQ ID NO: 4523 - DNA, 177 bp, Haemophilus influenzae
  Name: NTH2520
atgaatgcagatcaactttgggaaaccacaatggatccaaattcacgtcgtatgttgaaagtttctattaaggatgctgttgcagcagatcaactcttcacgaccttaatgggagatgaagttgagccacgtcgtgagttcattgagctgaatgcgttaagagcaaatttagacgtg

SEQ ID NO: 4524 - protein, 59 aa, Haemophilus influenzae
  Name: NTH2520
MNADQLWETTMDPNSRRMLKVSIKDAVAADQLFTTLMGDEVEPRREFIELNALRANLDV

SEQ ID NO: 4525 - DNA, 702 bp, Haemophilus influenzae
  Name: NTH2521
atgcactcattttctcaacggagaacctttatgaaaccttatcttatcgccccatcaattctttctgccgatcttgcacgtcttggcgatgacgtacaaaacgtacttaatgcaggcgcggatgttattcattttgatgttatggataatcattatgtacctaatctcacttttgggcctgcagtatgtcaagctttacgtgattatggcattaccgcaccgatagatgtgcatttaatggtaaaaccgatcgatcgcattattcccgattttgctaaagcgggtgcgaactacatcacttttcacccagaatctagcgaacatattgaccgctctttgcagcttattcgcgattgtggttgtaaatctggattagtttttaatcctgcgacgccgttgagctatttagattatgttttggataaagtggatgtggttttattaatgtcagtgaatcctggatttggcggacaatcttttattccagcaacattgaagaaattacaacaggctcgtaagatcattgatgaaagtggttatgacattcgtcttgaagtagatggtggcgtgaaggttgataacatcgcagaaattgccgcggcgggtgcagatatgttcgtggcaggttctgcaatttttggtaagccagattataaacaagttattgaccaaatacgtacacagttagcaagtgttagcgca

SEQ ID NO: 4526 - protein, 234 aa, Haemophilus influenzae
  Name: NTH2521
MHSFSQRRTFMKPYLIAPSILSADLARLGDDVQNVLNAGADVIHFDVMDNHYVPNLTFGPAVCQALRDYGITAPIDVHLMVKPIDRIIPDFAKAGANYITFHPESSEHIDRSLQLIRDCGCKSGLVFNPATPLSYLDYVLDKVDVVLLMSVNPGFGGQSFIPATLKKLQQARKIIDESGYDIRLEVDGGVKVDNIAEIAAAGADMFVAGSAIFGKPDYKQVIDQIRTQLASVSA

SEQ ID NO: 4527 - DNA, 672 bp, Haemophilus influenzae
  Name: NTH2522
atgaacacacaatttaaacttattggctttgatttagacggcaccttggtaaatagcttgcctgatttagcgttatccgtaaattctgccttggctgaatttaatttaccgaaagcgccagaagaattagttttaacttggatcggtaatggcgcgcctgtattaattgctcgagcgttagattgggcgaaaaaacaaacaggaaaagtgctaactgaaacagaggttaagcaagtaacagaacgttttaatttttattatggcgagaatttatgtaatgtcagccgcttgtatccaaatgtaaaagaaactttagaaaccttgaaagaaaaaggctatgtcctagcagttgttaccaataaacccacaagacatgttcaacctgtgttggcagcatttggcattgatcatttatttagtgaaatgttgggcggtcaatccttacctgccattaagccacatccagctccactttattatttatgcggaaaatttggttttgaaccacgccaagtgcttttcgtgggcgattctaaaaatgatattatcgcggctcacgctgcgggctgtgcagttgttggtttaacttacggctacaattacaatatccctatcactgaatccaatccagattgggtgtttgatgattttgcccagctattaacgattctt

SEQ ID NO: 4528 - protein, 224 aa, Haemophilus influenzae
  Name: NTH2522
MNTQFKLIGFDLDGTLVNSLPDLALSVNSALAEFNLPKAPEELVLTWIGNGAPVLIARALDWAKKQTGKVLTETEVKQVTERFNFYYGENLCNVSRLYPNVKETLETLKEKGYVLAVVTNKPTRHVQPVLAAFGIDHLFSEMLGGQSLPAIKPHPAPLYYLCGKFGFEPRQVLFVGDSKNDIIAAHAAGCAVVGLTYGYNYNIPITESNPDWVFDDFAQLLTIL

SEQ ID NO: 4529 - DNA, 90 bp, Haemophilus influenzae
  Name: NTH2524
gtgtttacccataaaaaatctgcccctcaattgttggtttggttagtccaacttttggggtgcagatcaattttcaccgcacttttttgt

SEQ ID NO: 4530 - protein, 30 aa, Haemophilus influenzae
  Name: NTH2524
VFTHKKSAPQLLVWLVQLLGCRSIFTALFC

SEQ ID NO: 4531 - DNA, 138 bp, Haemophilus influenzae
  Name: NTH2525
ttgggtggcggtggcattctggcatatttgggtttcattggcggtcgtcctgatggtttacggggaatcagtccatttatgccacttttttcaaaccgtttcaaccatgtcccgactaaggcgttggaaggaatattg

SEQ ID NO: 4532 - protein, 46 aa, Haemophilus influenzae
  Name: NTH2525
LGGGGILAYLGFIGGRPDGLRGISPFMPLFSNRFNHVPTKALEGIL

SEQ ID NO: 4533 - DNA, 351 bp, Haemophilus influenzae
  Name: NTH2526
atgggtaaacactacacaatcgaatttaaattacaggctctccaacctattttgaatggaaaaatgagtattagagaagcggctcgtttttacaatattccttccaacgccttagtcgggacatggttgaaacggtttgaaaaaagtggcataaatggactgattccccgtaaaccatcaggacgaccgccaatgaaacccaaatatgccagaatgccaccgccacccaaaactgaagaagaccgtttacgtttgagaattttacagcttgaagcggaggtagcctacctaaaggagttgagaaggctcagacttcaggaagaagccgagcaacagaaattatccaaaggt

SEQ ID NO: 4534 - protein, 117 aa, Haemophilus influenzae
  Name: NTH2526
MGKHYTIEFKLQALQPILNGKMSIREAARFYNIPSNALVGTWLKRFEKSGINGLIPRKPSGRPPMKPKYARMPPPPKTEEDRLRLRILQLEAEVAYLKELRRLRLQEEAEQQKLSKG

SEQ ID NO: 4535 - DNA, 114 bp, Haemophilus influenzae
  Name: NTH2527
ttgccaggtgtgaatcatatcgtcgaatcttggctgaacatggcatcattcaaagtatgtcgagaaaagggaattgcttggacaatgcagcgatggaaagtttctttgggcgat

SEQ ID NO: 4536 - protein, 38 aa, Haemophilus influenzae
  Name: NTH2527
LPGVNHIVESWLNMASFKVCREKGIAWTMQRWKVSLGD

SEQ ID NO: 4537 - DNA, 855 bp, Haemophilus influenzae
  Name: NTH2528
atgaaaacatctatttatcaattaaagtggggaacctttaatcttattgaaggggattttattagccaatatgctgcactttatggcgaatggtcagatgtagaagtccaattttttttggaaaacctaaattcttcaagtaatgtcattgaagttggttcgaatattggaatgcacgcagttcctattgcaaagacaataagtggggggggggggaaattattttgttttgaacctcaaagagtaatttttcagacactttgtgcgaatttgtcgcttaatcaattaacaaatgttcatgcctataatttgggggttggtgaaaatgaacagttgattgagattccctcatcaaattatgatactgcttggaattatggaagtttttcattagataaagggtttagtaccgagggtaattttataggtgtagaatctaaggaattgatacatgttatttctttagataaacacccagaagttaatcgattggaagatatagatctattaaaaattgatgctgaaggatttgagctaaatgttttaaatggtgcaaagaatctcatagagagacataagcctataatttttgtagaagctcatattcatcactctaatgagttgatatcctatttagataagattggttataagtgttattggtttatttctgaacgttatcaaaaaaataactactttaagcaggagaaatctcttggtggaatggactttaatttagcttgtttccataagagtaaacaatcaacattaccagaggaactacggacaacaccaaataatttattaactgaaataccaatagtaagtaacagatttgatctgcccccaaaaagt

SEQ ID NO: 4538 - protein, 285 aa, Haemophilus influenzae
  Name: NTH2528
MKTSIYQLKWGTFNLIEGDFISQYAALYGEWSDVEVQFFLENLNSSSNVIEVGSNIGMHAVPIAKTISGGGGKLFCFEPQRVIFQTLCANLSLNQLTNVHAYNLGVGENEQLIEIPSSNYDTAWNYGSFSLDKGFSTEGNFIGVESKELIHVISLDKHPEVNRLEDIDLLKIDAEGFELNVLNGAKNLIERHKPIIFVEAHIHHSNELISYLDKIGYKCYWFISERYQKNNYFKQEKSLGGMDFNLACFHKSKQSTLPEELRTTPNNLLTEIPIVSNRFDLPPKS

SEQ ID NO: 4539 - DNA, 225 bp, Haemophilus influenzae
  Name: NTH2529
gtgtttaaaccattctctttggcagattttcgatggaaaatgcggcactttactttggtattgcgagtagtggaaccccttagtcaatggttgaaagcctttcggaaaaacggtataaatgggtgccatcccaaacctaaaggtcgcccaagtatgaaacccaaatacgctaaaatgtctccaccacccaaaacagaagaacgtttacgcctacgcatccttgag

SEQ ID NO: 4540 - protein, 75 aa, Haemophilus influenzae
  Name: NTH2529
VFKPFSLADFRWKMRHFTLVLRVVEPLSQWLKAFRKNGINGCHPKPKGRPSMKPKYAKMSPPPKTEERLRLRILE

SEQ ID NO: 4541 - DNA, 396 bp, Haemophilus influenzae
  Name: NTH2530
ttgagagtgcattatccttatagattaagtcgtcgcccaaatggcatgttagtgcaagaaatgttgttacaagcggtgaaaaaattacagagaaatgcgaatttgatattacattcagaccaaggaatccattatcaaatgcttagctatcaacgcttattagcgaaaaataggatttctcaaagtatgtcgagaaaagggaattgcttggacaatgccgcgatggaaagtttctttgggcgattaaaaacagaatgtttttatggtagggaatttaacagcagagaagagatagttgatgccgtcagggattatttggattactataaccaccgacggattcaactaaaattaaaagggctgagtccgatacaatatcgaaaacaatcctttaaa

SEQ ID NO: 4542 - protein, 132 aa, Haemophilus influenzae
  Name: NTH2530
LRVHYPYRLSRRPNGMLVQEMLLQAVKKLQRNANLILHSDQGIHYQMLSYQRLLAKNRISQSMSRKGNCLDNAAMESFFGRLKTECFYGREFNSREEIVDAVRDYLDYYNHRRIQLKLKGLSPIQYRKQSFK

SEQ ID NO: 4543 - DNA, 1107 bp, Haemophilus influenzae
  Name: NTH2531
atggcattggcattttggtcaatgactattgtggttgcgcctatttttggcccaattttaggcggatggattagcgataatatccattggggatggatcttttttatcaatgttccgatcggtttgttagttgtgctaatcagctggaagattttgggaagcagagaaagtgaaattgttcatcaacctattgataaagtcggtttagttttacttgtcttaggagtgggatgtttgcaattaatgcttgatcagggtcgtgagcaagattggtttaattctaatgaaatcattatattagccgttgttgctgtcgtttgtctgattgccttggttatttgggaattgacagatgacaatcctgtagtggatatttcacttttccattctcgtaattttagcgtagggtgtttatgtactagtttagcctttttgatttatctaggttctgtggtattaattccgctcttgctacaacaagtcttccattacaccgcgacgtgggcagggcttgcggcttccccagttggattattcccaattttgctttcaccgattattgggcgtttcggttataagatcgatatgcgaattttagtgacgataagctttattgtatatgcaataacattttattggcgagcggtaactttcgagccatcaatgacatttgttgatgtagctttaccacaattagtgcaaggtttagcggtgtcctgtttctttatgccacttactacaataacgctgtctggcttgcctgcgcataaaatggcttcagcctctagcttatttaactttttgagaactttagcgggttctgtaggaacatctttgaccacatttatgtggtataaccgtgaagctgttcaccacactcaattaacagaacacattaatccttataacccgatttcccaaagtttttaccatcaaatgaatcaatttggtttaagtgatacgcaaacttcagcttacctcgctcaacaaataacatcgcaaggatttattattggcgcaaatgaaatattttggttatcagctatgggattcttaggattgcttattgtgatttggtttgcaaaaccaccttttagtactcagcat

SEQ ID NO: 4544 - protein, 369 aa, Haemophilus influenzae
  Name: NTH2531
MALAFWSMTIVVAPIFGPILGGWISDNIHWGWIFFINVPIGLLVVLISWKILGSRESEIVHQPIDKVGLVLLVLGVGCLQLMLDQGREQDWFNSNEIIILAVVAVVCLIALVIWELTDDNPVVDISLFHSRNFSVGCLCTSLAFLIYLGSVVLIPLLLQQVFHYTATWAGLAASPVGLFPILLSPIIGRFGYKIDMRILVTISFIVYAITFYWRAVTFEPSMTFVDVALPQLVQGLAVSCFFMPLTTITLSGLPAHKMASASSLFNFLRTLAGSVGTSLTTFMWYNREAVHHTQLTEHINPYNPISQSFYHQMNQFGLSDTQTSAYLAQQITSQGFIIGANEIFWLSAMGFLGLLIVIWFAKPPFSTQH

SEQ ID NO: 4545 - DNA, 768 bp, Haemophilus influenzae
  Name: NTH2532
gtggcacatcgagattttgctgcgcgtcgtagctcaaataataagaaaaaaaataagaaaaagaatacaaatgtcttgatttttcttgctttatttattgttctagtttttgttgttggactttatttgttgaaaaatcagaacagtaaggtaagcgtgcagcaagctataacacaacaggaaaaagctcaacctaaaagtgtgttacctaatcgtccagaggaagtgtggagttatattaaagccttagaaacgcgtactgtacctgtagataataatccagcgagtgtagaacaaaatatgcgtttaacagaagaacaacgtcaagttttaattcaaatagaaagagatcaaaaagcggctgatgaagctagaaaactggctgagcaacagagaatagaagatgcaacgagaactcaatccaaaaaaacggaagatatgaaaaatacagagtcagaaatcgtaaaattggaatcaattaaaaagcaagactcacagaaaattgaaagcgcaaaaaaagtagaacaaataaaaacggttaataatgtacgggatagcaagaaatttggtttacaatgcggtgcttttaaaaatcgagcgcaagctgaaaatttgcaaggtcgtttacagatgacaggattaaatgctcaaatacaaactaacggcgaatggaaccgtgttcgtgtagcaagttttgatactcgagagcttgcagtacaggcgcaaagtagagctaaaactgttaccgattgtgttgtgattggtatg

SEQ ID NO: 4546 - protein, 256 aa, Haemophilus influenzae
  Name: NTH2532
VAHRDFAARRSSNNKKKNKKKNTNVLIFLALFIVLVFVVGLYLLKNQNSKVSVQQAITQQEKAQPKSVLPNRPEEVWSYIKALETRTVPVDNNPASVEQNMRLTEEQRQVLIQIERDQKAADEARKLAEQQRIEDATRTQSKKTEDMKNTESEIVKLESIKKQDSQKIESAKKVEQIKTVNNVRDSKKFGLQCGAFKNRAQAENLQGRLQMTGLNAQIQTNGEWNRVRVASFDTRELAVQAQSRAKTVTDCVVIGM

SEQ ID NO: 4547 - DNA, 3096 bp, Haemophilus influenzae
  Name: NTH2533
atgtatgaggaaatccgaatgaaatttaccgatatatttattcgccgtcctgttttagcagtttcaattagtttgttaatgattattttagggttgcaagcaatctcgaaattggcagtgcgtgaataccctaaaatgactactacagtcattacagtgagtaccgcatatccaggggcagatgcgaatttaatccaagcatttgttacgtcaaaattggaagaatctatcgcgcaagccgataatattgattatatgtcttcgactagtgcgcctagtagttcgactattacaataaaaatgaaattaaataccgatcctgcaggcgcgttagcagatgtgttagccaaagtgaatgcagtaaagtcagcattaccaaatggtattgaagatcctagtgtatcctcttcttcaggtgggagcggtattatgtatatcagtttccgatctaaaaaactagattctagtcaggtaactgattacatcaatcgtgtagtcaaacctcaattctttacgattgaaggcgtggcagaagtacaagtatttggtgcggctgagtatgcattacgtatttggctagatccacaaaaaatggcagctcaaaatctttctgtgccaacagtgatgtctgccctttctgcaaataatgtacaaacggctgcggggaacgataatggctattatgtgagttatcgtaataaagtagagactacaacgaaatcagtggaacaactcagcaacttaattatttcatcaaatggcgatgatttagtgcgtttgcgtgatattgcaaccgttgaattaaataaagaaaatgataattcgcgtgctacggcaaatggtgcagagtccgttgtgttagccatcaatccaacctcgacagcaaaccctttgactgtcgcagaaaaaattcgccctttatatgaaagtataaaaacacaactgccagacagtatggaaagcgatattctttatgaccgcactattgccattaatagctctattcacgaggtcataaaaactattggtgaagctactttgatcgttttagtggtaattttaatgtttatcggttcgttccgtgctattttaattccaatattggctattccaatttctcttattggcgtattaatgctgctacaaagtttcaacttttctattaatttaatgaccttgcttgctttaattcttgccataggtttagttgtagatgatgctattgtggtgctggagaatattgatcgtcatattaaagcgggagaaacgccattccgagcggcgattattggtacgcgtgaaattgccgtgcctgtaatttctatgactatcgcattgatcgcagtttactcaccaatggctttaatgggggggattactggcacattgtttaaagagtttgctttaacccttgctggtgcagtatttatttctggtgttgtggcattaacgttatcgccaatgatgagtagtaagttactcaaatccaatgctaaaccaacatggatggaagaacgcgtagaacataccttatgtaaagtaaatcgtgtttacgaatacatgcttgatctcgttatgctcaatcgtaaatcaatgctggcttttgcggtcgtgattttctcaacgctcccatttttgtttaattcactttctagtgaattaacgccaaatgaagataaaggcgcatttattgcaattggtaatgcgccatctagcgtaaatgtggattacattcaaaatgcaatgcaaccatatatgaaaaatgtaatggaaacacccgaagtctcttttggtatgagcattgctggtgcgccaacttctaatagctcgttaaatatcatcacattgaaagattggaaagaacgttcacgtaaacaatccgcaataatgaatgaaattaatgaaaaagcaaaatcaattccagaagtgtcagtatcagcatttaacattcctgaaattgatacaggggaacaaggcgctccagtctctattgtattgaaaactgcgcaagattataaatctttggcaaacaccgcagagaaattcctcagtgcgatgaaagcctctggcaaatttatttatacaaatttagatttgacctatgacacggcgcaaatgacaatttcagtagataaagagaaagctggtacttacggcatcacgatgcaacaaatcagtaatactttagggagtttcttatctggtgcgacagttacgcgtgtggatgtggatggacgcgcttataaagtcatttcgcaggtaaaacgagatgatcgcttatcgccagaaagtttccaaaattattatttaactgcatctaatggtcaatcagtgccattaagtagtgttattagtatgaaattagaaactcagccaacatcattaccgcgtttcagccaattaaattcggctgaaatcagtgctgtaccaatgccgggtatatcaagtggtgatgccattgcttggcttcaacaacaggcaaatgataatttgccacaaggatacacttatgatttcaaatccgaagctcgtcaattagtacaagagggtaatgcacttacgacgactttcattcttgctgttgtaattattttcttggtgcttgccattcagtttgaatctatacgtgacccaatggtaattatgatttccgtaccattagccgtaagtggtgcattggtgagcttaaatattttatccttctttagcatcgcaggaacaacattaaatatctactctcaagttgggttgattactctcgtgggattaatcactaaacacggtatcttaatgtgtgaagtggcaaaagaagaacagctaaactatggtaaaactcgaattgaggcaatcactcacgcggcaaaagtgcgtttgcgtccaattctaatgacaacggcggcaatggtagctggcttaattccattactctatgcaacaggtgcgggagcggtatctcgctttagtattgggatagtgattgtagcgggattatccattggtactattttcaccttgttcgtcttgcctgtggtatatagctatatcgcaactgaacacaaaccattaccggtttttgatgaaaataaaacaacccac

SEQ ID NO: 4548 - protein, 1032 aa, Haemophilus influenzae
  Name: NTH2533
MYEEIRMKFTDIFIRRPVLAVSISLLMIILGLQAISKLAVREYPKMTTTVITVSTAYPGADANLIQAFVTSKLEESIAQADNIDYMSSTSAPSSSTITIKMKLNTDPAGALADVLAKVNAVKSALPNGIEDPSVSSSSGGSGIMYISFRSKKLDSSQVTDYINRVVKPQFFTIEGVAEVQVFGAAEYALRIWLDPQKMAAQNLSVPTVMSALSANNVQTAAGNDNGYYVSYRNKVETTTKSVEQLSNLIISSNGDDLVRLRDIATVELNKENDNSRATANGAESVVLAINPTSTANPLTVAEKIRPLYESIKTQLPDSMESDILYDRTIAINSSIHEVIKTIGEATLIVLVVILMFIGSFRAILIPILAIPISLIGVLMLLQSFNFSINLMTLLALILAIGLVVDDAIVVLENIDRHIKAGETPFRAAIIGTREIAVPVISMTIALIAVYSPMALMGGITGTLFKEFALTLAGAVFISGVVALTLSPMMSSKLLKSNAKPTWMEERVEHTLCKVNRVYEYMLDLVMLNRKSMLAFAVVIFSTLPFLFNSLSSELTPNEDKGAFIAIGNAPSSVNVDYIQNAMQPYMKNVMETPEVSFGMSIAGAPTSNSSLNIITLKDWKERSRKQSAIMNEINEKAKSIPEVSVSAFNIPEIDTGEQGAPVSIVLKTAQDYKSLANTAEKFLSAMKASGKFIYTNLDLTYDTAQMTISVDKEKAGTYGITMQQISNTLGSFLSGATVTRVDVDGRAYKVISQVKRDDRLSPESFQNYYLTASNGQSVPLSSVISMKLETQPTSLPRFSQLNSAEISAVPMPGISSGDAIAWLQQQANDNLPQGYTYDFKSEARQLVQEGNALTTTFILAVVIIFLVLAIQFESIRDPMVIMISVPLAVSGALVSLNILSFFSIAGTTLNIYSQVGLITLVGLITKHGILMCEVAKEEQLNYGKTRIEAITHAAKVRLRPILMTTAAMVAGLIPLLYATGAGAVSRFSIGIVIVAGLSIGTIFTLFVLPVVYSYIATEHKPLPVFDENKTTH

SEQ ID NO: 4549 - DNA, 1257 bp, Haemophilus influenzae
  Name: NTH2534
ttgaacgctcttggcgtgcgattcagaaataattgttgttatttttataacggagctttaaacatgagtcaaactcaacatcaaagaccaaaacgctcacatattttcttgatgaaaataattttagtggtatttgtcttaatttttgtcggtgtcatcggttttaatataataaaaggcgtaatgataagccgagccattgcagaaatgccagaatcttcaagcccagtaaccgcacttgaagttcaaccgcgtgaatggacgccagttattaacacaacaggtcttgtgcgtccaaatcaaggcgcattgctcagtacacaaaatgcaggtacgatttctcaagtacttgtgcaaaatggacaaaatgtgaaaaaaggtgaggtgcttgtggaacttgatagttctgttgaacgagctaatctacaagctgctcaggcacaattatcagcacttcgtcaaacttaccagcgttatgtgggtttattaaacagcaatgctgtatcacgtcaagaaatggataacgcaaaagcggcttatgacgctcaactagccaatatcgaatctttaaaagcagtaattgagcgccgtaaaattgttgcgccatttgatggcaaagcaggtattgtgaaaatcaatgttggacaatatgtgaatgttggaacagaaattgtgcgtgtagaagatactagctcaatgaaagtggattttgctctttcacaaaatgatttagataaattacatatcggtcagcgcgttacagcgacaacagatgctcgcttgggcgaaacattttcagctcgaattacggctattgaacctgccattaattcatcaacaggtttagttgatgttcaagctacatttaatcctgaagatgggcataaattgctttcaggtatgttctctcgtttacgcattgcgctaccaactgaaacaaatcaagttgtcgttccacaagtagctattagctacaatatgtatggcgaaattgcctatttacttgaaccattatctgaagaagaaaaaggaaaaatgtcaggtaatgaaaaattggatcgtctctatcgtgcgaaacagatcaccgtatttactaaagatcgtcaaggtgtttatgctcaattacagggaaatgaagttaaagcgggagataaaattattacaggcggtcagcaaggtattggtaatggaagtcttgtggaatggattaaaaaagacattgtgggtgcagtagagcctgcacataaaacaccactt

SEQ ID NO: 4550 - protein, 419 aa, Haemophilus influenzae
  Name: NTH2534
LNALGVRFRNNCCYFYNGALNMSQTQHQRPKRSHIFLMKIILVVFVLIFVGVIGFNIIKGVMISRAIAEMPESSSPVTALEVQPREWTPVINTTGLVRPNQGALLSTQNAGTISQVLVQNGQNVKKGEVLVELDSSVERANLQAAQAQLSALRQTYQRYVGLLNSNAVSRQEMDNAKAAYDAQLANIESLKAVIERRKIVAPFDGKAGIVKINVGQYVNVGTEIVRVEDTSSMKVDFALSQNDLDKLHIGQRVTATTDARLGETFSARITAIEPAINSSTGLVDVQATFNPEDGHKLLSGMFSRLRIALPTETNQVVVPQVAISYNMYGEIAYLLEPLSEEEKGKMSGNEKLDRLYRAKQITVFTKDRQGVYAQLQGNEVKAGDKIITGGQQGIGNGSLVEWIKKDIVGAVEPAHKTPL

SEQ ID NO: 4551 - DNA, 588 bp, Haemophilus influenzae
  Name: NTH2535
ttgctccttattttactcaaggatcttatgcgacaagctaaaactgatttagccgaacaaatttttcttgctaccgatcgtttaatggcaaaagaaggtttagatcggctttctatgcataaaatcgcaaaagaggcaaatgtagcagcaggaacgatttacctttatttcaaaaacaaagatgagttgcttgaacaatttgcacatagagtgttttcaatgtttatggcaacacttgaaaaagattttgatgaatctaagccttttttcgaacagtatcgacaaatgtggaaaaatatttggtatttcttacaagaaaatcccaccattctatccaatttaaagcaatatgaatctttgcctaatttcaaggatatttgtaaaaacgttaaaaattgtcgttgggatttattttgtgaccaagccaaaaaagctggcttattagcggaattatctgaagatattctctttttattaagtttgaaaacggcgataaatttagcctctgatgcaaaatttatcgatttcgatcttaagcctgaaattttagaatctgtgattgaacgctcttggcgtgcgattcagaaa

SEQ ID NO: 4552 - protein, 196 aa, Haemophilus influenzae
  Name: NTH2535
LLLILLKDLMRQAKTDLAEQIFLATDRLMAKEGLDRLSMHKIAKEANVAAGTIYLYFKNKDELLEQFAHRVFSMFMATLEKDFDESKPFFEQYRQMWKNIWYFLQENPTILSNLKQYESLPNFKDICKNVKNCRWDLFCDQAKKAGLLAELSEDILFLLSLKTAINLASDAKFIDFDLKPEILESVIERSWRAIQK

SEQ ID NO: 4553 - DNA, 93 bp, Haemophilus influenzae
  Name: NTH2536
ttgagtaaaataaggagcaataattgctcaaaaatgaatggacgttcattttatttattttttattttttggcaagttaaaaaacaaaaagcg

SEQ ID NO: 4554 - protein, 31 aa, Haemophilus influenzae
  Name: NTH2536
LSKIRSNNCSKMNGRSFYLFFIFWQVKKQKA

SEQ ID NO: 4555 - DNA, 144 bp, Haemophilus influenzae
  Name: NTH2537
gtgcggttaattttgactgcattttatattcctattttttatatcctcctttgtttatcattcatcttatgggtttacggattacctacagataagtattgttacgctttttgttttttaacttgccaaaaaataaaaaataaa

SEQ ID NO: 4556 - protein, 48 aa, Haemophilus influenzae
  Name: NTH2537
VRLILTAFYIPIFYILLCLSFILWVYGLPTDKYCYAFCFLTCQKIKNK

SEQ ID NO: 4557 - DNA, 1254 bp, Haemophilus influenzae
  Name: NTH2538
gtgatttttatgcaacaagattatttaagccaacaacgattctccgctcttcctctacatccgattgtgcgaggtgctttggcaaaaaaaggctttgatttttgtaccccaattcaggctttatccttgcctatcagtttaaatggacgagatgttgcaggacaagctcaaacgggtacaggcaagacaatggcttttttaacggctacttttcaccatcttttaactcaccaagatcctaatcttgaatatcctcacccaagaactttgattttagcacctactcgagaattagcggtacagattagtaatgacgcagaatttcttgcaaaagcgagtggattaaagaccgcacttgcctatggtggcgatggttatgataaacaactacaagtgattgagcgtggcgtagatattttgattggtacgacggggcgagtcattgattatgtaaaacaaggcgtaattggtttagatgaaatccaagttgtcgtgctagatgaagcggatcgaatgtttgatcttgggtttatccgtgatattcgttatttattgcgtaaatgccccgctccgcaagcgcgtttaacgatgttattttcagcgacgctttcttataaagtgcgtgaattagcatttgaggatatgaatgatcctgaatatattgaaatagaaccggaacaaaaaacaggtcatcgtattaaagaagaacttttttatccatctaatcaggataaaatggcacttctcttaaccttaatggaagatgaatggcctgagcgctgtattgtgtttgcgaatacaaaacatcgttgtgaagaaatttggggttatttggcggctgatggacatcgtgttggtttactgactggcgatgtagcccagaaaaaacgtttatcgttattaaaacaatttaccgacggtgatttagatattttagtagcaacagatgtggctgctcgtggcttgcatatttctgatgtgacgcatgttttcaattatgatttacctgatgatagggaagattacgttcaccgaattggccgtactggacgagcaggggaaagtggcgtttcgattagttttgcttgcgaagaatatgcgatgaatttaccaggaattgaagaatatattggccattctatcccagtgagccaatatgaaacagaagccttgcttgaactgccgaaaccgtatcggttaaaacgtgcagtaccaccgcaagggcatacaagacatcgttcttatcacacaaaa

SEQ ID NO: 4558 - protein, 418 aa, Haemophilus influenzae
  Name: NTH2538
VIFMQQDYLSQQRFSALPLHPIVRGALAKKGFDFCTPIQALSLPISLNGRDVAGQAQTGTGKTMAFLTATFHHLLTHQDPNLEYPHPRTLILAPTRELAVQISNDAEFLAKASGLKTALAYGGDGYDKQLQVIERGVDILIGTTGRVIDYVKQGVIGLDEIQVVVLDEADRMFDLGFIRDIRYLLRKCPAPQARLTMLFSATLSYKVRELAFEDMNDPEYIEIEPEQKTGHRIKEELFYPSNQDKMALLLTLMEDEWPERCIVFANTKHRCEEIWGYLAADGHRVGLLTGDVAQKKRLSLLKQFTDGDLDILVATDVAARGLHISDVTHVFNYDLPDDREDYVHRIGRTGRAGESGVSISFACEEYAMNLPGIEEYIGHSIPVSQYETEALLELPKPYRLKRAVPPQGHTRHRSYHTK

SEQ ID NO: 4559 - DNA, 204 bp, Haemophilus influenzae
  Name: NTH2539
atgcctgacgaaatgattgaagtaccttgtccgatttgccaaaaatcggtgccttggataaatgaaagtacttttcgacctttttgtagcaaacgttgccagttaattgatcttggcgaatgggcggctgaagaaaaagcgattccaagtgatactgctgattttgcaatggatccaaatgtgagtgacggatggagcattaaa

SEQ ID NO: 4560 - protein, 68 aa, Haemophilus influenzae
  Name: NTH2539
MPDEMIEVPCPICQKSVPWINESTFRPFCSKRCQLIDLGEWAAEEKAIPSDTADFAMDPNVSDGWSIK

SEQ ID NO: 4561 - DNA, 630 bp, Haemophilus influenzae
  Name: NTH2541
atgggaaattatatgacttatattgttggcttaactggtggcattggtagtggtaaaacaacgattgctaatttatttaccgatcttggcgtacctctagtggatgcggatgtggttgctagagaagtcgtcgcgaaagattcccccttattgtcaaaaattgttgaacattttggggctcaaattttaacggaacaaggcgagcttaatcgcgcggctttacgagagcgagtgtttaaccatgatgaagataaattgtggttaaataaccttctacatcccgctattcgtgaacgaatgaaacaaaaattagctgaacaaactgcgccttacacattatttgtcgtccctttattaatagaaaataaattgaccgcactttgtgatcgtattttggtggtggatgtgagtccacaaactcaacttgctcgttcatcacaacgagataacaataattttgagcaaattcaacgaattatgaattctcaagtttctcaacaagagcgtttaaaatgggcagatgatgtgattaacaatgattctgaactggcccaaaacttaccgcacttgcagcaaaaggtgctagaattgcaccagttttatttacaacaagcggaaaataaaaatgcc

SEQ ID NO: 4562 - protein, 210 aa, Haemophilus influenzae
  Name: NTH2541
MGNYMTYIVGLTGGIGSGKTTIANLFTDLGVPLVDADVVAREVVAKDSPLLSKIVEHFGAQILTEQGELNRAALRERVFNHDEDKLWLNNLLHPAIRERMKQKLAEQTAPYTLFVVPLLIENKLTALCDRILVVDVSPQTQLARSSQRDNNNFEQIQRIMNSQVSQQERLKWADDVINNDSELAQNLPHLQQKVLELHQFYLQQAENKNA

SEQ ID NO: 4563 - DNA, 1263 bp, Haemophilus influenzae
  Name: NTH2542
atgtttacaagaaatatgactatcgctgattacgatccagtattgtggcaagcgatccaagatgaaaatcgtcgtcaagaagaacatatcgaactcattgcatctgaaaactatgcgagtccacgtgtgatggaagcgcaaggttcacaattcactaataaatatgcggaaggctatccaggtaaacgttattacggtggttgtgagtatgcggacattgtggaacagttagcaattgaccgtgcgaaagaattatttggtgcagattacgtgaatgttcaaccgcactctggatcacaagcgaatgctgcggtgtatggtgcattgattaatgcaggcgatactattttaggtatggatttggctcacggtggtcatttaactcacggtgcaaaagtcagtttctctggcaaaatttataactccgtactttatggaattactgcggatggcttaattgattatgaagatgttcgtcaaaaagcattagaatgtaaaccaaaacttatcgttgctggtttctcggcttattcacaagttgtggattgggcgaaaatgcgtgaaatcgcagatgaagttggtgcgtatttatttgtggatatggcgcatgtagcgggattaattgcagcgggtttatatctaaatccactccctcatgcacatgttgtgacaacaacaacccataaaacgttgggcggtccgcgtggtggtttaattctttcatcttgtggcgatgaagaaatctacaaaaaattacaatcatccgtattccctgcaaatcaaggtggtccattagttcatattattgcggcaaaagcagtttgctttaaagaagcattagagcctcaatataaagaataccaagcaaatgtaatcaaaaatgcgaaagcaatggttgaggtatttaaacaacgtggttatgacgttgtgtcaaatggcactgaaaaccacttgttcttagtaagttttattaaacaaggattaacaggtaaagcagctgatgcggcattaggcaaagcaaatattacagtgaataaaaatgctgtaccaaacgatccgcaaaaaccattcgtcacttctggcatccgtgtaggtacaccatctgtgactcgccgtggtttcaatgaaaatgatgtgcgtgaattagctggctggatgtgtgatgttttagatgctttaggcaaagaaaatgaagaacaagtgattgctgaaactaaagaaaaagtattagcaatttgtaaacgtcttccagtttatccgaaa

SEQ ID NO: 4564 - protein, 421 aa, Haemophilus influenzae
  Name: NTH2542
MFTRNMTIADYDPVLWQAIQDENRRQEEHIELIASENYASPRVMEAQGSQFTNKYAEGYPGKRYYGGCEYADIVEQLAIDRAKELFGADYVNVQPHSGSQANAAVYGALINAGDTILGMDLAHGGHLTHGAKVSFSGKIYNSVLYGITADGLIDYEDVRQKALECKPKLIVAGFSAYSQVVDWAKMREIADEVGAYLFVDMAHVAGLIAAGLYLNPLPHAHVVTTTTHKTLGGPRGGLILSSCGDEEIYKKLQSSVFPANQGGPLVHIIAAKAVCFKEALEPQYKEYQANVIKNAKAMVEVFKQRGYDVVSNGTENHLFLVSFIKQGLTGKAADAALGKANITVNKNAVPNDPQKPFVTSGIRVGTPSVTRRGFNENDVRELAGWMCDVLDALGKENEEQVIAETKEKVLAICKRLPVYPK

SEQ ID NO: 4565 - DNA, 1434 bp, Haemophilus influenzae
  Name: NTH2543
ttgtttgttttttcaaaatatagaattacaagaatattagttggcgctttatttgcaataagtattgttgttaataatgtacattatgcagtataccaatcttggattggacctgttaattactcacttgcatttaaagaaattaatgagataacaaatgctggcttaacaatgatagataaattcatatatccattgttatttggtttatttgaagttgctgtgtttttaagtttaagtttcataaaaagaaaagtatataaactttcttggatttttgactttattttttatgctgtgatgatgtatgtttttgttcgagcgtatacaacaaaatcccatgagcgttttatttcacctaacactgtttattctcgattaaaatccaattatttatcgttgggttattttataggacgaattgttccttatgagatattttctttatctaatattcctctttatcataaatctaagcctatgaaatcgggctctccgaaaattaagaatataattttaattatgggggaaagtgcgacctcaagtcattttagtgcttttggttacgggagaaaaacatctccttttttagatagcttaaaatataaatcaggagctcttgttggtaaaacttattcaggaggaaagctaacagcaatttctttaccaatgttttttaatgcaattccttatccaaatggaatacaacagatagctaaaggagatacgaatttatttaatttagcgaaagagcaaggctttcagacatatttttattcagctcaagctagggatgatatgcatatgatcaattttttaggaggagcttggattgatgatattcgttttccagataatgaagggtattctttaagagattcaatgcctgataataaattacttcctgcttttaaaaatattaatttagataatggttatcattttgttgttttacatcatagagggagtcatattccctatggggcattattagatgaaaaagagaaggtgtttggaaaaaataacgcaacagataattatgataatactattctaaatactgataactttatctcagaggtttaccattacttatctaataaatcttctaaagattggataattgcctatacatcagatcatggtcaatatgtaaaaggcgacacttataagcaagggacatttgatgaagataattatattgtgccattagttctatatagtccaaatgaagaaatacagaaactagtgttggacaattttgaatcatgtaagatttcatttcataatcagttatctagctttattattaatataatgggatataactattcagttagcacttgcgataagggggttgttaatggaaatattctcacaggtgatgctggatacctaaaaatagaatctaatggtaaacaagagtatgttcat

SEQ ID NO: 4566 - protein, 478 aa, Haemophilus influenzae
  Name: NTH2543
LFVFSKYRITRILVGALFAISIVVNNVHYAVYQSWIGPVNYSLAFKEINEITNAGLTMIDKFIYPLLFGLFEVAVFLSLSFIKRKVYKLSWIFDFIFYAVMMYVFVRAYTTKSHERFISPNTVYSRLKSNYLSLGYFIGRIVPYEIFSLSNIPLYHKSKPMKSGSPKIKNIILIMGESATSSHFSAFGYGRKTSPFLDSLKYKSGALVGKTYSGGKLTAISLPMFFNAIPYPNGIQQIAKGDTNLFNLAKEQGFQTYFYSAQARDDMHMINFLGGAWIDDIRFPDNEGYSLRDSMPDNKLLPAFKNINLDNGYHFVVLHHRGSHIPYGALLDEKEKVFGKNNATDNYDNTILNTDNFISEVYHYLSNKSSKDWIIAYTSDHGQYVKGDTYKQGTFDEDNYIVPLVLYSPNEEIQKLVLDNFESCKISFHNQLSSFIINIMGYNYSVSTCDKGVVNGNILTGDAGYLKIESNGKQEYVH

SEQ ID NO: 4567 - DNA, 255 bp, Haemophilus influenzae
  n 23: n is any nucleotide
  Name: NTH2544
ttgctgcctgcagtcgactctangagaccccgcctaaagtgcggtcaaaaacgagaagttttcttagcgggtgtcgcagaacaagaaggcaagctagtcacaaacggcggtcgtgtactttgtgtgactgcgttaggcgaaagtgtatttgaagcacaacaaaaagcgttaaaattggctgagcaaattcaatggtctgggcgtttttatcgtcgagacattggttacagggctgtggaacgagaacaagcaaaa

SEQ ID NO: 4568 - protein, 85 aa, Haemophilus influenzae
  Xaa 8: Xaa is any amino acid
  Name: NTH2544
LLPAVDSXRPRLKCGQKREVFLAGVAEQEGKLVTNGGRVLCVTALGESVFEAQQKALKLAEQIQWSGRFYRRDIGYRAVEREQAK

SEQ ID NO: 4569 - DNA, 303 bp, Haemophilus influenzae
  n 294, 295, 296, 297, 298: n is any nucleotide
  Name: NTH2545
atgaacattctgaaaagaaaaacgccacagaatattcgttttggagaacaaaagcctaaatattattttcatattcgggcttttgcggtattgcttggtgtcttttttttacttggtgtttattttaattggcaaagcattttagaaaaaatggatgataagccgattagtgcatttgcacttgttggacaaaatacctttactactgctgatgatattaaagaaagcctattaaaaatgggcgaattaaaaggttttgggggcaaggggtaccgagtccgatttcgtataccnnnnnttaat

SEQ ID NO: 4570 - protein, 101 aa, Haemophilus influenzae
  Xaa 99, 100: Xaa is any amino acid
  Name: NTH2545
MNILKRKTPQNIRFGEQKPKYYFHIRAFAVLLGVFFLLGVYFNWQSILEKMDDKPISAFALVGQNTFTTADDIKESLLKMGELKGFGGKGYRVRFRIPXXN

SEQ ID NO: 4571 - DNA, 918 bp, Haemophilus influenzae
  Name: NTH2546
atgaacttaaaacaagaaaaaatcgcggtgttattaggcggcacatctgctgaacgtgaagtttctttcaattcaggcaaagcggtattagaagcattattaaagcaaggttataatgcacatcctattgatcctaaagaatataatgttgcaaatcttaaaaaggatggctttaatcgagcatttaatattttgcacggtcgtggtggagaagatggcacaatgcaaggtttattagagcaaattggtttgccttatacggggtgtggcgtgatggcttctgcattaacgatggacaaaatgcgtacaaaaatgttgtggaaagcttttggtttacctgttgcagatatgaaagtggttacccgagaaactttttctgaattagatcctcaggctgttgtggcaaaattaggcttaccattaatggttaaaccctctttagaaggctctagcgttggcttaacgaaagtaaaagcggtagaagagttaaaaagtgcggtggaatatgcgcttaaatttgataataccattctaattgaagagtggttagctggcgatgaattaactgtgcctgtgcttgacaatcaagtattacccgcaattcgtattgttccagagggcgaattttatgattatgaagcgaagtatatttctgataatacgcaatatttctgcccagcaggtttaacgcctgaacgcgagcaagagttagcaatattagtaaaacgtgcttatgatgcactgggatgtcgtggttggagtcgtattgatgtaatgtgtgatgcaaaaggtaatttccgtttggttgaggttaatactaatcctggaatgacgagccatagtttattcccaaaatctgcagcgacagtaggtatttcttttgagcaactcgtcgtgaaaattttggagttgagcctg

SEQ ID NO: 4572 - protein, 306 aa, Haemophilus influenzae
  Name: NTH2546
MNLKQEKIAVLLGGTSAEREVSFNSGKAVLEALLKQGYNAHPIDPKEYNVANLKKDGFNRAFNILHGRGGEDGTMQGLLEQIGLPYTGCGVMASALTMDKMRTKMLWKAFGLPVADMKVVTRETFSELDPQAVVAKLGLPLMVKPSLEGSSVGLTKVKAVEELKSAVEYALKFDNTILIEEWLAGDELTVPVLDNQVLPAIRIVPEGEFYDYEAKYISDNTQYFCPAGLTPEREQELAILVKRAYDALGCRGWSRIDVMCDAKGNFRLVEVNTNPGMTSHSLFPKSAATVGISFEQLVVKILELSL

SEQ ID NO: 4573 - DNA, 1425 bp, Haemophilus influenzae
  Name: NTH2548
atgaaacattcccacgaagaaattagaaaaattatccctgaaatgcgccgtgtacagcaaattcatttcattggcattggtggtgcgggaatgagcggcattgcagaaattttattaaatgaaggttatcaaatttcaggttcagatattgccgatggcgtagtcactcaacgtttagctcaagctggggcaaaaatctacattggtcatgcagaagaacatattaaaggtgccagtgttgttgttgtgtctagtgcgataaaagatgataaccctgaattagttgcatcgaaacaaaaacgcattccagtgattcaacgcgcacaaatgttggcggagattatgcgttttcgtcacggtattgctgttgcaggaacacacgggaaaacgacaacaacagcaatgatttcaatgatttacacccaagctaaacttgatccgacttttgtaaatggtggtttagtgaaatcggcgggtaagaatgcacatttaggggcaagtcgttatttaattgccgaagccgatgaaagtgatgcgtcgtttttgcatttacagccaatggtatctgttgtaactaatatggagccagaccatatggatacttacgaaggcgattttgaaaaaatgaaagccacttatgtgaaattcctgcataatttaccattctatggtttagccgtgatgtgcgctgatgatcctgttttaatggaacttgtgccaaaagttggtcgccaagtgattacatatggttttagtgagcaggcagattatcgcattgaagattatgaacaaacaggttttcaaggtcattacacagtgatttgcccaaataatgaacgtattaatgtgttgctcaatgttcctggaaaacataatgcattaaatgcaacggctgcacttgctgtagcaaaagaagagggtattgctaacgaggcaattttagaggctctggctgattttcagggggctggtcgtcgttttgatcagctaggcgaatttattcgtccaaatggtaaagtgcgtttagttgatgattatggtcatcatccaacagaagtagacgtaaccattaaagcagcgcgagaaggctggggagataaacgtattgtaatgattttccaaccgcatcgttattcgcgcactcgtgatttgtttgatgattttgtacaagtgctttcgctagtagacgctttgattatgcttgatgtgtacgcagcgggagaagcccctattgttggcgctgacagtaaatctctttgccgttccattcgtaatcttggtaaagttgatcctattttggtatcagatacttcgcaactaggcgatgttctcgatcaaattattcaagatggcgatttgattttggcacaaggtgctggtagcgtaagtaaaatttctcgtggcttggctgaatcttggaagaat

SEQ ID NO: 4574 - protein, 475 aa, Haemophilus influenzae
  Name: NTH2548
MKHSHEEIRKIIPEMRRVQQIHFIGIGGAGMSGIAEILLNEGYQISGSDIADGVVTQRLAQAGAKIYIGHAEEHIKGASVVVVSSAIKDDNPELVASKQKRIPVIQRAQMLAEIMRFRHGIAVAGTHGKTTTTAMISMIYTQAKLDPTFVNGGLVKSAGKNAHLGASRYLIAEADESDASFLHLQPMVSVVTNMEPDHMDTYEGDFEKMKATYVKFLHNLPFYGLAVMCADDPVLMELVPKVGRQVITYGFSEQADYRIEDYEQTGFQGHYTVICPNNERINVLLNVPGKHNALNATAALAVAKEEGIANEAILEALADFQGAGRRFDQLGEFIRPNGKVRLVDDYGHHPTEVDVTIKAAREGWGDKRIVMIFQPHRYSRTRDLFDDFVQVLSLVDALIMLDVYAAGEAPIVGADSKSLCRSIRNLGKVDPILVSDTSQLGDVLDQIIQDGDLILAQGAGSVSKISRGLAESWKN

SEQ ID NO: 4575 - DNA, 135 bp, Haemophilus influenzae
  Name: NTH2549
ttgtggcgttttataaatagcctcagtcataagtattttttatatccaaaagtgctaatattagaaataaaaacgttgcgaattttaaccgcacttttagttgagttttgtcattgggagaaaaggaaaaataaa

SEQ ID NO: 4576 - protein, 45 aa, Haemophilus influenzae
  Name: NTH2549
LWRFINSLSHKYFLYPKVLILEIKTLRILTALLVEFCHWEKRKNK

SEQ ID NO: 4577 - DNA, 1053 bp, Haemophilus influenzae
  Name: NTH2550
atgaaaaataaaaaattattagtgatggcgggtggcactggcggtcatgtttttcctgccattgcagttgctcaaactttacaaaaacaagaatgggatatttgctggttaggtacgaaagatagaatggaggctcaacttgtaccaaaatatggtattcctattcgatttattcaaatttctggtttgcgtggtaaaggtataaaagctttgttaaatgcgccttttgccatttttcgtgccgtgttgcaggcaaaaaaaattattcaagaagaaaagcctgacgctgtacttggtatgggaggctatgtttctggccccgctggcgttgcggcaaaactttgtggtgtaccaatcattttacatgaacaaaatgcgatagcgggtttaacgaataagttattaggtaaaattgcaacctgtgtattacaggcatttccaactgcttttcctcatgctgaagtagtaggaaacccagttcgagaagatttatttgagatgccaaatcctgatattcgtttttcggatcgtgaggaaaaattacgtgtcttagtggttggtggtagtcaaggagcgagagtgcttaatcatactttacctaaagtagtcgcccagcttgcagataaattagagcttcgtcatcaagtaggtaaaggtgcggtagaagaagtcagccaactttatggcgagaatttagaacaagttaaaataacagaatttattgataatatggcagaggcttatgcttgggctgatgtggttatttgccgttctggcgcattaaccgtatgtgaaattgcagcagtgggagtcgcagcaatttttgtaccattccaacataaagatcgccaacaatatttaaatgcgaaatatttatcagatgttgacgcggcgaaaattatagaacaggcagatttaacgcctgaaatgctagtgaattatttaaaaaatttaactcgtgaaaatttattgcagatggcattgaaagcgaaaacaatgtcgatgcctaatgcggcacaacgtgtagctgaagtaattaaacaatattcaaac

SEQ ID NO: 4578 - protein, 351 aa, Haemophilus influenzae
  Name: NTH2550
MKNKKLLVMAGGTGGHVFPAIAVAQTLQKQEWDICWLGTKDRMEAQLVPKYGIPIRFIQISGLRGKGIKALLNAPFAIFRAVLQAKKIIQEEKPDAVLGMGGYVSGPAGVAAKLCGVPIILHEQNAIAGLTNKLLGKIATCVLQAFPTAFPHAEVVGNPVREDLFEMPNPDIRFSDREEKLRVLVVGGSQGARVLNHTLPKVVAQLADKLELRHQVGKGAVEEVSQLYGENLEQVKITEFIDNMAEAYAWADVVICRSGALTVCEIAAVGVAAIFVPFQHKDRQQYLNAKYLSDVDAAKIIEQADLTPEMLVNYLKNLTRENLLQMALKAKTMSMPNAAQRVAEVIKQYSN

SEQ ID NO: 4579 - DNA, 1182 bp, Haemophilus influenzae
  Name: NTH2552
atggaatttttacagaacatcaaaaaaaattacgatgaatggacacgcatcacacctcaaggtttgttgtatgatcgcgcactattttggttatttgttattttgcttttaattggtttagtggcagtaacatctgcttctattccttatagctctcgtttatttaatgatcctttttactttgcaaaacgcgacgctatttatgtgctactttctttgctcacttgttatatttcattacaaatttcttcttcgcaatgggaaaaatggcacgctaaaatttttttattttctgtcatattattattgcttgtcccttttatcggtacatcggttaatggcgcaaaacgttggatttcattggggatcttaaactttcaacctgcagaatttgcaaaattggctttgacttgttttttagcaagttatttcactcgtcgttatgatgaagtgcggtcgcgacatgttagtatttttaaaccgtttattgttatgcttgtattgggttgttttcttttattgcaacctgatttaggtagtacagtcgtgctatttattattatgtctgggatgctttttatcgtaggggcgaaaattttacagtttgtaggattgatagcattaggtggaatcttattcgtttggctagtattgaccgcctcttatcggttaaagcgatttataggatttttagaaccctttaaagatccttatggcactggtttccaattaacaaactctcttatagcatttgggcggggagaaattactggcgaaggattaggtaattcaattcaaaaattagattatctgcctgaagcacataccgatttcattatggcgattatcggcgaagaatttggatttatcggtatattgattgttattcttttattaggtttattaatttttcgtgcaatgaaaattggacgagaatccttaatgttagaacaacgttttcgaggtttttttgcattaggtattggtttttggattttctttcaaggctttgtgaatttaggtatggctcttggaatgctaccaactaaaggtttaacctttccactcgtgagttatggtggttcgagtattatcattatgtccgccactattggtattttattgcgaattgatcacgaaaatcgtttatttcgtataggtcaagcacgcttgcgtgatgat

SEQ ID NO: 4580 - protein, 394 aa, Haemophilus influenzae
  Name: NTH2552
MEFLQNIKKNYDEWTRITPQGLLYDRALFWLFVILLLIGLVAVTSASIPYSSRLFNDPFYFAKRDAIYVLLSLLTCYISLQISSSQWEKWHAKIFLFSVILLLLVPFIGTSVNGAKRWISLGILNFQPAEFAKLALTCFLASYFTRRYDEVRSRHVSIFKPFIVMLVLGCFLLLQPDLGSTVVLFIIMSGMLFIVGAKILQFVGLIALGGILFVWLVLTASYRLKRFIGFLEPFKDPYGTGFQLTNSLIAFGRGEITGEGLGNSIQKLDYLPEAHTDFIMAIIGEEFGFIGILIVILLLGLLIFRAMKIGRESLMLEQRFRGFFALGIGFWIFFQGFVNLGMALGMLPTKGLTFPLVSYGGSSIIIMSATIGILLRIDHENRLFRIGQARLRDD

SEQ ID NO: 4581 - DNA, 1311 bp, Haemophilus influenzae
  Name: NTH2553
atgaatgcctatcaaaacaaaaatattacgatcattgggcttggcaaaacaggtctttcttgtgtggattatctcttatcccaacaggctaatattcgtgtgattgatacccgaaaaaagcctactggtattgataaacttcctcaaaatatccctcttcatactggtagtttaaatcaggaatggttacttgaaagcgatatgattgttattagcccagggcttgcggtaaaaacaccagaaattcaaaccgcacttaaagcgggagtggaagtaatcggcgatattgaattattctgccgcgcagcgacaaagccaattgtggggattacaggttcaaatggaaaaagtactgttactactttagtttatgaaatggcgaaagctgctggcgtgaaagttggtatgggcggaaatattgggattcccgctttgtcattgttgaatgaagattgtgaactttatgtactagagctttctagttttcagcttgagacaacttatagcttaaaagctgcggctgcgactgttttgaacgtgactgaagatcatatggatcgctatatggatttagaagattatcgccaagcaaaattacgcatttatcataatgctgaggtcggagttttgaataatgaggataagctgacttttggtgaaggtgaaaatcaagcgagacaaaccgtttcttttgcggaaaatagtgcggattattggctaaaaactgaaaatggcaagcaatacttaatggtaaaagatgaagtaattttgccttgtgaagaagtaacattagtcggtcgccataattatatgaacattttggcagcaacagcattggcacaagctgtcggtattaatttagattcaattcgtaccgcacttcgtcatttcaaagggttagatcatcgttttcaattagtgcatcaagctaatggtattcgttggattaatgactctaaagcaacaaatgtggggagtacagttgctgcattagctgggctttatattgagggtaaattgcatttgttgctaggcggagacggaaaaggggctgatttttcagaattagctgaattaattaatcaaccacacattatttgttattgttttggtcgagatggtgtgcagcttgcaaaattttcatcacaaagctatttgtttgaaacaatggaacaagcgatagaatttttacgcccaacattgcaaagcggagatatggtattattgtcgcctgcttgtgcaagtctcgatcagtttgcttcttttgaaaagcgcggcgaagaatttacgcatttagcgcaatattcagcc

SEQ ID NO: 4582 - protein, 437 aa, Haemophilus influenzae
  Name: NTH2553
MNAYQNKNITIIGLGKTGLSCVDYLLSQQANIRVIDTRKKPTGIDKLPQNIPLHTGSLNQEWLLESDMIVISPGLAVKTPEIQTALKAGVEVIGDIELFCRAATKPIVGITGSNGKSTVTTLVYEMAKAAGVKVGMGGNIGIPALSLLNEDCELYVLELSSFQLETTYSLKAAAATVLNVTEDHMDRYMDLEDYRQAKLRIYHNAEVGVLNNEDKLTFGEGENQARQTVSFAENSADYWLKTENGKQYLMVKDEVILPCEEVTLVGRHNYMNILAATALAQAVGINLDSIRTALRHFKGLDHRFQLVHQANGIRWINDSKATNVGSTVAALAGLYIEGKLHLLLGGDGKGADFSELAELINQPHIICYCFGRDGVQLAKFSSQSYLFETMEQAIEFLRPTLQSGDMVLLSPACASLDQFASFEKRGEEFTHLAQYSA

SEQ ID NO: 4583 - DNA, 1080 bp, Haemophilus influenzae
  Name: NTH2554
atgttagtctggcttgctgaatatcttgttcgttacgaaaccgcctttaatgcgatttcttatattaccgtccgcgcaattcttgcattattaaccgcactttttatctcactttggattggccctaaagtgatcaaacgtttacagatcttaaaatttggtcaagaagtgcgaaatgatggccctgaaagtcactttgcaaaaaaaggcacacccactatgggcggtgtgatgattttattctctattggcgtaagtacgttattatgggcaaatcttgctaattcttatatttgggtttgtttatttgttttatttggatacggcgcaattggttttgtggatgatttccgtaaaattacccgtaaaaatactgatggattgattgcgcgttggaaatatttctggatgtctgtggtggcattagtggcaatcctttggctttattggcttggtcacgacactgatgccacccgtttagtgattccattctttaaagacattatgcctcagttaggtttgttctatattgtgttatcttactttgtgattgttggaaccggtaatgcagtgaatttaaccgacggtttagatggattagcgattatgcctactgcgcttgttgcaggtgcgtttgctttaattgcttgggctacaggtaacgtgaatttcgcagaatatttgcacattccgtatattaaatacagttctgaagtagtggtgttctgtacagctattgttggcgcgagtttaggatttttatggtttaatacttatccagctcaagtatttatgggggacgtgggttctctagcattaggtggtgcgctgggtgtcgtagcaattcttgttcgtcaggaatttttgcttgtgataatgggtggtgtatttgttgttgaagcactctctgttattttgcaagtagggtcttataagttacgcaaacaacgcatttttagaatggcaccgattcaccaccattttgaattgaagggatggcctgagccaagagtgattattcggttttggattatttccttaatgttagtgttgatgggattagtcaccttgaagttgcgt

SEQ ID NO: 4584 - protein, 360 aa, Haemophilus influenzae
  Name: NTH2554
MLVWLAEYLVRYETAFNAISYITVRAILALLTALFISLWIGPKVIKRLQILKFGQEVRNDGPESHFAKKGTPTMGGVMILFSIGVSTLLWANLANSYIWVCLFVLFGYGAIGFVDDFRKITRKNTDGLIARWKYFWMSVVALVAILWLYWLGHDTDATRLVIPFFKDIMPQLGLFYIVLSYFVIVGTGNAVNLTDGLDGLAIMPTALVAGAFALIAWATGNVNFAEYLHIPYIKYSSEVVVFCTAIVGASLGFLWFNTYPAQVFMGDVGSLALGGALGVVAILVRQEFLLVIMGGVFVVEALSVILQVGSYKLRKQRIFRMAPIHHHFELKGWPEPRVIIRFWIISLMLVLMGLVTLKLR

SEQ ID NO: 4585 - DNA, 1371 bp, Haemophilus influenzae
  Name: NTH2555
atgattaaactctctactgtacaacttgcacagattcttcaagctaaattaattggcgatgaaaatgtgcaagttgaagaaattaatacggatactcgaaaaagcgtatcaaatagcttattttttgctttaaaaggcgaaaaatttgatgctcatcaatatcttgatcaagcggtgtcacagggtgcgcttgcgcttgttgttcagcaagaaaactcgtctattttagttcctcaacttgtggttaaagacactcgtattgctttgggcgagcttgcaaaatggttacgcgagaaaattaatccgcgtactgtggcgatgaccggctcttctggaaaaaccacagtaaaagaaatgacagcaagtattttgcagcataccgcagcagattcagaagcggtactttttaccaatggtaacttcaataacgatataggtgtgcctttaactctgcttcgcttaacagaaaaacatcgttttgctgtgattgaacttggtgcaaatcatcaaaatgaaatcaattacaccacaaaattagttcaacctaatgccgcattgattaataatattgcgcccgcacatttagaggggtttggttctttagcgggagttgttcaagcaaaaggcgagatttatcgaggtttaacaaaaaatggtgtggcgattatcaatgctgaacataatcacttagatatttggcaaaaagaaattagtaatcacgccattcaatatttcaacggcaaggactattccgtcaaaaatgttcaaggtaacgaacaaggttcaacctttacgttagtttctccgcaaggcgaaattgatattagtttaccttatcttggagagcataatgtaaaaaatgctttagctgctaccgcactagcgatgaatgttggtgctacgcttgccgatgtcaaagctggattagaacaacgttcacaagtgaaagggcgtttatttcctattcaagtaacgcctaatttattgttattagatgatacttataacgcaaataaagattctctctgtgcggctattgatgtcctaaaaagttatgatgctttccttattctatgtgtcgcagatatgaaagaattgggcgaaaattctctcgctattcatcgtgaagttggacaatatgttaatttggtaaatttagatttggtgtgttcttatggcaatgaaagtgcggttatttctgaggctgttttgggtaagcattttacggataaaactgaaatggtggatttcttagttccacttattgaaaaccaattacaacaaaataaaaaagttgtggtgctgggaaaaggctcacgctcaatgaaaatggaagatgtgatctattcattaaaggataaaattaaatgt

SEQ ID NO: 4586 - protein, 457 aa, Haemophilus influenzae
  Name: NTH2555
MIKLSTVQLAQILQAKLIGDENVQVEEINTDTRKSVSNSLFFALKGEKFDAHQYLDQAVSQGALALVVQQENSSILVPQLVVKDTRIALGELAKWLREKINPRTVAMTGSSGKTTVKEMTASILQHTAADSEAVLFTNGNFNNDIGVPLTLLRLTEKHRFAVIELGANHQNEINYTTKLVQPNAALINNIAPAHLEGFGSLAGVVQAKGEIYRGLTKNGVAIINAEHNHLDIWQKEISNHAIQYFNGKDYSVKNVQGNEQGSTFTLVSPQGEIDISLPYLGEHNVKNALAATALAMNVGATLADVKAGLEQRSQVKGRLFPIQVTPNLLLLDDTYNANKDSLCAAIDVLKSYDAFLILCVADMKELGENSLAIHREVGQYVNLVNLDLVCSYGNESAVISEAVLGKHFTDKTEMVDFLVPLIENQLQQNKKVVVLGKGSRSMKMEDVIYSLKDKIKC

SEQ ID NO: 4587 - DNA, 1464 bp, Haemophilus influenzae
  Name: NTH2556
atgaaaaaactcaccgcactttttaatttgcctgaattaaagaatgatatagaactccataatatggtgttagatagccgtaaggttaaagctggcgatctttttgtggcgataaaaggtcatcaggtggatggaaatcaatttattgattctgctcttcattctggtgcgagtgcggtggtttctgagacagaattatctagcgagcatttaactgtggcgtttatcaggaatgtgccggtagttaaatattatcaacttgcacgtcatctttcgtccttagctgatgttttttatgattcgccctctaaaaatttaacccttgttggcgttacaggaacaaatggcaaaaccactatttctcaattattagcgcaatgggcggaattattggggcatcgtgcggctgtgatgggaaccattggtaatggacttttggggcaaattgtagaagctaaaaatacgacaggttcagcagtagaaattcagtcatctctttcaactttcaaacacgcaggtgcagattttacctctattgaagtttcatcacacggtttggcgcagcatcgtgtagaagccttgcattttaaagcggcaattttcacgaatttaacccgtgatcatctagattatcatcaatctatggaaaattatgctgcggcgaagaaacgcttgttcactgaattagatacccaaattaaagtgattaatgctgatgatgaaattggataccaatggctaactgaactacctgatgctattgccgtaagtatgaatgcggattttaaagtaggttcacaccaatggatgaaagcaataaatatccattatcattttaaaggtgcagatattacttttgaatctagctggggtaatggtgttttgcatagcccattaattggtgcttttaatgtaagtaatttattattagtaatgaccacgttgttatcgtttggttacccattggaaaatttactcgctacggcgaaatctttaaaaggagtatgtggaagaatggaaatgattcaatatccaaataaaccaatcgttattgtagattatgcgcatacaccagatgcgttggaaaaagcgttgattgctgcgcgtgaacattgccaaggcgaattatggtgcatctttggttgtggcggagaccgtgatagaggcaaacgtccgttaatggcacaggttgcagagcagtttgctgaaaagattattgtgacaaaagataatccacgaacagaaccacaaagccaaattgaagcagatattgtcgctggctttaaaaatatggaaaaagtggggattattcctgatcgcgcacaggcgatccagtttgcgattgaaagtgcggtagaaaatgacgtgattttaattgctggaaagggtcacgagcattatcaaattattggttcggaagttgtgcatttttccgaccaagaaattgcacttgatttcttaaaa

SEQ ID NO: 4588 - protein, 488 aa, Haemophilus influenzae
  Name: NTH2556
MKKLTALFNLPELKNDIELHNMVLDSRKVKAGDLFVAIKGHQVDGNQFIDSALHSGASAVVSETELSSEHLTVAFIRNVPVVKYYQLARHLSSLADVFYDSPSKNLTLVGVTGTNGKTTISQLLAQWAELLGHRAAVMGTIGNGLLGQIVEAKNTTGSAVEIQSSLSTFKHAGADFTSIEVSSHGLAQHRVEALHFKAAIFTNLTRDHLDYHQSMENYAAAKKRLFTELDTQIKVINADDEIGYQWLTELPDAIAVSMNADFKVGSHQWMKAINIHYHFKGADITFESSWGNGVLHSPLIGAFNVSNLLLVMTTLLSFGYPLENLLATAKSLKGVCGRMEMIQYPNKPIVIVDYAHTPDALEKALIAAREHCQGELWCIFGCGGDRDRGKRPLMAQVAEQFAEKIIVTKDNPRTEPQSQIEADIVAGFKNMEKVGIIPDRAQAIQFAIESAVENDVILIAGKGHEHYQIIGSEVVHFSDQEIALDFLK

SEQ ID NO: 4589 - DNA, 1830 bp, Haemophilus influenzae
  Name: NTH2557
atggtgaaatttaattcctcgcgtaaatcaggtaagtcaaaaaaaacaattagaaaattgaccgcacctgaaactgtaaagcaaaacaagtctcaaaaggtgtttgaaaaatgctttatgcgtggacgttatatgctttctacggttcttattttacttggtctgtgtgctttagtcgcacgagcagcttatgttcaatctattaatgccgatacgttatcaaatgaagcggataagcgttctttgcgtaaagatgaagtattatcggtgcgtggttctattttagatcgtaatggtcagcttttatctgtaagcgtaccgatgagcgcgattgtggcagatccaaaaacgatgttgaaggaaaattcgcttgcggataaagaacgaattgcagctttagccgaagaattaggtatgactgaaaatgatttagtgaaaaaaattgagaaaaattctaaatctggttatttgtatttagcacgtcaagttgaattaagtaaagctaactatattcgtagattaaaaattaagggtattattttagaaacagagcatcgccgtttttatcctcgtgtagaagaagctgcacacgtggtgggttatacggatattgatggaaatggtattgaaggcattgagaaaagttttaattccctgcttgttggtaaagacggttcacgtactgttcgtaaagataaacgtgggaatattgttgcacatatctccgatgagaaaaaatatgatgcacaagatgttaccttaagtattgatgaaaaattgcaatctatggtgtatcgtgagattaaaaaggcggtgtctgagaataatgcggagtctggtactgcggtgttagttgatgttcgaacaggggaagtgttagctatggcgactgcgccctcttataatccaaacaaccgtgtcggcgtgaaatcagagttaatgcgtaaccgtgcaattaccgatacttttgagccaggttctacggtaaaacctttcgttgttttaaccgcacttcaacgaggtgtcgttaaacgagatgaaattattgatactacgtcctttaaattaagcggtaaagaaattgtggacgttgcaccacgtgctcagcaaactttagacgagattttaatgaactctagtaaccgtggtgtaagtcgtcttgcattacgtatgccacctagcgcattaatggaaacttatcaaaatgcaggtttaagtaaaccgacagatttaggcttgatcggagaacaagttgggattttgaatgcaaatcgtaaacgctgggcagatattgagcgtgcaacagtcgcttatggttatggtattactgcgacacctttacaaattgctcgtgcctatgcaacccttggtagtttcggtgtttatcgcccgctttctatcactaaagttgatccgccagttattgggaaacgggttttctctgaaaaaataactaaagatattgtgggaattttagagaaagtagcaattaaaaataaacgcacaatggtggaaggctaccgtgtcggcgtaaaaacaggtacggcacgtaagattgaaaatggacattatgtaaataaatatgtggcatttactgcgggtattgcaccaattagtgatcctcgttatgcattagtggttttgatcaatgatccaaaagcaggagaatattatggtggtgcggtttctgcccctgtattctctaacattatgggctatgcgttacgtgcaaatgctattccgcaagatgctgaagcagctgaaaacacaacaacgaaaagtgcaaaacgaattgtttatattggcgaacacaagaatcaaaaagtgaat

SEQ ID NO: 4590 - protein, 610 aa, Haemophilus influenzae
  Name: NTH2557
MVKFNSSRKSGKSKKTIRKLTAPETVKQNKSQKVFEKCFMRGRYMLSTVLILLGLCALVARAAYVQSINADTLSNEADKRSLRKDEVLSVRGSILDRNGQLLSVSVPMSAIVADPKTMLKENSLADKERIAALAEELGMTENDLVKKIEKNSKSGYLYLARQVELSKANYIRRLKIKGIILETEHRRFYPRVEEAAHVVGYTDIDGNGIEGIEKSFNSLLVGKDGSRTVRKDKRGNIVAHISDEKKYDAQDVTLSIDEKLQSMVYREIKKAVSENNAESGTAVLVDVRTGEVLAMATAPSYNPNNRVGVKSELMRNRAITDTFEPGSTVKPFVVLTALQRGVVKRDEIIDTTSFKLSGKEIVDVAPRAQQTLDEILMNSSNRGVSRLALRMPPSALMETYQNAGLSKPTDLGLIGEQVGILNANRKRWADIERATVAYGYGITATPLQIARAYATLGSFGVYRPLSITKVDPPVIGKRVFSEKITKDIVGILEKVAIKNKRTMVEGYRVGVKTGTARKIENGHYVNKYVAFTAGIAPISDPRYALVVLINDPKAGEYYGGAVSAPVFSNIMGYALRANAIPQDAEAAENTTTKSAKRIVYIGEHKNQKVN

SEQ ID NO: 4591 - DNA, 321 bp, Haemophilus influenzae
  Name: NTH2558
atgtctgaaaataataagcctcgttatccgttacagcagattttagtcgaagatttattttcttcaaataagttagtggtgttgctgttgatagggattttagtttctgcaatgggaacgatttggataacccataaaactcgccaattaatttctgaaaatggaatgttaattttacagcgtcaagcacttgagaatgaataccgtaatttacaagtgcaggaagctacggaaggggatagcacgcgagtagaatctattgcgattagtacattaaaaatgaaagttgtttcttcagagcaagaagttgaaattagagaa

SEQ ID NO: 4592 - protein, 107 aa, Haemophilus influenzae
  Name: NTH2558
MSENNKPRYPLQQILVEDLFSSNKLVVLLLIGILVSAMGTIWITHKTRQLISENGMLILQRQALENEYRNLQVQEATEGDSTRVESIAISTLKMKVVSSEQEVEIRE

SEQ ID NO: 4593 - DNA, 963 bp, Haemophilus influenzae
  Name: NTH2559
atgaatagcgaaaattccttttcttcatctgaacatattacagttttacttcacgaagccgtgaatggcttggcattgaaggagaatggcatttatattgatggtacttttgggcgtggggggcattctcggtttatcctttctcaactttcttctaatggtcgtttgatagctgtagatcgtgatcctcgtgctattgcagaagcacacaaaatccaagacttgcgttttcagattgaacataacagcttttcgcatattcctgaaatttgtgacaaattaaatttagtgggcaaaattgacggtattttgcttgatcttggtgtgtcttcccctcagcttgatgaagcagaacgtggttttagttttatgaaagatggcccgcttgatatgcgtatggatacaactcaaggtttatctgctgaagaatggttaaaacaagtgtccattgaggatttaacttgggtgttgaaaacttttggcgaagagcgtttcgctaaacgtattgccactgctattgttgatttcaataaaagtgcggtaaaaaatagcacagaatttttatcgcgtaccagtcaattggcggaacttatttcacaggcagttccttttaaagataaacataaacatcctgcgacgcgtagtttccaagctattcgtatttttattaattcggaattagatgaattagaaagtctgcttaattctgcgttagatatgttagcaccagaaggtcgtttatcaattattagtttccattctttagaagatagaatggtgaaacattttatgaaaaaacaaagtaagggcgaggatattcccaaaggtttaccattgcgagaagatcaaattcagcgtaatcaaaaattaagaattattggtaaagccattcagccaagtgatgcagaaattcaagcaaatcctcgttcaagaagtgccatattacgtgtggcagagagaatt

SEQ ID NO: 4594 - protein, 321 aa, Haemophilus influenzae
  Name: NTH2559
MNSENSFSSSEHITVLLHEAVNGLALKENGIYIDGTFGRGGHSRFILSQLSSNGRLIAVDRDPRAIAEAHKIQDLRFQIEHNSFSHIPEICDKLNLVGKIDGILLDLGVSSPQLDEAERGFSFMKDGPLDMRMDTTQGLSAEEWLKQVSIEDLTWVLKTFGEERFAKRIATAIVDFNKSAVKNSTEFLSRTSQLAELISQAVPFKDKHKHPATRSFQAIRIFINSELDELESLLNSALDMLAPEGRLSIISFHSLEDRMVKHFMKKQSKGEDIPKGLPLREDQIQRNQKLRIIGKAIQPSDAEIQANPRSRSAILRVAERI

SEQ ID NO: 4595 - DNA, 453 bp, Haemophilus influenzae
  Name: NTH2560
atgtttcgtggtgcaacggcggttaatttagattctaaggggcgtgtagcgatcccaactcgctatcgcgctgaaattcttgaaaagaaccaagggcaaatggtttgtactgtagatattcgccaatcctgtcttttactttatccccttgatgaatgggaaaaaatcgaacaaaaacttctcgcactttctaactttgatcctacccaacgccgtttgcagcgagtaatgcttggccatgccactgaatgtgagatggatgctcagggtcgtattttgcttagtgggccattacgccaacacgcaaaattagaaaaaggtttaatgttggtagggcaacttaataaatttgaaatttggagcgatgtagaatggcatactcaaattgcagaggatatagaaattggctccagcacagattttgctgctgatgcgttaaatgatttctcatta

SEQ ID NO: 4596 - protein, 151 aa, Haemophilus influenzae
  Name: NTH2560
MFRGATAVNLDSKGRVAIPTRYRAEILEKNQGQMVCTVDIRQSCLLLYPLDEWEKIEQKLLALSNFDPTQRRLQRVMLGHATECEMDAQGRILLSGPLRQHAKLEKGLMLVGQLNKFEIWSDVEWHTQIAEDIEIGSSTDFAADALNDFSL

SEQ ID NO: 4597 - DNA, 624 bp, Haemophilus influenzae
  Name: NTH2561
atgaatcaattcctgcagaatcgcgcaatgcaaggagcatcaataatacagaaccttactagcggtaattgggatccatcgattttagcatcgctgggtttaagtaataaccatttccctcctatgcgttatgcaggtgaaaaagttggaaaattacgtacaccgttagcccagaaatggggattaaatcccgtacctgtcatttcttgtggacatgatactcaatttgctgtgtttgggtctggtgcagggctgaatcagcctgtgttaagttctggcacctgggaaatcttaatggctagaacccagcacgcagaacctagatttgagtttgtttctcaaggcttaaccactgaatttgatgcacaatccaattgctttaatccagcggtacaatgggtgggttctggcgtcatagaatggttaggtaaattattattttccgatgtttatggtagcgatcactattacaccacaatgatcaaagagggagaaaaagcttttaatgcgggaaaaagagcggtcaattttgaaggtatttttagccaaaaaggtcaaggtaatatcagtggactttaccatgtttgtctactcagtggagataattctatgttcagacgcact

SEQ ID NO: 4598 - protein, 208 aa, Haemophilus influenzae
  Name: NTH2561
MNQFLQNRAMQGASIIQNLTSGNWDPSILASLGLSNNHFPPMRYAGEKVGKLRTPLAQKWGLNPVPVISCGHDTQFAVFGSGAGLNQPVLSSGTWEILMARTQHAEPRFEFVSQGLTTEFDAQSNCFNPAVQWVGSGVIEWLGKLLFSDVYGSDHYYTTMIKEGEKAFNAGKRAVNFEGIFSQKGQGNISGLYHVCLLSGDNSMFRRT

SEQ ID NO: 4599 - DNA, 405 bp, Haemophilus influenzae
  n 396, 397, 398, 399, 400: n is any nucleotide
  Name: NTH2562
ttgcattgcgcgattctgcaggaattgattcatttcttcctccccgccctttttccatcccttcccttctatgcattttctggaccacctttcccccgtttgccctttttttccggccccccctttttctcgctgctttccttagccttgtgcgatgtttccttttttcttttttccgtcgtccccctgtttgttctccctttttcccctttttgtcccgtcctccgttttcccccgccccgccgtccctttcctttttacattctccccccctttttgccccccgttatatctttggccgttagttgccgccgcccccgtttttctcctttttcccccccgcctcttttcccccccctttttcccccgccctccttgtccttgttctccgtcccnnnnnttaat

SEQ ID NO: 4600 - protein, 135 aa, Haemophilus influenzae
  Xaa 133, 134: Xaa is any amino acid
  Name: NTH2562
LHCAILQELIHFFLPALFPSLPFYAFSGPPFPRLPFFSGPPFFSLLSLALCDVSFFLFSVVPLFVLPFSPFCPVLRFPPPRRPFPFYILPPFLPPVISLAVSCRRPRFSPFSPPPLFPPLFPPPSLSLFSVPXXN

SEQ ID NO: 4601 - DNA, 93 bp, Haemophilus influenzae
  Name: NTH2563
atgttagacacaggaggaaaaagaagatggaagaaaaaaaaaaaagtaaatcggggcaatattaaaggcacaaaaataaaaaatgaagagcag

SEQ ID NO: 4602 - protein, 31 aa, Haemophilus influenzae
  Name: NTH2563
MLDTGGKRRWKKKKKVNRGNIKGTKIKNEEQ

SEQ ID NO: 4603 - DNA, 204 bp, Haemophilus influenzae
  Name: NTH2564
gtgatcaaaaagctaaaaagttatgataaagtagtcaaggcctattatacaacgggcaattactcgattttattaaaggtaatgacacacacaattgcagaattacattccgttttggcgaccaagattcagttaattgatgaaattcaatccactgaaaccttgatttcaatgcaaaatccaattttgcgagatattaaacct

SEQ ID NO: 4604 - protein, 68 aa, Haemophilus influenzae
  Name: NTH2564
VIKKLKSYDKVVKAYYTTGNYSILLKVMTHTIAELHSVLATKIQLIDEIQSTETLISMQNPILRDIKP

SEQ ID NO: 4605 - DNA, 420 bp, Haemophilus influenzae
  Name: NTH2565
ttgtcgaatcaaaataaggagaaaataatggcagaaaaagaagtcagattagataaatggttgtgggctgcccgattttacaaaacacggagcattgctaaagcgatgattgaaagtggtaaagtgcattacaacaatcaacgtgcgaaagtaagtaaaattgtggaagtgggcgcaatgttaaaacttcgccagggaaacgaagaaaaagaaataaaaattatcgccttaagcgatcaacgccgaggtgcgccagaagcacaattactctatcaagaaaccgaaagtagcgtgaaaaaaagagaagaaatcgcgtgggcaagaaaaaataattccctttcaatgccccatcctgatcgtcgcccaaataaaaaagagcggagagatttattgaaatttaaacaccaagataaatttgaa

SEQ ID NO: 4606 - protein, 140 aa, Haemophilus influenzae
  Name: NTH2565
LSNQNKEKIMAEKEVRLDKWLWAARFYKTRSIAKAMIESGKVHYNNQRAKVSKIVEVGAMLKLRQGNEEKEIKIIALSDQRRGAPEAQLLYQETESSVKKREEIAWARKNNSLSMPHPDRRPNKKERRDLLKFKHQDKFE

SEQ ID NO: 4607 - DNA, 792 bp, Haemophilus influenzae
  Name: NTH2566
ttgaaaaatagtcaaatttttgacaaggttgagtggttttctttttttaagctcaaggaacaatttatgcataacgaaaacttaaaagaattgaccgttcgaggaattattctcggtgcattgattacggtaattttcactgcatccaatgtgtatctcggtctaaaagtgggggtgacatttgcgtcatctattccagcggccgtcatttctatggcagtactcaaatttttcaaagattctagcattcttgaaaataatatggtgcaaactcaagcatcttcagcaggtacgctttcttctgtgatcttcgtcttgcctggtttattaatgatgggctactggcaagattttccattctggcaaacgatgttgatttgtgcagctggtggtacattgggcgtgttattcactattccattacgccgtgcaatggtggtaaatagtaatttaccttatcctgaaggggtagctgctgcagaaattttgaaagcaggtaatcatgcagatggcgacagcggtgtgaaagatattgcttacggtggtgttttagcgggattagtggcatttttaactaacggtttacgcgtgatggctgatggtagtgcttggattcaacaggaaagcggcgttccaattaccaatgggcttttcacttgccttactcggtgctggttatttaattggcattgtcggcggtattgcgatgttaatcggtgttattttgacttggggtgtggcagtgccatatttcacaatgtcagaagatattgccgcggatgcaagtttaat

SEQ ID NO: 4608 - protein, 264 aa, Haemophilus influenzae
  Name: NTH2566
LKNSQIFDKVEWFSFFKLKEQFMHNENLKELTVRGIILGALITVIFTASNVYLGLKVGVTFASSIPAAVISMAVLKFFKDSSILENNMVQTQASSAGTLSSVIFVLPGLLMMGYWQDFPFWQTMLICAAGGTLGVLFTIPLRRAMVVNSNLPYPEGVAAAEILKAGNHADGDSGVKDIAYGGVLAGLVAFLTNGLRVMADGSAWIQQESGVPITNGLFTCLTRCWLFNWHCRRYCDVNRCYFDLGCGSAIFHNVRRYCRGCKFN

SEQ ID NO: 4609 - DNA, 1320 bp, Haemophilus influenzae
  Name: NTH2567
ttgacttggggtgtggcagtgccatatttcacaatgtcagaagatattgccgcggatgcaagtttaattgattctgcgatgactgtttggaaaaccaaagtgcgttatattggtgtgggtacaattggtattgctgcgatttggacattgctgattttaatgaaaccaatgattgaagggatggttcattctttccgtatgctgaaaggtgggcaagaggcatcagaacatcgtattgatattgacctttctccaaaaacaatgatttatatcttaattgcgacggttgcgttaattgttatttcattacatcactttattgcggcggcaccaatttcgcctgagctttccattttattagtggtagtttgtactttcttagcggtatttatcggcttctttgtggcagctgcttctggttatatggcaggtttagtgggttcatcttcaagcccaatttctggtatcggaattatttctgttatcgtgatttcattagtattggtgtcaatcggtaatgcctcgggcttatttgaaactgtagatggtcagaaatttttaaccgcacttacattgtttacggcatctatcgtaatcactacagcttgtatttctaatgataatctacaagatttaaaaacgggtttattagttgaagcaacaccttggcgacaacaagttgcattaattatcggctgctttgtcggtgcacttgttattgcgccagtattagaaatcttatatcacgcgtatggtttcagtggtgcattgccacgtccagatatggatccttcacaagccttatctgcaccacaagcaacgttaatgaccgccatttctcaaggtattttcacaaataaattggaatggacttacatcttaactggtgtgggtttaggtgctgtgttaattacgattgatgcatttttgaaaaaagtcagcaacaaagtctttagcttgccagttattgctgtggggattggtatttacttaccaccatcaattaatacgcctgtgattgttggtgcattcctagcgtggattatggctcgccatattgcaaaacttggtaacaaagaagtgtcagctaaagcagaacgtttcggtacgcttttctctgcaggtttaattgtaggcgaaagtttaatgggtgtcattttagcattcattattgcggcttctgttaccactggtggttctgaagcgccattatccttaaatcttgaaaactgggatacaattggcgagtggttcggtttaatcgtatttatcgtgggcattgtgatttttgcatctcgcgtattacgtgcgaaaaaaatc

SEQ ID NO: 4610 - protein, 440 aa, Haemophilus influenzae
  Name: NTH2567
LTWGVAVPYFTMSEDIAADASLIDSAMTVWKTKVRYIGVGTIGIAAIWTLLILMKPMIEGMVHSFRMLKGGQEASEHRIDIDLSPKTMIYILIATVALIVISLHHFIAAAPISPELSILLVVVCTFLAVFIGFFVAAASGYMAGLVGSSSSPISGIGIISVIVISLVLVSIGNASGLFETVDGQKFLTALTLFTASIVITTACISNDNLQDLKTGLLVEATPWRQQVALIIGCFVGALVIAPVLEILYHAYGFSGALPRPDMDPSQALSAPQATLMTAISQGIFTNKLEWTYILTGVGLGAVLITIDAFLKKVSNKVFSLPVIAVGIGIYLPPSINTPVIVGAFLAWIMARHIAKLGNKEVSAKAERFGTLFSAGLIVGESLMGVILAFIIAASVTTGGSEAPLSLNLENWDTIGEWFGLIVFIVGIVIFASRVLRAKKI

SEQ ID NO: 4611 - DNA, 414 bp, Haemophilus influenzae
  Name: NTH2568
atgaaatcttacttaaaaacacttattttttttcctctgattttacagatagtcgtcaccgcacttttgatttggttcgatgatgactcaagtggcgttatcgttcctttttctagctatgctctcacagcatttcttctcgccacaattcccgcatttttaaccgcacttttagccgcaaaattccgttacacacgttataacattgcttcgattgtattagtttcatcgatcatttcatttgtttattgcaatatggcatcttatttttatttgttattactcggcgaacaagacacttccttttggggctggttgaccgaagggggattgtccctcgggttaataagcacatgcggaatggttttttatgctctatttgtaatgccttggttgctgccaaaaacaagagaa

SEQ ID NO: 4612 - protein, 138 aa, Haemophilus influenzae
  Name: NTH2568
MKSYLKTLIFFPLILQIVVTALLIWFDDDSSGVIVPFSSYALTAFLLATIPAFLTALLAAKFRYTRYNIASIVLVSSIISFVYCNMASYFYLLLLGEQDTSFWGWLTEGGLSLGLISTCGMVFYALFVMPWLLPKTRE

SEQ ID NO: 4613 - DNA, 807 bp, Haemophilus influenzae
  Name: NTH2569
atgctgacgctaaacgaacatttacttaaccaagtattgctgattgcttaccaagcgggtaagcatttgcaacagttttatcaaaaacaggttcatgttgaattgaaagaagacaacacgcctgtgacggaagcggatctttttgtgagccaatttttaaccgaaaaattgaccgcacttttccctaatgtccctgttctttcggaagaaaattgccatatttcctttgaagaacgtaaaaattggaaagaatattggttgattgatcctcttgatggcacacaacaatttattaatcgtaccgatcaattttctgtgttgataaccttagttcgtaaaaataaacccgtgttaagcattattcatgcgccaattttatcaataacttattatgcaatgcgtgatttcggagcgtttaaaaaacaactggatcaggtaaaaaaactcactaaaaacacgacgaattttgaccgccctttacgaattgcggtaggtgcaaccacttcacaagaaaaagtgcggtcgattttgccgaaggattttacttgtgaatttgttgtggttggttcaagtagcttaaaaagcggtttggtggctgaaggtgcagtagattgttatgttcgtttaggacaaacaggcgaatgggataccgctggcgcagaagtgttgctgaatgaaactcacggtgccatttttgactctcattttgagcctttaacctataaccaacgcgaaacattgattaatccgcattttgttatggtgggcgatcaatcgttcgattggcgttctgtctttcaatttaat

SEQ ID NO: 4614 - protein, 269 aa, Haemophilus influenzae
  Name: NTH2569
MLTLNEHLLNQVLLIAYQAGKHLQQFYQKQVHVELKEDNTPVTEADLFVSQFLTEKLTALFPNVPVLSEENCHISFEERKNWKEYWLIDPLDGTQQFINRTDQFSVLITLVRKNKPVLSIIHAPILSITYYAMRDFGAFKKQLDQVKKLTKNTTNFDRPLRIAVGATTSQEKVRSILPKDFTCEFVVVGSSSLKSGLVAEGAVDCYVRLGQTGEWDTAGAEVLLNETHGAIFDSHFEPLTYNQRETLINPHFVMVGDQSFDWRSVFQFN

SEQ ID NO: 4615 - DNA, 1422 bp, Haemophilus influenzae
  Name: NTH2570
atgcaaactgataataattgtatcgtcatttttggcgcgtctggtgacttaactcatcgtaaactcattccagccctttataatctctacaaaatcgggcgtttgagtgaaaacttttccgttcttggtgttgcacgttctgacttgaacgatgaaactttccgcaaaaaaatgcgtgaggcgttaattcataatgaagaaacaacacctgacactttagatgctttctgctctcatctttattaccaagcagtgaatacttcggatgctcaagattacggcaaacttgttccacgtttagacgaacttcacgataaatatcaaacctgtggtaacaccctttactatatgtccactccgccaagtctttatggcgtgattcctgagtgtttggctgcacatggtttaaatacggaagaatatggctggaaacgtattatcgttgaaaaaccttttggttacgatgaaaaaacagcgcaagcattagacgtacaaatccaccgtttctttgaagaacaccaaatttatcgtatcgaccattatttaggtaaagaaaccgttcaaaacttgctcgtattacgtttttcaaatggttggtttgaaccgctttggaaccgtaatttcattgattatgtagaaattactggtgcagaatctattggcgtggaagagcgcgggggctattatgatggttctggcgcaatgcgagatatgttccaaaaccatttattacaagtccttgctatggttgcaatggagccgccagcgattattaacgcgaattcaatgcgtgatgaagtggcaaaagtgatgcatagtttgcgtccattaacttcggaggatatggagaataaccttgttttgggtcaatacactgcggctgaaattaacggcaaaatggaaaaaggctatctagaagaaaaaggtgtgcctgcagattctcgtactgaaacctacatctcattgcgttgtgaaattgaaaactggcgttgggctggcgtgccgttctatgttcgtacgggtaaacgcttaccagctcgtgtgactgaaattgtgatccattttaaaactacgccacatcctgtattcagccaaaatgcaccagagaataaattgattattcgtattcaacctgatgaagctatttcaatgcgttttggtttgaaaaaaccaggtgcaggttttgaggcgaaagaagtatcaatggatttccgttatgcagatttagcaggcacgcaagtattaaccgcttatgaacgtttattgttggatgcgatgaaaggcgatgcaaccttgtttgcgcgtactgatgctgttcacgctgcatggaaatttgttcagccgattttagattacaaagcgaatggtggtcgtattcacgaatatgaagccggcacttgggggcctgggcagccgataaat

SEQ ID NO: 4616 - protein, 474 aa, Haemophilus influenzae
  Name: NTH2570
MQTDNNCIVIFGASGDLTHRKLIPALYNLYKIGRLSENFSVLGVARSDLNDETFRKKMREALIHNEETTPDTLDAFCSHLYYQAVNTSDAQDYGKLVPRLDELHDKYQTCGNTLYYMSTPPSLYGVIPECLAAHGLNTEEYGWKRIIVEKPFGYDEKTAQALDVQIHRFFEEHQIYRIDHYLGKETVQNLLVLRFSNGWFEPLWNRNFIDYVEITGAESIGVEERGGYYDGSGAMRDMFQNHLLQVLAMVAMEPPAIINANSMRDEVAKVMHSLRPLTSEDMENNLVLGQYTAAEINGKMEKGYLEEKGVPADSRTETYISLRCEIENWRWAGVPFYVRTGKRLPARVTEIVIHFKTTPHPVFSQNAPENKLIIRIQPDEAISMRFGLKKPGAGFEAKEVSMDFRYADLAGTQVLTAYERLLLDAMKGDATLFARTDAVHAAWKFVQPILDYKANGGRIHEYEAGTWGPGQPIN

SEQ ID NO: 4617 - DNA, 735 bp, Haemophilus influenzae
  Name: NTH2571
gtgggtatatttacttacgacatcataaacggaacagcaatgaataccatcactttcccaactgctcaacacgcagtcgaaaaaatcgcgcaagaatttgtgatttacagtcagttaaatcgtcctgtacatatttctctttctggtggatcaacacctaagttgctatttaaaaccttagccaaattgccttatgctgaacaaattaactggaaaaatctgcatttttggtggggagatgatcgtatggttccgccatctgatcctgaaagtaactatggcgaagtacaaaaacttttattcgatcatattcaaattccagcagaaaatatccatcgaatttgtggcgaaaatgaaccgcactttgagttaaaacgctttgaagaagaattaagtgcggtcattccaaacggtatttttgattggattattttaggtatgggaacagatggtcataccgcttctctcttcccacatcaaaccaattttgatgatgaaaacctagctgtcattgcaaaacaccctgaaagcggtcaaattcgcatttctaaaacagctaaactcattgaacaagccaaacgcattacctatttggtaacgggtgaaagcaaagcagatattttaaaagaaattaaaactaccccagcagaaaacttgccttatcccgctgcaaaaatcaaagcaaaaaatggggtgacggagtggtatttggataaagccgcggcaaggctgctc

SEQ ID NO: 4618 - protein, 245 aa, Haemophilus influenzae
  Name: NTH2571
VGIFTYDIINGTAMNTITFPTAQHAVEKIAQEFVIYSQLNRPVHISLSGGSTPKLLFKTLAKLPYAEQINWKNLHFWWGDDRMVPPSDPESNYGEVQKLLFDHIQIPAENIHRICGENEPHFELKRFEEELSAVIPNGIFDWIILGMGTDGHTASLFPHQTNFDDENLAVIAKHPESGQIRISKTAKLIEQAKRITYLVTGESKADILKEIKTTPAENLPYPAAKIKAKNGVTEWYLDKAAARLL

SEQ ID NO: 4619 - DNA, 186 bp, Haemophilus influenzae
  Name: NTH2572
atgttcaccattgaaagcaaaagtggtgttcgtcaatcgagggttatacaacggcttttggcagcagggattatttttggttatgccatcaaccaaatttcggtgatttatttctttttaggttgtgtgattatcgccgcagtttttggggcggttacgacgaagaataaggggatattggtaaag

SEQ ID NO: 4620 - protein, 62 aa, Haemophilus influenzae
  Name: NTH2572
MFTIESKSGVRQSRVIQRLLAAGIIFGYAINQISVIYFFLGCVIIAAVFGAVTTKNKGILVK

SEQ ID NO: 4621 - DNA, 123 bp, Haemophilus influenzae
  Name: NTH2573
ttgcccctacaagcgatcaattttgccaacactgcaggcaactcctactttaccaatatccccttattcttcgtcgtaaccgccccaaaaactgcggcgataatcacacaacctaaaaagaaa

SEQ ID NO: 4622 - protein, 41 aa, Haemophilus influenzae
  Name: NTH2573
LPLQAINFANTAGNSYFTNIPLFFVVTAPKTAAIITQPKKK

SEQ ID NO: 4623 - DNA, 90 bp, Haemophilus influenzae
  Name: NTH2575
ttgagccaattgtttgagatgttcccttttgtggcaactgcgttactctcgattgtaggggcaaattacatttgccctttacctgttcaa

SEQ ID NO: 4624 - protein, 30 aa, Haemophilus influenzae
  Name: NTH2575
LSQLFEMFPFVATALLSIVGANYICPLPVQ

SEQ ID NO: 4625 - DNA, 540 bp, Haemophilus influenzae
  Name: NTH2576
atgactacgaaatataatgcaggtattcatcatcgaagctcgattcgtttaaaacattataattatcgttctgaaggattttatttcatcaccatttgttgtaaaaataaagaatgtctatttgggcatatcattaatcaacaaatgcaattaaatgatttagggaattacgtaaaacagtgttgggaaaatattccaatgttctttccacaagtacgaattgatgaatttgtgattatgccaaatcatttacacggtattattgaaattattgaacaggtaaagggcaaatgtaatttgcccctacaatcgagagtaacgcagttgccacaaaagggaacatctcaaacaattggctcaatagttcgtggatttaaagcaggtgtaacatcttgggcaagaaaaaatagtgaaatttttgatgtttggcagcgaaattattatgaacatattattcgtgatgaaaaatcctatttgcagatttatgaatatattcaaaataatcctattttatgggaacaagatcaattatatgtagat

SEQ ID NO: 4626 - protein, 180 aa, Haemophilus influenzae
  Name: NTH2576
MTTKYNAGIHHRSSIRLKHYNYRSEGFYFITICCKNKECLFGHIINQQMQLNDLGNYVKQCWENIPMFFPQVRIDEFVIMPNHLHGIIEIIEQVKGKCNLPLQSRVTQLPQKGTSQTIGSIVRGFKAGVTSWARKNSEIFDVWQRNYYEHIIRDEKSYLQIYEYIQNNPILWEQDQLYVD

SEQ ID NO: 4627 - DNA, 1176 bp, Haemophilus influenzae
  Name: NTH2577
atgtcagtaaaaggcgacatcggtgttatcggcttagccgtaatggggcaaaacctcattttaaatatgaatgatcatggctttaaagtggtggcatataaccgtaccacttcaaaagtggatgaatttttacaaggtgcagcaaaaggcacgaatattattggcgcatactctttagaagatttagcttctaaattagaaaaaccacgtaaagtgatgttaatggtgcgcgcgggtgatgtggtggatcaattcattgatgcgttactaccgcacttagaagaaggcgacatcattattgatggtggtaactcaaactatccggatacaaatcgtcgtgtaaaagcattggctgaaaaaggcattcgctttatcggttcgggagtttctggcggtgaagaaggtgcacgtcatggaccatctatcatgccaggtggtaatcaagaagcatggcaatatgtgaaaccaattttccaagcaatctcagctaaaacagaacaaggcgaaccttgctgtgactgggttggcggtgaaggcgctggccactttgtgaaaatggttcacaacggtatcgaatatggcgatatgcaattaatctgtgaagcttaccaattcttaaaagaaggtttaggcttgagctatgacgaaatgcaagccatcttcgcagaatggaaaaatactgaacttgatagctatttaatcgatatcaccactgacattcttggctataaagatgcaagtggagaacctttagtcgaaaaaatcttggatactgcgggtcaaaaagggacaggtaaatggacaggtatcaatgcgttagattttggtattccattaactttaatcactgaatccgtttttgcacgctgcgtgtcttcctttaaagatcaacgtgttgcggctaatcaattattcggcaaaactattacaccagttgaaggcgacaaaaaagtatggattgaagcggtacgtaaagcattattagcgtcaaaaattatttcttacgcacaaggctttatgctgattcgtgaagcctctgaacaatttggttgggatattaactatggtgcaactgcgttgttatggcgtgaaggttgtatcattcgtagccgtttcttaggtaatattcgcgatgcttatgaagcaaatccaaatctttgttttcttaggttcaga

SEQ ID NO: 4628 - protein, 392 aa, Haemophilus influenzae
  Name: NTH2577
MSVKGDIGVIGLAVMGQNLILNMNDHGFKVVAYNRTTSKVDEFLQGAAKGTNIIGAYSLEDLASKLEKPRKVMLMVRAGDVVDQFIDALLPHLEEGDIIIDGGNSNYPDTNRRVKALAEKGIRFIGSGVSGGEEGARHGPSIMPGGNQEAWQYVKPIFQAISAKTEQGEPCCDWVGGEGAGHFVKMVHNGIEYGDMQLICEAYQFLKEGLGLSYDEMQAIFAEWKNTELDSYLIDITTDILGYKDASGEPLVEKILDTAGQKGTGKWTGINALDFGIPLTLITESVFARCVSSFKDQRVAANQLFGKTITPVEGDKKVWIEAVRKALLASKIISYAQGFMLIREASEQFGWDINYGATALLWREGCIIRSRFLGNIRDAYEANPNLCFLRFR

SEQ ID NO: 4629 - DNA, 228 bp, Haemophilus influenzae
  Name: NTH2578
gtggtggcaaaatctatcgaagtgggtatcccaatgccttgtatggcgtctgcgattactttcttagatggctatacttcagcacgtttaccagcaaacttattgcaagcacaacgcgactacttcggtgctcatacttatgaacgcacagataaacctcgtggcgagtttttccacaccaactggactggtcgtggcggtaatacagcatcaactacttatgatgtg

SEQ ID NO: 4630 - protein, 76 aa, Haemophilus influenzae
  Name: NTH2578
VVAKSIEVGIPMPCMASAITFLDGYTSARLPANLLQAQRDYFGAHTYERTDKPRGEFFHTNWTGRGGNTASTTYDV

SEQ ID NO: 4631 - DNA, 621 bp, Haemophilus influenzae
  Name: NTH2579
atgctctcgctcactgctgaatcttgtgaactgttcaatattcctttctatcaattcgcccaaatgaaaaaattctgcccagaagatattccagcgattaaagcggattacaaattacattgggataattggaaagcgataattcaatctgtttcagcacaactcggtacgccttttgcgaaaccgcatattgaaagctggaccaatggttggcaggtacgggcgcatttcttcgcttattttaaatacgagtttaaccaaaattctgccgcaatcttttctgtgctattaaatcgtcgccgactaagagtgtgtttagattggcattgctatcgtgcagatcgctcacaaattaatgtgcaacaatataatcagtggcttgatcaatttgatttcaaacaatttgctgattttgagatttggcgagaggatgaaagtgaatatgatgattttcgccaagtgaaggtcatttctgaaaaaaatctgatcttacgttcagatgaggatttttggtgcattgggaaaagtattgaaaaagccgagttaaatcaaatagatcccattttatttattacacacaccattcaacaattacaaccgctttacgatcgctgccatcaa

SEQ ID NO: 4632 - protein, 207 aa, Haemophilus influenzae
  Name: NTH2579
MLSLTAESCELFNIPFYQFAQMKKFCPEDIPAIKADYKLHWDNWKAIIQSVSAQLGTPFAKPHIESWTNGWQVRAHFFAYFKYEFNQNSAAIFSVLLNRRRLRVCLDWHCYRADRSQINVQQYNQWLDQFDFKQFADFEIWREDESEYDDFRQVKVISEKNLILRSDEDFWCIGKSIEKAELNQIDPILFITHTIQQLQPLYDRCHQ

SEQ ID NO: 4633 - DNA, 825 bp, Haemophilus influenzae
  Name: NTH2581
atggcaacctatttcgttggtgatttacaaggctgttatgatgaattacagcttttattagaacgtgtgaacttcaatccaacgcaagataaactttatcttgtgggagatcttgtggctcgtggggataaatcacttgaatgccttcgtttcgtaaaatcacttggcgattcggcacaaaccgtgctaggcaatcatgatttacacttaattgcgactgcactgggtattaaaaaagtaaaaccgcgtgatcgtgttgatgctatttttaatgcgcccgattttgatgaactgattcattggttacgccatcagccattacttgtacataataaaaagttaaacttcctgatggtgcatgcaggtatttcgcctgattggaatttggaaactgcgaaatcttgtgcggctgaagtggaacagattttacaaaatggggattttcattatctcattgaaaatatgtattccgaacaacctgatcgctggtcgcctgatttacagggcttagcgcgtcatcgttacattattaatgcttttactcgaatgcgtttttgctatttagatcatcgcttggattttgcctgtaaatcccctttaaaatatgcacctacagagctcacgccttggtttaatttaggtaatccactttataaacaaattcccattgtctttggacattgggcaagtttagtggatgagcctaccccaaaaggtgtttatgccctagatactggttgtgtgtggaataatcgaatgactatgttacgctgggaagacaagcagatcttcacacaaagtgcggtcaaaaattacagtgatttt

SEQ ID NO: 4634 - protein, 275 aa, Haemophilus influenzae
  Name: NTH2581
MATYFVGDLQGCYDELQLLLERVNFNPTQDKLYLVGDLVARGDKSLECLRFVKSLGDSAQTVLGNHDLHLIATALGIKKVKPRDRVDAIFNAPDFDELIHWLRHQPLLVHNKKLNFLMVHAGISPDWNLETAKSCAAEVEQILQNGDFHYLIENMYSEQPDRWSPDLQGLARHRYIINAFTRMRFCYLDHRLDFACKSPLKYAPTELTPWFNLGNPLYKQIPIVFGHWASLVDEPTPKGVYALDTGCVWNNRMTMLRWEDKQIFTQSAVKNYSDF

SEQ ID NO: 4635 - DNA, 936 bp, Haemophilus influenzae
  Name: NTH2582
ttgttgatttattcttttcgtatagtagaatgcaaaaaatttagttatttccatttttatttaaatatgagtgctattgaaaatattgtcattagtatggaaaatgcaactgaacgtcgcaaacatattactaagcaatttgaatcaaaaaaactttcatttagtttctttaatgcgtacacttatcaatcaatcaatcaatcaatcaatcaatcaatcaatcaatcaatcaatcaatcaatctccatattacataatatagaggaatctagaatacttactaaaggagaaaaaggctgtttaattagccatttcttattatggaataagtgtgtgaatgaaaatttggaatatctcacaatttttgaagatgatgtaattcttggcgagaatgcggaagtgtttttggcacaagatgaatggttaaaaacacgttttgattttaatgatatttttattattcgtttagaaacttttttacagccagttaaacttgagaaacaaactaaaattccacctttttattctaggaactttgatattttaaaatcgactcactgggggacggctggttatattatttctcaaggtgcggctaaatatgtaattgaatatttaaagaatattccttctgatgaaattgttgcagttgatgaacttatttttaataaattagttgatgttgataattatattgtctatcaacttaatccagcaatttgtattcaagaactccaagcgaatcaaagtaaaagtgtattaacaagtggattggaaaaagaacgagaaaaacgtccaaaaatccgtaagaaaaagacattgaaacagcgtttaactcggataaaagaaaatattatacgagctttaaatagaaaaaaatggaaagaacaacaacgtattaaagaaatgcaaggtaaagaaattgtccgttttatg

SEQ ID NO: 4636 - protein, 312 aa, Haemophilus influenzae
  Name: NTH2582
LLIYSFRIVECKKFSYFHFYLNMSAIENIVISMENATERRKHITKQFESKKLSFSFFNAYTYQSINQSINQSINQSINQSISILHNIEESRILTKGEKGCLISHFLLWNKCVNENLEYLTIFEDDVILGENAEVFLAQDEWLKTRFDFNDIFIIRLETFLQPVKLEKQTKIPPFYSRNFDILKSTHWGTAGYIISQGAAKYVIEYLKNIPSDEIVAVDELIFNKLVDVDNYIVYQLNPAICIQELQANQSKSVLTSGLEKEREKRPKIRKKKTLKQRLTRIKENIIRALNRKKWKEQQRIKEMQGKEIVRFM

SEQ ID NO: 4637 - DNA, 861 bp, Haemophilus influenzae
  Name: NTH2583
atgaattcaaaaaaacacttaggccatacggcgcgtaaacgctttggtcaaaactttttacatgatacttctgtaattcaaggtatcgtggcggcgatttacccacaacccaatcaattcttagtggaaattggtccgggacttggcgcattaacagagcctgttggtgaacttgtcgatcatctgactgtggtagagcttgaccgagaccttgcggaacgtttacgtcaccatccatttttacatcaaaagctcaccgttattgaaacagatgcgatgcaatttgattttgatgagctttatacaacagagaatttagcagaaaaagggcaaaaattacgtgtatttggtaacttgccttataacatttctacgccattaatgttccacttatttaagtatcatgatgtgattcaagatatgcacttcatgctgcaaaaagaagtggttaaacgcttatgcgcagggccaaatagcaaagcttatggtcgcttaaccattatggcgcaatatttctgccaagtgatgcctgtacttgaagtacctccttctgcattcaaaccagcaccgaaagtggattcagccgttgtgcgtttaattccgcataaagaattgccgcaccctgtaaaagatttatattggttgaaccgtgtttgctcccaagcgttcaatcaacgccgcaaaacattgcgtaatgcactttcaacactattttcacctgaaaatctgaccgcacttggtattgatttaaatgcacgtgcagaaaatttggctatcgcagattatgcgcgcttagcgaactggctggcagataatccaccagcagatgttaataacgatgaaatattagattcagaagag

SEQ ID NO: 4638 - protein, 287 aa, Haemophilus influenzae
  Name: NTH2583
MNSKKHLGHTARKRFGQNFLHDTSVIQGIVAAIYPQPNQFLVEIGPGLGALTEPVGELVDHLTVVELDRDLAERLRHHPFLHQKLTVIETDAMQFDFDELYTTENLAEKGQKLRVFGNLPYNISTPLMFHLFKYHDVIQDMHFMLQKEVVKRLCAGPNSKAYGRLTIMAQYFCQVMPVLEVPPSAFKPAPKVDSAVVRLIPHKELPHPVKDLYWLNRVCSQAFNQRRKTLRNALSTLFSPENLTALGIDLNARAENLAIADYARLANWLADNPPADVNNDEILDSEE

SEQ ID NO: 4639 - DNA, 759 bp, Haemophilus influenzae
  Name: NTH2584
gtggtcatttgtggtggaaatcataaaggatatttacaagcatcaaagaaaaagcccagcatatcagatcgatttaaaatcatgggtgaacaaaaatccttaaatcagtccaaatatgtcatcgctcattctgcattaatgaaaaaagaactcgttgagttatatcatgtctctgaaaacaaaattgatgtgatttatccccctattaatacagataaattcacacaaatcaatgaagaagaaagagtaaagctcagagaaaagttaggtttcaaaaaagatgaaatcatttacctattcccttctactggccatacgcgaaaaggtttcgatattttgaaaaaatattttgaaaaaactcagttacctattcgcttagtggtcgcaggaacgcctgtagaagaaaatcctaaaatttcttcacttggtttttgcaaaaatatgcctgaattatatcaagcggcagatttcactattatggcatctcaatatgaaccatttgggcttgttggactagaatctatattatctggtacgccagttattttttctgaaaacatgggatgcctagaagtattaaaaaacgaatttggctatacattttctagagaaaacataagtactttagatgaggcaattcaaaaatcagtaaaacaagcatctgaacagctacaccgtattctcaatccaatggattgtattcgttataatccaagtttgagtcatcatattaaagctatactggaactcatcgctaaa

SEQ ID NO: 4640 - protein, 253 aa, Haemophilus influenzae
  Name: NTH2584
VVICGGNHKGYLQASKKKPSISDRFKIMGEQKSLNQSKYVIAHSALMKKELVELYHVSENKIDVIYPPINTDKFTQINEEERVKLREKLGFKKDEIIYLFPSTGHTRKGFDILKKYFEKTQLPIRLVVAGTPVEENPKISSLGFCKNMPELYQAADFTIMASQYEPFGLVGLESILSGTPVIFSENMGCLEVLKNEFGYTFSRENISTLDEAIQKSVKQASEQLHRILNPMDCIRYNPSLSHHIKAILELIAK

SEQ ID NO: 4641 - DNA, 195 bp, Haemophilus influenzae
  Name: NTH2585
atgaataaaacattactaagtaataataatcacccaaatatttcattaacctgtcaaaaatttcaatacggtggaggtatggaacgatatcttattgatattgttaatggattatctcaggctaacattacacctaaaatttactctgccaagtttgatactgcattacctgaatataatctaattatatccaat

SEQ ID NO: 4642 - protein, 65 aa, Haemophilus influenzae
  Name: NTH2585
MNKTLLSNNNHPNISLTCQKFQYGGGMERYLIDIVNGLSQANITPKIYSAKFDTALPEYNLIISN

SEQ ID NO: 4643 - DNA, 252 bp, Haemophilus influenzae
  Name: NTH2586
gtgcggataaaaaatcgattatttttagaggatacaatggcgaaagaagattgcattgagatgcaaggcacaattttagagactttaccgaatactatgttccgcgtggagttggaaaacggtcacgtggttactgcacatatttccgggaaaatgcgtaaaaactatattcgtattttgactggggataaagtgaccgtagaaatgacgccttatgatttaagtaaaggacgtattattttccgcagccgt

SEQ ID NO: 4644 - protein, 84 aa, Haemophilus influenzae
  Name: NTH2586
VRIKNRLFLEDTMAKEDCIEMQGTILETLPNTMFRVELENGHVVTAHISGKMRKNYIRILTGDKVTVEMTPYDLSKGRIIFRSR

SEQ ID NO: 4645 - DNA, 1440 bp, Haemophilus influenzae
  Name: NTH2587
atgtttggaccattcaaacccgctccgcatattgcggaacttccagcggaaaaaattgattccacgtataaacgcttacgttggcaagtgtttgcagggatcttcttcggttatgctgcatattattttgtgcgtgcaaactttgacttagcacaacctggtttaattcaagctggcttgtactcaaaagcggaattaggtgttatcggctcagcggctggtcttgcttacggtttatcaaaattcgttatggcaggtatgtctgaccgttctaaccctcgtgtattcttaccatttggtttattgctctctggtttatgtatgaccttaatgggtttattcccatgggcaacttcaggcattgccattatgtgggtaatgatcttcttaaatggttggttccaaggtatgggttggcctccatgtggtcgtactatggtgcattggtggtctaaatctgaacgcggtactatcgtgtcaatttggaatacggcacataatatcggtggtatggtgcctggtgcaatggtgttattagctagtgcaattttcttcagtactcacggtattgaagcgcaggcgaaagatgtttggcaacaatcattatacttccctggtattgctgcgatgatctttgcaattcctgtgtacttcgtgatgcgtgatactccacaatcttgtggtttaccatcaatcgaaaaatggcgtaatgactacccagatgactataacgaaaaaacttacgaaaacgatttaactgcaaaagaaatcttcgtaacttatgtattaaaaaacaaattgttatggtatatcgcgattgctaatgtgttcgtctatttaatccgctacggtgtattaaaatggtctccagtttacttgagtgaagtgaaacacttcaacatcaaaggtactgcatgggcatacacaatctatgaattagcagcggttccaggtacattattatgtggttgggtatcagataaagtgtttaaaggtaaacgtggtttaactggtttcatctttatgatcttaaccactgcagcggttgttgcgtactggatgaacccagctacaccagaagcagagcttgcaaactactcagcttggtatgaaaacccatatcaattaactgatttcgtattaatgaccttaatcggtttcttaatctacggtcctgtaatgttaatcggtttacatgctcttgagcttgcaccgaaaaaagcagcaggtactgcagcaggtttcactggtttattcggttacttaggtggtactgtatcagcttcagcagttattggttgggcagctcaacattacggatgggacggtggtttctacgtaatgatcggcggtggcgtattagcggtgttattactcttaatcgtaatggttgaagaaggaaaacacaaagcgaaattaggcgatacttacggtactaaa

SEQ ID NO: 4646 - protein, 480 aa, Haemophilus influenzae
  Name: NTH2587
MFGPFKPAPHIAELPAEKIDSTYKRLRWQVFAGIFFGYAAYYFVRANFDLAQPGLIQAGLYSKAELGVIGSAAGLAYGLSKFVMAGMSDRSNPRVFLPFGLLLSGLCMTLMGLFPWATSGIAIMWVMIFLNGWFQGMGWPPCGRTMVHWWSKSERGTIVSIWNTAHNIGGMVPGAMVLLASAIFFSTHGIEAQAKDVWQQSLYFPGIAAMIFAIPVYFVMRDTPQSCGLPSIEKWRNDYPDDYNEKTYENDLTAKEIFVTYVLKNKLLWYIAIANVFVYLIRYGVLKWSPVYLSEVKHFNIKGTAWAYTIYELAAVPGTLLCGWVSDKVFKGKRGLTGFIFMILTTAAVVAYWMNPATPEAELANYSAWYENPYQLTDFVLMTLIGFLIYGPVMLIGLHALELAPKKAAGTAAGFTGLFGYLGGTVSASAVIGWAAQHYGWDGGFYVMIGGGVLAVLLLLIVMVEEGKHKAKLGDTYGTK

SEQ ID NO: 4647 - DNA, 1092 bp, Haemophilus influenzae
  Name: NTH2588
atgaaacttaaaactttagccctttctttattagcagctggtgtactagcaggttgtagcagccattcatcaaatatggcgaatacccaaatgaaatcagacaaaatcattattgctcaccgtggtgctagcggttatttaccagagcatacgttagaatctaaagcacttgcgtttgcacaacaggctgattatttagagcaagatttagcaatgactaaggatggtcgtttagtggttattcacgatcactttttagatggcttgactgatgttgcgaaaaaattcccacatcgtcatcgtaaagatggccgttactatgtcatcgactttaccttaaaagaaattcaaagtttagaaatgacagaaaactttgaaaccaaagatggcaaacaagcgcaagtttatcctaatcgtttccctctttggaaatcacattttagaattcatacctttgaagatgaaattgaatttatccaaggcttagaaaaatccactggcaaaaaagtagggatttatccagaaatcaaagcaccttggttccaccatcaaaatggtaaagatattgctgctgaaacgctcaaagtgttaaaaaaatatggctatgataagaaaaccgatatggtttacttacaaactttcgattttaatgaattaaaacgtatcaaaacggaattacttccacaaatgggaatggatttgaaattagttcaattaattgcttatacagattggaaagaaacacaagaaaaagacccaaagggttattgggtaaactataattacgattggatgtttaaacctggtgcaatggcagaagtggttaaatatgccgatggtgttggcccaggttggtatatgttagttaataaagaagaatccaaacctgataatattgtgtacactccgttggtaaaagaacttgcacaatataatgtggaagtgcatccttacaccgtgcgtaaagatgcactgcccgagtttttcacagacgtaaatcaaatgtatgatgccttattgaataaatcaggggcaacaggtgtatttactgatttcccagatactggcgtggaattcttaaaaggaataaaa

SEQ ID NO: 4648 - protein, 364 aa, Haemophilus influenzae
  Name: NTH2588
MKLKTLALSLLAAGVLAGCSSHSSNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIK

SEQ ID NO: 4649 - DNA, 159 bp, Haemophilus influenzae
  Name: NTH2590
atgctgatttcccacaagccaaaactagcgcctgctacttttagtgctgcaacgcagcccacaccaaagaaaatcaataaggctgtacctaaaaactcgccaatacagttcgcttttaatgatttatccatagatcactccttagaagtgcggttgaaa

SEQ ID NO: 4650 - protein, 53 aa, Haemophilus influenzae
  Name: NTH2590
MLISHKPKLAPATFSAATQPTPKKINKAVPKNSPIQFAFNDLSIDHSLEVRLK

SEQ ID NO: 4651 - DNA, 651 bp, Haemophilus influenzae
  Name: NTH2591
atgggcgttgcacttgcagtatatgcaacagcgggtttatctggcgcacatttaaaccctgcagtaaccattgccctttggaaatttgcttgctttgatggcaaaaaagtaattccttacatcatttcacaaatgctcggcgcattctttgctgccgcattagtttatgccttataccgcaatgtttttatcgattatgaaacagtccacaatattgttcgtggtacacaagaaagtttaagccttgcgggtacattctccacttatcctcatccaagtttaagcattggtggcgcctttgctgtggaattcgtgattactgcaattcttatggcattaattatggcattaactgacgatggaaacggagtacctcgtggtccgcttgccccattattaatcggtatcttgatagccgttattggtggtgctatgggaccattaactggttttgccatgaatccagcacgtgacttcggaccaaaattctttgcttatctcgctggctggggcgaactcgctttaactggcggacgcaaaatcccttattttatcgttccaatggttgcacctgttttaggcgcattagctggtgcatggttatacaaaaaagcaattggcggcaatttaccttgtaattgcggctgcgaa

SEQ ID NO: 4652 - protein, 217 aa, Haemophilus influenzae
  Name: NTH2591
MGVALAVYATAGLSGAHLNPAVTIALWKFACFDGKKVIPYIISQMLGAFFAAALVYALYRNVFIDYETVHNIVRGTQESLSLAGTFSTYPHPSLSIGGAFAVEFVITAILMALIMALTDDGNGVPRGPLAPLLIGILIAVIGGAMGPLTGFAMNPARDFGPKFFAYLAGWGELALTGGRKIPYFIVPMVAPVLGALAGAWLYKKAIGGNLPCNCGCE

SEQ ID NO: 4653 - DNA, 1509 bp, Haemophilus influenzae
  Name: NTH2592
atgacagacaaaaaatacatcattgcattagaccaaggcacaacaagctctcgcgcagtattattagatcataatgcgaatgtggttgaaattgcacaacgtgaatttacccaaatctaccctcgagctggttgggtagaacataacccaatggaaatttgggcaactcaaagctcaaccttaaacgaagtcgttgcaaaagcgggcattacatctgatgaaatcgctgctatcggtatcaccaaccaacgtgaaaccaccattgtatgggaaaaatcaaccggtacacctgtttacaacgcgatcgtttggcaatgccgccgtactgcagacattaccgataaattaaaagccgatggccatgaagaatatattcgtaataccacaggcttagtggttgacccttacttctctggtacaaaagtaaaatggattttggataacgttgaaggcgcacgagaaaaagctgaacgaggcgaattattatttggtaccgttgatacttggcttgtatggaaattgactcaaggccgagtgcacgtaaccgattataccaacgcatctcgtaccatgttatttaacatccatactaaacaatgggatgacaagatgcttgaaatcttgaatattcctcgttcaatattacctgaagtacgtaattcttctgaaatttacggccaaaccaatatcggtggtaaaggtggtgtgcgtattcctgttgcagggattgctggtgaccaacaagccgctctttacggacatctttgcgtacatgcaggccaagccaaaaacacttacggcacaggttgctttatgttactccacacgggtaacaaagctattacatccaaaaatggactactcacaaccattgcttgtaatgcaaaaggcgaaccagaatatgccttagaaggttcagtatttatcgcgggtgcatcaatccaatggctccgtgatgaactcaaaactgttcacgatagttttgactctgaatactttgcacaaaaagtgactgatagtaatggcgtatatgttgttccagctttcacaggcttaggtgcaccatattgggatccatatgcgcgcggtgcgatttttggtctttctcgcggtgcaaactgtaatcatattgttcgagcaaccttacaatctattgcttaccaaacccgtgatgtcttagaggctatgcaatcagattcgggtgaacgattacaatatctccgtgtagatggtggtgcgacaaacaataacttcttaatgcaattccaagctgacattttagatgtaaatgtagagcgcccagttgtgaaagaagtgaccgctctaggtgcagcttatcttgctggtttagcaacaggcttctggaaagatttagacgagcttcgcgataaagcccgtgtagaacgcactttcagcccagacagcgacaatgaaaaacgtgaacgtcgctacaaaggctggaaaaaagcagttaaacgctcattagaatgggcaaaagaagatgaagaa

SEQ ID NO: 4654 - protein, 503 aa, Haemophilus influenzae
  Name: NTH2592
MTDKKYIIALDQGTTSSRAVLLDHNANVVEIAQREFTQIYPRAGWVEHNPMEIWATQSSTLNEVVAKAGITSDEIAAIGITNQRETTIVWEKSTGTPVYNAIVWQCRRTADITDKLKADGHEEYIRNTTGLVVDPYFSGTKVKWILDNVEGAREKAERGELLFGTVDTWLVWKLTQGRVHVTDYTNASRTMLFNIHTKQWDDKMLEILNIPRSILPEVRNSSEIYGQTNIGGKGGVRIPVAGIAGDQQAALYGHLCVHAGQAKNTYGTGCFMLLHTGNKAITSKNGLLTTIACNAKGEPEYALEGSVFIAGASIQWLRDELKTVHDSFDSEYFAQKVTDSNGVYVVPAFTGLGAPYWDPYARGAIFGLSRGANCNHIVRATLQSIAYQTRDVLEAMQSDSGERLQYLRVDGGATNNNFLMQFQADILDVNVERPVVKEVTALGAAYLAGLATGFWKDLDELRDKARVERTFSPDSDNEKRERRYKGWKKAVKRSLEWAKEDEE

SEQ ID NO: 4655 - DNA, 465 bp, Haemophilus influenzae
  Name: NTH2593
atgagcgaaaaatatgtggtaacttgggatatgtttcaaatgcatgcccgaaaattatcagaacgtttacttccagcttctcaatggaaaggtattattgcggtgagtcgcggtggtttatttccagcggctgtattggctcgtgaattgggtcttcgtcatattgaaaccgtttgtatcgcaagttatcacgatcataacaaccagggagaactacaagttcttcatgcagcccaagtgccaaatggtggcgaaggatttatcgtggtagatgatttagttgatacgggtaatactgcgcgtgcgattcgtcaaatgtaccctaatgcaaaatttgtcactgtatttgcaaaacctgcaggtgcggaattagtggatgattacgtaattgatattccacaaaatacttggattgagcaaccttgggatttaggtttaacctttgttccacctctctctagaaaa

SEQ ID NO: 4656 - protein, 155 aa, Haemophilus influenzae
  Name: NTH2593
MSEKYVVTWDMFQMHARKLSERLLPASQWKGIIAVSRGGLFPAAVLARELGLRHIETVCIASYHDHNNQGELQVLHAAQVPNGGEGFIVVDDLVDTGNTARAIRQMYPNAKFVTVFAKPAGAELVDDYVIDIPQNTWIEQPWDLGLTFVPPLSRK

SEQ ID NO: 4657 - DNA, 135 bp, Haemophilus influenzae
  Name: NTH2594
ttgcataaagatgcactacccgcgtttttcacagacgtaaatcaaatgtatgatgcattattgaataaatcaggggcaacaggtgtatttactgatttcccagatacttgcgtggaattcttaaaaggaataaaa

SEQ ID NO: 4658 - protein, 45 aa, Haemophilus influenzae
  Name: NTH2594
LHKDALPAFFTDVNQMYDALLNKSGATGVFTDFPDTCVEFLKGIK

SEQ ID NO: 4659 - DNA, 822 bp, Haemophilus influenzae
  Name: NTH2595
atgaaaacaacgttaaaaatgaccgcacttacggctctttctgctcttgtcttagctggctgtggtgcacaccaaatgaaatcagaagaacaagcaaatatgcaattacaacaacaagctgttcttggcttaaactggatgcaagattctggcgaatataaagcattagcttatcaagcgtacaatgcggcaaaagttgcatttgatcacgcaaaagtggcaaaaggtaagaaaaaagcggttgtggctgatttagatgaaactatgttagacaacagcccttatgctggctggcaagttcaaaataacaaaccattcgatggtaaagattggactcgttgggtagacgcacgtcaatctcgtgccgttccgggtgcggtagaatttaataattatgtaaacagccacaaaggtaaagtgttctacgtaacaaaccgcaaagacagctctgaaaaagcaggcactattgatgatatgaaacgcttaggtttcaatggcgtggaagaatctgcattttatttgaaaaaagacaaatcagctaaagcggctcgttttgcagaaattgaaaaacaaggctatgaaatcgtactttatgtaggcgataacttagatgacttcggtaataccgtatatggcaaattaaacgctgaccgccgtgcattcgttgatcaaaaccaaggcaaatttggtaaaactttcatcatgttacctaacgcaaactacggtggctgggaaggcggtttagctgaagggtatttcaaaaaagatacacaaggccaaatcaaagctcgtttagatgcagtacaagcttgggatggtaaa

SEQ ID NO: 4660 - protein, 274 aa, Haemophilus influenzae
  Name: NTH2595
MKTTLKMTALTALSALVLAGCGAHQMKSEEQANMQLQQQAVLGLNWMQDSGEYKALAYQAYNAAKVAFDHAKVAKGKKKAVVADLDETMLDNSPYAGWQVQNNKPFDGKDWTRWVDARQSRAVPGAVEFNNYVNSHKGKVFYVTNRKDSSEKAGTIDDMKRLGFNGVEESAFYLKKDKSAKAARFAEIEKQGYEIVLYVGDNLDDFGNTVYGKLNADRRAFVDQNQGKFGKTFIMLPNANYGGWEGGLAEGYFKKDTQGQIKARLDAVQAWDGK

SEQ ID NO: 4661 - DNA, 681 bp, Haemophilus influenzae
  Name: NTH2596
atgaagaagaatttttcagtggggaaattgccgtttaaaggaaaaagtgcggttaattttcaccgcacttttaaaccaaaattaaaacccaaaacgttgtcgttggatgaaaccaaagttgtgttattcaataaaccttttgatgtactcacgcaatttaccgacgaacaagggcgcgctaccttaaaagattttatttcaattccaaatgtttatgcggcaggtcgattagatagagacagtgaaggattactgattttaaccaataatggcgaattacaacatcgtttatcagatcccaaatttaaaacagaaaaaacctattgggtgcaagtggaaggtatccctgaagaaaccgatttagcacaactcagaaaaggtgtagaacttaaagatggtatgactaaacaggctcaagtgcggttaatttcagagccaaatttatgggaacgcaatccacctatccgagaacggaaaaatattcccacaagctggttagaaattaaaattagtgaagggcgcaaccgccaagtgcggagaatgactgcgcatattggcttccccaccttacgattagtgagagtgagtatgggctcattatctattgatggattagcaaatggctcatttagattattatcattggatgaaataaaagtattatttcagaccgtcaaatta

SEQ ID NO: 4662 - protein, 227 aa, Haemophilus influenzae
  Name: NTH2596
MKKNFSVGKLPFKGKSAVNFHRTFKPKLKPKTLSLDETKVVLFNKPFDVLTQFTDEQGRATLKDFISIPNVYAAGRLDRDSEGLLILTNNGELQHRLSDPKFKTEKTYWVQVEGIPEETDLAQLRKGVELKDGMTKQAQVRLISEPNLWERNPPIRERKNIPTSWLEIKISEGRNRQVRRMTAHIGFPTLRLVRVSMGSLSIDGLANGSFRLLSLDEIKVLFQTVKL

SEQ ID NO: 4663 - DNA, 396 bp, Haemophilus influenzae
  Name: NTH2597
gtgcgccaaagtgcggtcaataaaatcgaagatttaggctttgaatatcgcaaattaggttggcaatctgtgctcggctcatcggggacgattaaaactgttgcgcaagtcattgcgactaatctcgatccaaatggaaccattacagccgagcgattaaatgctctaattgaacaaacactacaagccaagcattttaccgagctaaatattaacggtttaaaccaagaccgtgtggatgtttttgtacccggtttagcgattttaagtgcagtgtttgaggtttttcatattcaacaaatgcgctattctgacggtgcattgcgcgaaggcgtcatttatagcctagaaaaaacttccaagttgcagatattcgagcgtgcaccgcttgagggt

SEQ ID NO: 4664 - protein, 132 aa, Haemophilus influenzae
  Name: NTH2597
VRQSAVNKIEDLGFEYRKLGWQSVLGSSGTIKTVAQVIATNLDPNGTITAERLNALIEQTLQAKHFTELNINGLNQDRVDVFVPGLAILSAVFEVFHIQQMRYSDGALREGVIYSLEKTSKLQIFERAPLEG

SEQ ID NO: 4665 - DNA, 636 bp, Haemophilus influenzae
  Name: NTH2598
ttgatttactttataaatttgaattttaggaatgttatgaatgacgctattttagaacccaaacatcgtggcaatgtacgtgaaattgccgcaattgatcttggctcaaacagctttcatatgattgttgcgcgtattgtaaacggctcaatccaagtgctttcgcgcttaaaacaaaaagttaaactcgcggaaggcttagatgaaaatgcggtgcttaatcaagaggctatcacacgtggcgtgaattgcttagccttatttgccgaacgtttacaaggttttcctatggaaaacgtcaatgtagttggcacttatacgttacgaagagcggtgaataatgacgaatttttacgtcaagcagccaaagttttcccctatcccattaatattattagtgggcaaacggaagctaaaaccatctacgctggcgtatgccatactcagccagaaaaaggcagaaagcttgttatagatattggtggcggctcgacagaaatgattatcggcgatgatttcacgccgcttatggctgaaagccgacatatgggatgcgtgagttttgcgactcaatttttttaccgatggcatcatttccccagaaaactttcaacgcgtgcgccaaagtgcggtcaa

SEQ ID NO: 4666 - protein, 212 aa, Haemophilus influenzae
  Name: NTH2598
LIYFINLNFRNVMNDAILEPKHRGNVREIAAIDLGSNSFHMIVARIVNGSIQVLSRLKQKVKLAEGLDENAVLNQEAITRGVNCLALFAERLQGFPMENVNVVGTYTLRRAVNNDEFLRQAAKVFPYPINIISGQTEAKTIYAGVCHTQPEKGRKLVIDIGGGSTEMIIGDDFTPLMAESRHMGCVSFATQFFYRWHHFPRKLSTRAPKCGQ

SEQ ID NO: 4667 - DNA, 1737 bp, Haemophilus influenzae
  Name: NTH2599
gtgtcttacgataacaaacaaacacaagccaatattgccgcacattgctggcaaaacacagatatagaattatgtttcccacaagcattcaatgcaggcaagcaaggtaatatccctttccaattcaaacgtgttaatttggatttaatgaataaacttatcgaacaagatagcctcaaaggaaacttgcaagcgcaaggtaatgtggcttggtttacggataaaccattccaatttagcacaaaagtagatggcaatcatttagctttctctcaaaaattggattaccgcacgtttaaattagatattccaaaattaacccttaatgccgacattcaaaataataatttggttttaaaaacagacatcaatttgcataatcaaggcagaattgtaggcgatattcgtttaaatgattttgttaaaactcgccaacttggcggaacccttgcgatagaacgattaaacttgtcgatcgcaaatcagctacttactagcggtgaatcagtgaatggtaaggtagtctcgaagttgagtttcggcgggaatttagagaaaccattattaaatggtgacttcaatattcgtaatattcgtaccaaattgaaatctatgccagtcaatattacagatggcgatattgccctacgctttaatggtaaccgttcaacattgcaagggaaaatcgaaacagtagatagtcacttaaacttaactggacgtgcaaactgggcgaatattgaacattggacgacagaattgaatgcacaagcaaataatttcaacgtggatattccatctatggcgaagctacgtttcagtccagatatcacgataaaagccaatcctaaggaattgaatttaagcggaacagtggatattccttgggcgcgtattaaaattgacagtctgccagatactgctgagccagtcagcgaagatgaagtgattttaaacggcccgcacaagagcaaagaagaactgattaaacgtgaatttgccgcaaaaacgaaatcaggaatggatattcgctctgatttacgcatcaatattggtaaagacgtcagccttgatgcctatggcttaaaaaccaatcttgatggtttactttctgtgaaacaagacaaaggcaatttaggtttattcgggcaaatcaatttaaccaaaggtcgctatgcttctttcggacaagatttactcattcgtaaagggcttattagtttttctgggcaagcggcacaacctacgttgaatattgaggctattcgtaatcctgaaacaatggaagacagcaaaattactgctggagtgagagtgattggcatagccgatagcccagaagtcactattttcagtgaaccaagcaaaccacaagatcaagcactttcttatttattaacaggtcgttcgttagaaagtagtggagaagtgggttcaacgggatcagttggtgcagcattaattggtttaggcatttcaaagagcggtaaattagtgggcagtattggcgaagtttttggtattcaagacttaaaccttggtacatctggcgtgggcgataaatctaaggttacagtaagtggcaatattaccaatcgcttacaaataaaatatggcgtaggtttatttgatgggttagcagaagttacattacgttatcgcctaatgccacagctttattttcaatccgtttctagcacaaaccaagtgtttgatttactttataaatttgaattt

SEQ ID NO: 4668 - protein, 579 aa, Haemophilus influenzae
  Name: NTH2599
VSYDNKQTQANIAAHCWQNTDIELCFPQAFNAGKQGNIPFQFKRVNLDLMNKLIEQDSLKGNLQAQGNVAWFTDKPFQFSTKVDGNHLAFSQKLDYRTFKLDIPKLTLNADIQNNNLVLKTDINLHNQGRIVGDIRLNDFVKTRQLGGTLAIERLNLSIANQLLTSGESVNGKVVSKLSFGGNLEKPLLNGDFNIRNIRTKLKSMPVNITDGDIALRFNGNRSTLQGKIETVDSHLNLTGRANWANIEHWTTELNAQANNFNVDIPSMAKLRFSPDITIKANPKELNLSGTVDIPWARIKIDSLPDTAEPVSEDEVILNGPHKSKEELIKREFAAKTKSGMDIRSDLRINIGKDVSLDAYGLKTNLDGLLSVKQDKGNLGLFGQINLTKGRYASFGQDLLIRKGLISFSGQAAQPTLNIEAIRNPETMEDSKITAGVRVIGIADSPEVTIFSEPSKPQDQALSYLLTGRSLESSGEVGSTGSVGAALIGLGISKSGKLVGSIGEVFGIQDLNLGTSGVGDKSKVTVSGNITNRLQIKYGVGLFDGLAEVTLRYRLMPQLYFQSVSSTNQVFDLLYKFEF

SEQ ID NO: 4669 - DNA, 399 bp, Haemophilus influenzae
  Name: NTH2600
ttgttccgtcgtattcgtttgaaagatccgcttaaacaaaaacaactgttaaaaggcttggtgcaactttctgaagagggtgcagtgcaagtgtttcgtccattattaaacaacgatttaattgtgggggctgtgggtgtgttgcagtttgatgtggtggtttcgcgtttaaaaactgaatataacgtggaagcgatttatgaaaatgtgaacgttgccacggctcgttgggtggaatgtgccgatggaaaaaaatttgaagaatttaaacgtaaaaacgagcaaaatttagccttagatggcggcgataatttaacctatattgcaccaacaatggtaaatctaaatttagctcaagaacgttatcctgatgtcgttttttacaaaactcgcgaacat

SEQ ID NO: 4670 - protein, 133 aa, Haemophilus influenzae
  Name: NTH2600
LFRRIRLKDPLKQKQLLKGLVQLSEEGAVQVFRPLLNNDLIVGAVGVLQFDVVVSRLKTEYNVEAIYENVNVATARWVECADGKKFEEFKRKNEQNLALDGGDNLTYIAPTMVNLNLAQERYPDVVFYKTREH

SEQ ID NO: 4671 - DNA, 231 bp, Haemophilus influenzae
  Name: NTH2602
atggattttaattttattgagtttttaggttatatggcgactttttttgttgctgtatcttttttatttaaatctattgtgtatttacgcattgtaaatagtatcggcgcgattttatttgttatttacagcgtaattatcacagcataccccgttgcattattaaatgcctttttagttgtggtaaatatttatcaactttggcgattaaaacaagaaaatctctctaaa

SEQ ID NO: 4672 - protein, 77 aa, Haemophilus influenzae
  Name: NTH2602
MDFNFIEFLGYMATFFVAVSFLFKSIVYLRIVNSIGAILFVIYSVIITAYPVALLNAFLVVVNIYQLWRLKQENLSK

SEQ ID NO: 4673 - DNA, 183 bp, Haemophilus influenzae
  Name: NTH2603
atgtttggtatgcttgtcgtttattgctataaaaatattgagattttaactggctatcacggtattcctgatttgcttgcagggatagtcgtgcttggcttacatttctggaagaaaaatatgtttctatctattgctgttggtacgcttttctatatggctctcgttcaacttatttttata

SEQ ID NO: 4674 - protein, 61 aa, Haemophilus influenzae
  Name: NTH2603
MFGMLVVYCYKNIEILTGYHGIPDLLAGIVVLGLHFWKKNMFLSIAVGTLFYMALVQLIFI

SEQ ID NO: 4675 - DNA, 129 bp, Haemophilus influenzae
  Name: NTH2604
atggggcgattaacaggaaatacaaaaaatggtaataaacgtgtaaattgtaccgccactatacaaattccaatggtaatgatttgttctgttaatgtcattttaaagattccaattttgtttctaatt

SEQ ID NO: 4676 - protein, 43 aa, Haemophilus influenzae
  Name: NTH2604
MGRLTGNTKNGNKRVNCTATIQIPMVMICSVNVILKIPILFLI

SEQ ID NO: 4677 - DNA, 732 bp, Haemophilus influenzae
  Name: NTH2605
atgaatttatctcaacaaaatcaacactctaacccaattactgaagcggctaaggctgcttttccctacagcgtaccaatgattgcaggatttttatttcttggcatagcatacggtatttatatgaaagcacttggtttcggatttttatatcctactttgatggctttacttatttatgcgggttctgttgaatttattgcagcaggcgcacttattgcacctttctctccaatcagcgtattattaattaccttaatgattagtgcccgccaaattttttatggcatatcaatgctagaaaaatatggcatacatataggaaaaaaacgttggtatttaatcacaacacttgtagatgaatctttttccctaaattatatggcaaaaatcccacagcacttagataaaggttggtatatgttttttgtgagcttatatttgcatatttattgggtacttggcgcagcaatggggaatttatttggtactgttttaccttttaatttaaaaggtgtggaattttcaatgacagcactattcttagttatttttgcagaaaattggctaaaagaaaaatcccacgaaagctctctcttaggtttagggattgcatttgcttttttacttattataggaaaagaatattttttaattccaacattaattggcatttggttaattctaactatgcgcataactaaattagaaacaaaattggaatctttaaaa

SEQ ID NO: 4678 - protein, 244 aa, Haemophilus influenzae
  Name: NTH2605
MNLSQQNQHSNPITEAAKAAFPYSVPMIAGFLFLGIAYGIYMKALGFGFLYPTLMALLIYAGSVEFIAAGALIAPFSPISVLLITLMISARQIFYGISMLEKYGIHIGKKRWYLITTLVDESFSLNYMAKIPQHLDKGWYMFFVSLYLHIYWVLGAAMGNLFGTVLPFNLKGVEFSMTALFLVIFAENWLKEKSHESSLLGLGIAFAFLLIIGKEYFLIPTLIGIWLILTMRITKLETKLESLK

SEQ ID NO: 4679 - DNA, 927 bp, Haemophilus influenzae
  Name: NTH2606
atgaaaccaacctttctagaatttagacatcttaaaactttattggctttaaaagagacaggcagcgtttctctagctgcaaagcacgtatatctaacccaatcagccctttctcaccaaattaaattaatagaagaacaatttggcttgcctttatttgagcgtaaaagtaatccacttcgttttacttcagcgggagagcgtttaattcgtcttgcgaatgaagtaatgccgaaagtgattgatgctgaacgtgatcttgcaagggtaaaacacggcgatgcaggacagttacgtatagcggtggaatgccatacttgttttgattggttaatgccagcgatggatgaattccgtcagcattgggggctagtagaactggatattgtatctggctttcatactgatcccgttggtttattactttcccatcgagcagattgggcgatagtatcagaaatagagcataatgatgatgtcatttttaaaccgctcttttcttatgaaatggttgggatttgctcaaaaaatcattctttagcagaaaaagatatttgggaagcggaagattttattgatgaaacttgggtaacttaccccgtacctgacgatatgttagatctatggcgtaaagtgcttaaatcaaaaggcattaatcctactcgccgtacaacagaacttactattgcaatgattcaacttgttgcgagtcgtcgtggtattgcgactatcccttattgggctgcgctgccttatttggaaaagggttatgtcgtggcaagaaaagtcacaaaagaaggtttatatagcaatctatatgcggcgattcgcaaagaagatgaatccctttcttatttagaagatttttatcaaacagtcaaatctcaaagtttctcaactttacccggactttctgttttaaattta

SEQ ID NO: 4680 - protein, 309 aa, Haemophilus influenzae
  Name: NTH2606
MKPTFLEFRHLKTLLALKETGSVSLAAKHVYLTQSALSHQIKLIEEQFGLPLFERKSNPLRFTSAGERLIRLANEVMPKVIDAERDLARVKHGDAGQLRIAVECHTCFDWLMPAMDEFRQHWGLVELDIVSGFHTDPVGLLLSHRADWAIVSEIEHNDDVIFKPLFSYEMVGICSKNHSLAEKDIWEAEDFIDETWVTYPVPDDMLDLWRKVLKSKGINPTRRTTELTIAMIQLVASRRGIATIPYWAALPYLEKGYVVARKVTKEGLYSNLYAAIRKEDESLSYLEDFYQTVKSQSFSTLPGLSVLNL

SEQ ID NO: 4681 - DNA, 189 bp, Haemophilus influenzae
  Name: NTH2607
atgatgaaaaaatttccaaattttaaaccgcattctgacacggaaactgaagaattaattagcttactatttagaaaactcgatattgatgaactaatctttctgctacgtgttttacaacgtgatatccgtgcaaaatatacactcacaaaaataattaaaaaaaatatcaatttaaagttagattca

SEQ ID NO: 4682 - protein, 63 aa, Haemophilus influenzae
  Name: NTH2607
MMKKFPNFKPHSDTETEELISLLFRKLDIDELIFLLRVLQRDIRAKYTLTKIIKKNINLKLDS

SEQ ID NO: 4683 - DNA, 150 bp, Haemophilus influenzae
  Name: NTH2608
atgaaaatacaagataacgtcggctattacttcacaattcaagatcttcaagatcgtttacgtgtaagtcgttcaactattctgcgattaattgaatcgaaaaaattaacatctatcaaatttggacgacaagttcgtattcctgaatct

SEQ ID NO: 4684 - protein, 50 aa, Haemophilus influenzae
  Name: NTH2608
MKIQDNVGYYFTIQDLQDRLRVSRSTILRLIESKKLTSIKFGRQVRIPES

SEQ ID NO: 4685 - DNA, 888 bp, Haemophilus influenzae
  Name: NTH2609
gtgcagttataccctaaagatgttgcattaactcataagtatattcagtttaatgatctgtttattaaatttatggtgttagatctagatcgggaaaattctgcaatggattgggaattgttaggacttccaagtcccaatatagtggtacaaaatagattaaacggtcgatgtcattatatctatgcgttggaggtacctatttgtaacacaaagaatgctcgatttaagccaataagttattttaaaaagatacaacgagcttatattgataagttaggagcagatcaacactatgttggtgtattcactaaaaatccaaactcaaatttttggagaacatttgtatttaatgtacctaaatatactctggattatttagctgattttgttgatttatcaaataaacctgtattttatctaaatgataatgaagatattgaaggtcggaattgttctttatttaatcagatcaaaaaaattggttatcgtgaggttctgaagtttaaatgttcaggtaaacaattagaacaatttaatcagtatttattatcttcattagagttattaaatcagaatcataatccaccattaccatacagggagttaaaaggaattgctagaagttcatctcgttggatttgggaaagattttctgaatcatcgtttcaacaaattcagtcaaatcgttctcgaaaacgatgggaaaagcaacaaattatcaagaaagagttgtttaatcaatttggagctaataaacctaatatgtcgttaaagcaaatagcagaacaatttagtattagtgtaagctcattgaatcgttggtcagaagaattcggatgggtgaaatcacaaaatgacttaaaaagtaaatatgagaaaatagta

SEQ ID NO: 4686 - protein, 296 aa, Haemophilus influenzae
  Name: NTH2609
VQLYPKDVALTHKYIQFNDLFIKFMVLDLDRENSAMDWELLGLPSPNIVVQNRLNGRCHYIYALEVPICNTKNARFKPISYFKKIQRAYIDKLGADQHYVGVFTKNPNSNFWRTFVFNVPKYTLDYLADFVDLSNKPVFYLNDNEDIEGRNCSLFNQIKKIGYREVLKFKCSGKQLEQFNQYLLSSLELLNQNHNPPLPYRELKGIARSSSRWIWERFSESSFQQIQSNRSRKRWEKQQIIKKELFNQFGANKPNMSLKQIAEQFSISVSSLNRWSEEFGWVKSQNDLKSKYEKIV

SEQ ID NO: 4687 - DNA, 267 bp, Haemophilus influenzae
  Name: NTH2610
atgcaacacaaattgattgcctttattggtggcggcaatatggcacaagctattattcttggattattgaaacaaggttatcctgccgagcaaattattgtgaatgatccaaatgaagaaaaaagagcattttttgccaatcttggcgtggcaacttcagaaaataatgtggaaagtgcaatcaaagctgaggttgtgttgcttgcggtaaaacctcaaatgatggctgatgtttgtttgccactaagtgcggtggatttttcccga

SEQ ID NO: 4688 - protein, 89 aa, Haemophilus influenzae
  Name: NTH2610
MQHKLIAFIGGGNMAQAIILGLLKQGYPAEQIIVNDPNEEKRAFFANLGVATSENNVESAIKAEVVLLAVKPQMMADVCLPLSAVDFSR

SEQ ID NO: 4689 - DNA, 567 bp, Haemophilus influenzae
  Name: NTH2612
gtgcggtggatttttcccgataaattgttaatttccattgctgcaggtatttcaactgaacgcttgaacgcattaattccaagcgtaaaatcgatagtacgcgtcatgccaaatacacccgcattagtgggggaaggcatggcggggttatttgcaccgaaaaatacgagtgaaaattaccgcacttttgcacaagatttattgggagcagtgggaagaacggtttgggtggatgatgaaactcaaatgcacgcagtcaccgctgcttcaggaagtagcccagcctatttctttttaatgctggaagcgatgcagcaagccttaatcaaaatgaatatagatgaaaaaacagcacgtgaattagtccagcaatctatgcttggtgcagcaaaaatggtgaccgaaaatccgcaaattgcactttcaactttgcgtgaaaatgttacctcgaaaggtggcactactgcggcagcgttagcagtatttgacgcacaacattttaatcaaacaatagagcaagctatgcaggcttgtttgtctcgttcacaagaaatggaaactttattc

SEQ ID NO: 4690 - protein, 189 aa, Haemophilus influenzae
  Name: NTH2612
VRWIFPDKLLISIAAGISTERLNALIPSVKSIVRVMPNTPALVGEGMAGLFAPKNTSENYRTFAQDLLGAVGRTVWVDDETQMHAVTAASGSSPAYFFLMLEAMQQALIKMNIDEKTARELVQQSMLGAAKMVTENPQIALSTLRENVTSKGGTTAAALAVFDAQHFNQTIEQAMQACLSRSQEMETLF

SEQ ID NO: 4691 - DNA, 276 bp, Haemophilus influenzae
  Name: NTH2613
atgcaagttcgtcctttttattggctcgcactgagctttctaggttactactgcgcttatggcgtatttttgcctttctttcccgcatggttaaaatcacaacaatatggggaggaaatgattggtttggttatcggcagtgcttatattttccgatttgcgggcggattatttttttcatcgctgattaaaaaagccaatcatattattattctccttacgcctattggcgttagcatcggcaattattatggcggctatgagtttagttgcgca

SEQ ID NO: 4692 - protein, 92 aa, Haemophilus influenzae
  Name: NTH2613
MQVRPFYWLALSFLGYYCAYGVFLPFFPAWLKSQQYGEEMIGLVIGSAYIFRFAGGLFFSSLIKKANHIIILLTPIGVSIGNYYGGYEFSCA

SEQ ID NO: 4693 - DNA, 216 bp, Haemophilus influenzae
  Name: NTH2615
atgagtttagttgcgcataatttttggttgttgtttattgctatcggtttgtatgcttctgtgaattcagcaggaatgccgattggggattcgttggcatccacttggcaacgccaaatcggcttggattacggcaaactccgtttgattggttctgctgcttttattcttggtgtagtagtatttggtggcatgattggctgggttggcgagcca

SEQ ID NO: 4694 - protein, 72 aa, Haemophilus influenzae
  Name: NTH2615
MSLVAHNFWLLFIAIGLYASVNSAGMPIGDSLASTWQRQIGLDYGKLRLIGSAAFILGVVVFGGMIGWVGEP

SEQ ID NO: 4695 - DNA, 549 bp, Haemophilus influenzae
  Name: NTH2616
atgacattacgagtcatggttgcagtagggctgattcaaggctctcatgcggcttattatgtttacagcacgatttattggacaagtattgggatctccgtttctcaaactagcttactttggggcattggcgtattagcggaaattgtattatttttcttctctcgtcgtttatttcaaaatatttctatcagcgtactgctttatatttctgcgcttgcgtgcatcggacgctgggctgtaataggatatattgacgatttctggttgatattcttattgcaacttatacacagtttaacctatgccgtttgccattatgcgattgttcgctatatcaccacgcaaccgcaaagccatattgcgaagttacaaggtttgtataatggtttatccaatggtgtgctcattgctattttcactgcgattgctggcatgatttatccaacgtcgccagcgatgacatttgtatttatgagtatcattgcagctgcagcattttttgtgattccacgcaagttaaatgcctttttgattgttcagcataaa

SEQ ID NO: 4696 - protein, 183 aa, Haemophilus influenzae
  Name: NTH2616
MTLRVMVAVGLIQGSHAAYYVYSTIYWTSIGISVSQTSLLWGIGVLAEIVLFFFSRRLFQNISISVLLYISALACIGRWAVIGYIDDFWLIFLLQLIHSLTYAVCHYAIVRYITTQPQSHIAKLQGLYNGLSNGVLIAIFTAIAGMIYPTSPAMTFVFMSIIAAAAFFVIPRKLNAFLIVQHK

SEQ ID NO: 4697 - DNA, 891 bp, Haemophilus influenzae
  Name: NTH2617
atgaaaaatcttgcgctcattgatttgtttcttaacgaatattggattgaaaaagggctttcagaaaatactgttcaatcttatcgtttggatttaaccgcactttgtgattggttggataaaaacgacttgtctttggaaactttagatgctgttgatttgcaaggttttctaggagagcgtttggagaaaggttacaaagccacgagcaccgcacgaatgttaagtgcaatgcgtaaacttttccaatatttatatcgggaaaaatatcgagtggatgatccaagtgcggtgctaagttcgcctaaattacccagtcgcttgccaaaatatttaaccgagcaacaagtgtcagatttgctcaatacgccagatgttaaagtccctttggaattgcgtgataaagcaatgttagagttgctttatgcgacggggcttcgtgtaacagagttagtttcgcttacgattgaaaacatgagcgtgcaacaaggcgtggtgcgagtgattggtaaagggaacaaggaacgtattgtgccaatgggggaagaagctgcttattgggttcgtcaatttatgctttatggtcgtcctgtgctattaaatgggcagaagtctgatgttgtgtttccaagtcagcgcgcacagcaaatgactcgtcaaactttctggcatcgtgtaaaacattatgccattctcgcggatattgatgctgatgcactttcccctcacgttcttcgccatgcttttgccacccatttagtaaatcacggtgcggatttacgcgtggtgcaaatgttgttgggtcatacagatttatctacaacacagatttatactcacgtggcaaaagaaagattgaaacgattgcatgaaagatttcatcctagagga

SEQ ID NO: 4698 - protein, 297 aa, Haemophilus influenzae
  Name: NTH2617
MKNLALIDLFLNEYWIEKGLSENTVQSYRLDLTALCDWLDKNDLSLETLDAVDLQGFLGERLEKGYKATSTARMLSAMRKLFQYLYREKYRVDDPSAVLSSPKLPSRLPKYLTEQQVSDLLNTPDVKVPLELRDKAMLELLYATGLRVTELVSLTIENMSVQQGVVRVIGKGNKERIVPMGEEAAYWVRQFMLYGRPVLLNGQKSDVVFPSQRAQQMTRQTFWHRVKHYAILADIDADALSPHVLRHAFATHLVNHGADLRVVQMLLGHTDLSTTQIYTHVAKERLKRLHERFHPRG

SEQ ID NO: 4699 - DNA, 345 bp, Haemophilus influenzae
  Name: NTH2618
ttgctatcttgcgaagaatttcgacatttgttctatcgaaaagtaattttggattctaaaatgaaaaaaatcacgcttttttttaccgcacttttatgcttattttcaacttctgttttagccgaacctaattcaatacctaaacaatgtgaacaactatttaaagaaacagagaatttgattgcccaagcagaaaaacaacctggaacccacattcaagtaaataaaatcaaaagtaaactaaaccaaagcaaacaacaaattcttcaaatggaattagcgactcagttaaaaagttgtgaagtgggtttagcaaaattaagtaacttgaaaagttatagtgag

SEQ ID NO: 4700 - protein, 115 aa, Haemophilus influenzae
  Name: NTH2618
LLSCEEFRHLFYRKVILDSKMKKITLFFTALLCLFSTSVLAEPNSIPKQCEQLFKETENLIAQAEKQPGTHIQVNKIKSKLNQSKQQILQMELATQLKSCEVGLAKLSNLKSYSE

SEQ ID NO: 4701 - DNA, 1005 bp, Haemophilus influenzae
  Name: NTH2619
atgattgaagcagatagaattattagcgggcaagctaaggttgatgaagatgttatcgaccgtgctattcgtcctaaactattagcagattatgttgggcagccgcaagtacgcgagcagatggatattttcatcaaggcagccaaactacgtcaagatgccttagatcatttattgatttttggccctccaggtttgggaaaaacaacgcttgctaatattgtggcaaatgaaatgggcgtgaatattcgtacgacatcagggcctgtattagaaaaagcgggagatttagccgcaatgctaaccaatcttgaaccgcatgatgtgttatttattgatgaaatccatcgactttcccctgctattgaagaagtcctttatccagcaatggaagactatcagttggatattatgattggcgaaggacccgctgctcgttccattaaattagatttgcccccttttactttggttggtgcgaccactagagcgggttctttgacttctccattgcgtgatcgttttggtattgtgcaacgtttggaattctattctgtagaagatttaacatctatcgttgcaagaagtgcggactgtttaaatcttgaattagaacaacaagccgcttttgaggtggctcgtcgttcacgaggcacgcctcgaattgcaaaccgtttattacgacgtgtgcgtgattatgcagatgtacgtaatggcggtattatttctataaatgtggcaaaacaagcgctttcaatgctagatgtagacgatgctggatttgattatttagatagaaagttgttgtctgcagttattgagcgttttgatggtggccctgtggggctagataatcttgctgctgcaattggcgaagaacgtgataccattgaagatgttttagagccttatttgattcaacaggggtttctacaaagaacgccgcgtggccgtattgcaacatcgcaaacttatcgtcattttggtttgcagaaattatcagac

SEQ ID NO: 4702 - protein, 335 aa, Haemophilus influenzae
  Name: NTH2619
MIEADRIISGQAKVDEDVIDRAIRPKLLADYVGQPQVREQMDIFIKAAKLRQDALDHLLIFGPPGLGKTTLANIVANEMGVNIRTTSGPVLEKAGDLAAMLTNLEPHDVLFIDEIHRLSPAIEEVLYPAMEDYQLDIMIGEGPAARSIKLDLPPFTLVGATTRAGSLTSPLRDRFGIVQRLEFYSVEDLTSIVARSADCLNLELEQQAAFEVARRSRGTPRIANRLLRRVRDYADVRNGGIISINVAKQALSMLDVDDAGFDYLDRKLLSAVIERFDGGPVGLDNLAAAIGEERDTIEDVLEPYLIQQGFLQRTPRGRIATSQTYRHFGLQKLSD

SEQ ID NO: 4703 - DNA, 612 bp, Haemophilus influenzae
  Name: NTH2620
atgatcggtcgcttacaaggcattcttttagaaaaacaacctccagaaattttactcaatgtgcaaggcgtaggctatgaattgcttttgccgatgacgagtttctatgatttaccagaaattggacaagaaactactttattcacccatcttgttgttcgggaagatgctcacttactctttggatttgcccagaaaacagaccgcactttatttcgtgaattaattaaaacaaatggggttgggcctaaattagccttagcgattttatccgccatgtcggtcgaacaatttgcttacgcaatagagagagaagaactttctaaactcactaaaattccaggtgttggcaaaaaaacagctgaacgtttgttagttgaactcaaaggtaaatttaaaggcataaaacaaagtgatttctttgtagaaagtacgcatattccattatccccatctattgaatcccactcggaaagttcatctgatgaagcaatttcagccttgattgctttaggttataaacctgcagaagcagaaaaaatggtaaaacgcgttgctaaacctgaattaaccagtgaacaagttattcgtgaagcattaaaagccgcattg

SEQ ID NO: 4704 - protein, 204 aa, Haemophilus influenzae
  Name: NTH2620
MIGRLQGILLEKQPPEILLNVQGVGYELLLPMTSFYDLPEIGQETTLFTHLVVREDAHLLFGFAQKTDRTLFRELIKTNGVGPKLALAILSAMSVEQFAYAIEREELSKLTKIPGVGKKTAERLLVELKGKFKGIKQSDFFVESTHIPLSPSIESHSESSSDEAISALIALGYKPAEAEKMVKRVAKPELTSEQVIREALKAAL

SEQ ID NO: 4705 - DNA, 570 bp, Haemophilus influenzae
  Name: NTH2621
atgagcattattttaggtattgaccccggctctcgcgtaacgggttacggtgtgattcgccaaacagggagacatttagaatatctcggtagtggcgcaattcgtactcaagttgaagatttacccacccgtttgaaacgcatttatgctggagtaactgaaatcatcacgcaatttcaacctaatatgtttgcgattgagcaagtgtttatggcgaagaatgcggattcagcattgaaacttgggcaggctcgcggcacggcgattgttgcagcggtaaataatgatttacctgtttttgaatatgccgcacgtttagtaaaacaaacggttgtgggcattggttctgctgataaagtacaagtgcaagaaatggtgactcgtattttgaagttatcagataaacctcaagccgatgccgcggatgcgttggctattgcgattacacacgctcattctattcaacattctttacatattgccaattctgtgaaaatgacagaaacgcaagaaaaaatgaccgcacttttaaagaccagatatagccgaggacgctttagattaaaaatt

SEQ ID NO: 4706 - protein, 190 aa, Haemophilus influenzae
  Name: NTH2621
MSIILGIDPGSRVTGYGVIRQTGRHLEYLGSGAIRTQVEDLPTRLKRIYAGVTEIITQFQPNMFAIEQVFMAKNADSALKLGQARGTAIVAAVNNDLPVFEYAARLVKQTVVGIGSADKVQVQEMVTRILKLSDKPQADAADALAIAITHAHSIQHSLHIANSVKMTETQEKMTALLKTRYSRGRFRLKI

SEQ ID NO: 4707 - DNA, 612 bp, Haemophilus influenzae
  Name: NTH2622
gtgagtgctaacccgcgtttacgtgcagcagtagataaagcacttagcaacaatatgacgcgcgatactatcaaccgtgctattgatcgtggcgtaggtggtggcgatgataccaatatggaaaccaaaatctatgaaggttatggcccaggcggtacagcggttatggtggaatgtttaagtgataatgcaaaccgtacgatctcacaagtacgcccaagttttactaaatgtggtggtaacttgggaacagaaggttctgtgggttatttatttagcaaaaaaggtttaatcttaatcgcagaagcggatgaagatgccttaactgaagcggcaatcgaagcgggtgctgatgatattcaaccacaagatgatggttcatttgaaatctatactgcttgggaagatttaggttcagtgcgcgatggcattgaagcagctggttttaaagtacaagaagctgaagtaacgatgattccatcaacaaccgtcgatcttgatattgaaactgcaccaaaattacttcgtttaattgatatgttggaagattgtgatgacgtacaaaacgtatatcacaacggagaaatctgtgacgaagtggcatctcaactt

SEQ ID NO: 4708 - protein, 204 aa, Haemophilus influenzae
  Name: NTH2622
VSANPRLRAAVDKALSNNMTRDTINRAIDRGVGGGDDTNMETKIYEGYGPGGTAVMVECLSDNANRTISQVRPSFTKCGGNLGTEGSVGYLFSKKGLILIAEADEDALTEAAIEAGADDIQPQDDGSFEIYTAWEDLGSVRDGIEAAGFKVQEAEVTMIPSTTVDLDIETAPKLLRLIDMLEDCDDVQNVYHNGEICDEVASQL

SEQ ID NO: 4709 - DNA, 468 bp, Haemophilus influenzae
  n 421: n is any nucleotide
  Name: NTH2623
gtgcggtcagatttgaccgcatttttaatgatgcaatacaaaaataatcaatctgttcttgttgtaatttacgctaaaaatacaaaccgagttttaatgctccaacgccaagatgatcctgatttttggcagtctgttactggcaccattgaaagtggtgagacaccaaaaaaaacagcaattcgtgagctatgggaagaagtgcggttagaaatttcggaaaattccaccgcgctttttgattgcaatgagagcatagaatttgaaatttttccacatttccgctataaatacgcaccgaatattactcactgcaaagaacatttgtttttgtgtgaggcggaaaaagaatttattccagtattgagtgagcatttggcatatcaatgggtttcccctgaacaagcaatccaaatgacanaatcttccaataatgcggaagcaattagaaaatatattcttaaagat

SEQ ID NO: 4710 - protein, 156 aa, Haemophilus influenzae
  Xaa 141: Xaa is any amino acid
  Name: NTH2623
VRSDLTAFLMMQYKNNQSVLVVIYAKNTNRVLMLQRQDDPDFWQSVTGTIESGETPKKTAIRELWEEVRLEISENSTALFDCNESIEFEIFPHFRYKYAPNITHCKEHLFLCEAEKEFIPVLSEHLAYQWVSPEQAIQMTXSSNNAEAIRKYILKD

SEQ ID NO: 4711 - DNA, 1764 bp, Haemophilus influenzae
  Name: NTH2625
atgatgcgtacacattattgcggagcattaaaccgtaacaatatcggacaagacgtaacattaagcggttgggttcatcgccgtcgtgatttaggtggcttgatttttattgatatgcgcgatcgtgatggcattgtgcaagtttgttttgatcctaaatatcaagatgcattgacagcggctgctgggttacgtaatgaattctgtattcaaattaaaggtgaagtgattgcgcgtcctgaaaaccaaatcaataaaaatatggctacgggcgaagtggaagtgttagcgaaagaattacgcatctacaatgcttctgatgttttaccattagacttcaaccaaaataacaccgaagaacaacgtttaaaataccgttatttagatttacgtcgtcctgaaatggcgcagcgtttgaaaacccgtgcaaaaatcaccagctttgtgcgtcgctttatggatgataatggtttccttgatattgaaactccaatgcttaccaaagcaacgccagaaggcgcgcgcgactatttagtgccaagccgtgtgcataaaggcaaattctatgcattgccgcaatcaccacagcttttcaaacagcttttaatgatgtctggttttgaccgctattatcaaatcgtaaaatgtttccgtgatgaagatttgcgagcagaccgtcagcctgagtttactcaaatcgatgtggaaacttctttcctaactgcgccagaagtccgcgaaattatggaacgtatggtgcacgacttatggcttgataccattggtgtagatttaggtaagttcccagtgatgacttggcaagaagcaatgcgtcgttttggttcggataagccagatttgcgtaatccattagaaatggtagatgtagcagatattgtcaaagatgttgaatttaaagtatttaatgagccagcaaacaatccaaatggccgtgttgcagtcattcgagtaccaaatggtgcagaaattactcgtaaacaaattgatgaatatacacaatttgtaggcatctacggtgcaaaaggtttggcttgggcaaaagtaaacgatattaatgctggtcttgaaggcgtgcaaagtccgattgcgaaattcttaaatgaagaggtatggaaagcgttagcagaacgtgtgaatgcacaaactggcgatattttattcttcggtgcagacaaatggcaaacgaccactgatgcaatgggtgcgttacgtttgaaattaggttgtgatcttggcttaactcgtttagacgaatggcaaccgctttgggtcattgatttcccaatgtttgaacgtgatgaagaaggtaatcttgcagcaatgcaccatccattcacttcaccaaaagatttcagcccagagcaattagaggctgatccaacaagtgcggtagccaatgcttacgatatggtcatcaacggctacgaagtgggtggtggttctgtgcgtatttttgatccgaaaatgcaacaaactgtgttccgtattcttggtattgacgaagaacaacaacgcgagaaattcggtttcttattagatgcattaaaattcggtactccaccgcatgctggtttagcattcggtttagaccgtttaaccatgcttttaactggaacagaaaacattcgtgatgtaattgccttcccgaaaaccacggcagcagcgtgcttaatgacggaagccccgagttttgtaaatccgcaagcattggaagagttggcaatttctgtcgttaaagcagaa

SEQ ID NO: 4712 - protein, 588 aa, Haemophilus influenzae
  Name: NTH2625
MMRTHYCGALNRNNIGQDVTLSGWVHRRRDLGGLIFIDMRDRDGIVQVCFDPKYQDALTAAAGLRNEFCIQIKGEVIARPENQINKNMATGEVEVLAKELRIYNASDVLPLDFNQNNTEEQRLKYRYLDLRRPEMAQRLKTRAKITSFVRRFMDDNGFLDIETPMLTKATPEGARDYLVPSRVHKGKFYALPQSPQLFKQLLMMSGFDRYYQIVKCFRDEDLRADRQPEFTQIDVETSFLTAPEVREIMERMVHDLWLDTIGVDLGKFPVMTWQEAMRRFGSDKPDLRNPLEMVDVADIVKDVEFKVFNEPANNPNGRVAVIRVPNGAEITRKQIDEYTQFVGIYGAKGLAWAKVNDINAGLEGVQSPIAKFLNEEVWKALAERVNAQTGDILFFGADKWQTTTDAMGALRLKLGCDLGLTRLDEWQPLWVIDFPMFERDEEGNLAAMHHPFTSPKDFSPEQLEADPTSAVANAYDMVINGYEVGGGSVRIFDPKMQQTVFRILGIDEEQQREKFGFLLDALKFGTPPHAGLAFGLDRLTMLLTGTENIRDVIAFPKTTAAACLMTEAPSFVNPQALEELAISVVKAE

SEQ ID NO: 4713 - DNA, 609 bp, Haemophilus influenzae
  Name: NTH2626
atgttcaaaataaaggcttttttgtgccatatcatcagattttttgttatattatgcggcttgttgagattaaattacgttaaggataaccacatgttatttatcaatattacttttgcctgtattttagcgatccgtttttacagtctgtctatttcaattcgtcatgaaaaagcactcattgcaaagggtgcaatacagtatggtaaacgcaattccacactgttgtccattgcccatgttgcattttattttgcggcgatcattgaggctaataagcaaaacctgtcatttaatagcacttcacaaatagggttggcgattttaatttttgctattgcaatgctattttatgtgatttatgagctaaaagagatttggacagtaaaaatttatattttaccagaacatcaaattaatcgctctttcttgtttaaatacgtacgtcacccaaattatttcttaaacattattcccgaattaattggtttatcgcttttctgtcaggctaaatataccgcattggttggactacctatttatttgcttatcttagccgtgcgtattaaacaagaagagagtgccatgtcgcatttatttcctaaatca

SEQ ID NO: 4714 - protein, 203 aa, Haemophilus influenzae
  Name: NTH2626
MFKIKAFLCHIIRFFVILCGLLRLNYVKDNHMLFINITFACILAIRFYSLSISIRHEKALIAKGAIQYGKRNSTLLSIAHVAFYFAAIIEANKQNLSFNSTSQIGLAILIFAIAMLFYVIYELKEIWTVKIYILPEHQINRSFLFKYVRHPNYFLNIIPELIGLSLFCQAKYTALVGLPIYLLILAVRIKQEESAMSHLFPKS

SEQ ID NO: 4715 - DNA, 723 bp, Haemophilus influenzae
  Name: NTH2627
atggtaaaagatactctattttctacccccattgctaaattgggggatttcatctttgacgagaacgttgctgaagtctttccagatatgattcaacgttccgtgcctggctattccaacattattacggcaatcggtatgctggcagaacgtttcgtcacggctgatagtaacgtttatgatctaggttgctcacgaggagctgccacactttctgcacgtcgaaatattcatcaacccaacgtaaaaattattggtatcgataattctcaaccgatggttgaacgttgtcgccaacatattgcggcatatcatagtgaggtacctgtagaaattctctgtgacgatattcgccacgttgaaattaaaaatgcctcaatggtcattctcaacttcaccttgcaatttttaccgcctgaagatcgcgtggcattgctcacgaagatttatgaaggattaaatccaaatggcgtattagtactttctgaaaaattccgttttgaagatactaaaattgatcatttactcattgacttgcaccaccaattcaagcgagccaatggttatagcgaattagaagtgagccaaaaacgcaccgcacttgaaaatgtgatgcgtacagattctattgagacacacaaagtgcggttaaaaaacgtaggattttcacaagtagaactttggttccaatgctttaattttggctcgatgattgcggttaaa

SEQ ID NO: 4716 - protein, 241 aa, Haemophilus influenzae
  Name: NTH2627
MVKDTLFSTPIAKLGDFIFDENVAEVFPDMIQRSVPGYSNIITAIGMLAERFVTADSNVYDLGCSRGAATLSARRNIHQPNVKIIGIDNSQPMVERCRQHIAAYHSEVPVEILCDDIRHVEIKNASMVILNFTLQFLPPEDRVALLTKIYEGLNPNGVLVLSEKFRFEDTKIDHLLIDLHHQFKRANGYSELEVSQKRTALENVMRTDSIETHKVRLKNVGFSQVELWFQCFNFGSMIAVK

SEQ ID NO: 4717 - DNA, 234 bp, Haemophilus influenzae
  Name: NTH2629
atgcttactaaagtgtttcaaagtggtaacagccaagctgttcggatcccgatggactttcgttttgacgtcgataccgtagaaattttccgaaaggaaaatggggatgtggtattacgcccagtttctaaaaaaacagatgattttcttgcgttatttgaaggatttgatgagacctttattcaagcacttgaagcgcgtgatgatttaccgcctcaggagcgagaaaattta

SEQ ID NO: 4718 - protein, 78 aa, Haemophilus influenzae
  Name: NTH2629
MLTKVFQSGNSQAVRIPMDFRFDVDTVEIFRKENGDVVLRPVSKKTDDFLALFEGFDETFIQALEARDDLPPQERENL

SEQ ID NO: 4719 - DNA, 402 bp, Haemophilus influenzae
  Name: NTH2630
atgatttatatgttagacaccaatatcattatttatttaatgaaaaatcgccccaaaattattgccgaacgagtatcacaattattgcctaatgatcgcttagttatgagctttattacttatgctgaacttattaaaggcgcctttggtagtcaaaattatgagcaatcaatacgagcaatagaattacttactgaacgagtgaatgtactatatcccaatgaacaaatctgtttacattatggcaaatgggcaaatacactcaaaaaacaagggcgacctatcggaaataatgatctatggatcgcttgtcacgcattgagtttaaatgccgttcttattacacataatgtaaaagaatttcagcgaattacagatcttcagtggcaagattggacaaaa

SEQ ID NO: 4720 - protein, 134 aa, Haemophilus influenzae
  Name: NTH2630
MIYMLDTNIIIYLMKNRPKIIAERVSQLLPNDRLVMSFITYAELIKGAFGSQNYEQSIRAIELLTERVNVLYPNEQICLHYGKWANTLKKQGRPIGNNDLWIACHALSLNAVLITHNVKEFQRITDLQWQDWTK

SEQ ID NO: 4721 - DNA, 405 bp, Haemophilus influenzae
  Name: NTH2631
atgcaaattttacacactatgttacgcgtgggcgatttagatcgttcaatcaaattttatcaagatgttttaggtatgcgtttattacgcaccagtgaaaatccagaatacaaatatacgctggcttttttaggttacgaagatggcgaaagtgcggcagaaattgaattaacatacaactggggcgtagataaatatgaacatggcacagcatatggacatatcgctatcggcgtagatgatatttatgccacttgtgaagccgttcgcgcgagcggtggtaacgttactcgcgaagcagggccagtgaaaggtggatcaaccgtcattgcttttgttgaagatccagatggttataaaattgaatttatcgaaaacaaaagtactaaatctggtttaggcaac

SEQ ID NO: 4722 - protein, 135 aa, Haemophilus influenzae
  Name: NTH2631
MQILHTMLRVGDLDRSIKFYQDVLGMRLLRTSENPEYKYTLAFLGYEDGESAAEIELTYNWGVDKYEHGTAYGHIAIGVDDIYATCEAVRASGGNVTREAGPVKGGSTVIAFVEDPDGYKIEFIENKSTKSGLGN

SEQ ID NO: 4723 - DNA, 687 bp, Haemophilus influenzae
  Name: NTH2632
atgtccgattctcaagaaatcccttatcacaaccaattaaaaaatcgctttcgtggctatttccccgtcattattgatgttgaaactgcaggttttgatgcaaaaaaagatgcgttactcgaactagccgccatcacattaaaaatggatgaaaacggttatttgcatcctgatcagaaatgccattttcatatcaagccttttgaaggcgcaaatattaatccagaatccttgaaatttaatggtattgatattcacaatccactacgtggcgcggtgtctgaacttgatgcaatcacgggattatttcaaatggtgcgtcgaggacaaaaagatgcagattgccaacgttctatcattgtggcgcacaatgccacttttgaccaaagttttgtgatggctgccgctgaacgtactggcgtaaagcgtaatcccttccacccttttggcatgtttgataccgcaagtttagcaggattgatgtttggtcagactgttctcgttaaagcctgtcaagccgcaaaaattccttttgatggtaaacaagcccattcagcgttatatgataccgaacgcacggcgaaattattctgctatatggtcaatcatttaaaagatttaggtggtttcccacatattgcttctgaactagaacaggaaaaaacaactgaaaaagagaccgcactt

SEQ ID NO: 4724 - protein, 229 aa, Haemophilus influenzae
  Name: NTH2632
MSDSQEIPYHNQLKNRFRGYFPVIIDVETAGFDAKKDALLELAAITLKMDENGYLHPDQKCHFHIKPFEGANINPESLKFNGIDIHNPLRGAVSELDAITGLFQMVRRGQKDADCQRSIIVAHNATFDQSFVMAAAERTGVKRNPFHPFGMFDTASLAGLMFGQTVLVKACQAAKIPFDGKQAHSALYDTERTAKLFCYMVNHLKDLGGFPHIASELEQEKTTEKETAL

SEQ ID NO: 4725 - DNA, 1350 bp, Haemophilus influenzae
  Name: NTH2633
atgttatcaaaccctgttgttatctcaatcatcgttttgctggcacttagtttgctacgcatcaacgttattatcgcactggtgattgctgcgcttaccgcaggatttatcggtgatttaggtttaactaaaaccatcgaaacctttacaggcggcttaggtggcggtgctgaagtcgcaatgaactatgcaatacttggagcgttcgccattgctatttctaaatcaggaattactgatttaatcgcttataaaatcatcacaaaaatgaataaaacaccaactgctggcaatttaacttggtttaaatatttcatttttgcggtattggcattgtttgccatctcctctcaaaacttacttccagtgcatattgcttttattccaatcgttgtaccaccactactttcaatctttaaccgtttaaaaattgaccgccgtgcagtagcttgcgtacttacatttggtttaactgctacctatatattattaccagtaggctttggaaaaatctttattgaaagtattttagttaaaaacattaatcaagctggcgcaaccttaggtttacaaacaaatgtagcacaagtttctttagcaatgttgttacctgttattggaatgattttaggcttactcacagccatatttattacctaccgtaaaccacgtgaatacaatatcaatgttgaagaggcaacaactaaagatattgaagctcacattgctaatattaaaccaaaacaaattgttgcaagtttaatcgcgattgtcgcgaccttcgcaacacaattagtcacaagttcaactatcattggcggtttaattggcttaattattttcgtactatgtggcattttcaaactaaaagaaagcaacgatatttttcaacaaggcttgcgcttaatggcaatgattggctttgtaatgattgctgcttcaggttttgcaaatgtgattaatgccaccactggcgtaacagatttagtacaaagcctaagttctggtgttgtgcaaagtaaaggtattgccgcattattaatgcttgtcgttggtttattaattacaatgggtattggctcatcattctctacagtaccgattattacatcaatttacgtaccactctgtttatcttttggtttttctccattagcgacaatttctattgtaggcgtagcagcggctttaggagatgcaggttcgcccgcatcagactcaacattaggcccaacatctggcttgaatatggatggcaaacacgatcacatttgggattctgttgtacctacctttattcactataatattccattattggtattcggctggattgcagcaatgtacctt

SEQ ID NO: 4726 - protein, 450 aa, Haemophilus influenzae
  Name: NTH2633
MLSNPVVISIIVLLALSLLRINVIIALVIAALTAGFIGDLGLTKTIETFTGGLGGGAEVAMNYAILGAFAIAISKSGITDLIAYKIITKMNKTPTAGNLTWFKYFIFAVLALFAISSQNLLPVHIAFIPIVVPPLLSIFNRLKIDRRAVACVLTFGLTATYILLPVGFGKIFIESILVKNINQAGATLGLQTNVAQVSLAMLLPVIGMILGLLTAIFITYRKPREYNINVEEATTKDIEAHIANIKPKQIVASLIAIVATFATQLVTSSTIIGGLIGLIIFVLCGIFKLKESNDIFQQGLRLMAMIGFVMIAASGFANVINATTGVTDLVQSLSSGVVQSKGIAALLMLVVGLLITMGIGSSFSTVPIITSIYVPLCLSFGFSPLATISIVGVAAALGDAGSPASDSTLGPTSGLNMDGKHDHIWDSVVPTFIHYNIPLLVFGWIAAMYL

SEQ ID NO: 4727 - DNA, 582 bp, Haemophilus influenzae
  Name: NTH2634
ttgggggatttttttatgactgttcaacaacttatccaacgcttagatcaaaaagttcaacaactttatcaagctcatttatccaaacgagaagaaaaaatcttcgccaaatttgaccgcactttatttagtgaaaatggacaaaatgtttccttttatctaaaagaaatcaatcaaacgctagatagaataaagacattagagtctaacgattctaatcactataattttctagctgagcgtttactcgcccaatgttccgttctttcggaagctttagttcgcaaaaatactcatctaactgaatcccaaacaacaacgaaacaaaccattcaaaaatctcaacatagcattcataaattaccaccaagagaacgcctagaaaaatattacgaagcacgagaacaattgaataatctttatcgacagcataaagatttagcacaagctgaaaaaaataatgatgagaaaatacgttatgctcaacttgcagaagtttataaaaaacgccagcaaaaatgccaagatgcaatcgatcttttagaagaatatttggtgtttaaagaaagaagtggaaaaccg

SEQ ID NO: 4728 - protein, 194 aa, Haemophilus influenzae
  Name: NTH2634
LGDFFMTVQQLIQRLDQKVQQLYQAHLSKREEKIFAKFDRTLFSENGQNVSFYLKEINQTLDRIKTLESNDSNHYNFLAERLLAQCSVLSEALVRKNTHLTESQTTTKQTIQKSQHSIHKLPPRERLEKYYEAREQLNNLYRQHKDLAQAEKNNDEKIRYAQLAEVYKKRQQKCQDAIDLLEEYLVFKERSGKP

SEQ ID NO: 4729 - DNA, 102 bp, Haemophilus influenzae
  Name: NTH2635
atgcctttcctatttatgaacggaaaggcatttttgttgaatgaatttcagtgctttttattactacaatatatcgcagaaattaaccgcacttttgtcatc

SEQ ID NO: 4730 - protein, 34 aa, Haemophilus influenzae
  Name: NTH2635
MPFLFMNGKAFLLNEFQCFLLLQYIAEINRTFVI

SEQ ID NO: 4731 - DNA, 564 bp, Haemophilus influenzae
  Name: NTH2636
atggctacatatactaccagtgatttcaaaccaggtctaaaatttatgcaagacggcgagccttgtgtcatcgttgaaaatgaatttgtaaaaccaggcaaaggtcaggcattcactcgtactcgtattcgtaaattaatttcaggcaaagtattagacgtaaactttaaatctggcacttcggttgaagcagctgatgttatggatcttaacttaacttattcatacaaagacgatgcattctggtactttatgcacccagaaacatttgaacagtactctgcagatgcaaaagccgtaggcgatgcagaaaaatggttattagaccaagcagattgtatcgtgactttatggaatggcgcaccaattactgttacgccaccaaactttgttgaattagaaatcgtcgatacagacccaggtcttaaaggcgataccgcaggcactggcggtaaacctgcaacattaagcacaggcgcagttgtaaaagtgccgcttttcgtccaaatcggcgaagttatcagagttgatacccgctctggcgaatacgtctctcgcgtaaaa

SEQ ID NO: 4732 - protein, 188 aa, Haemophilus influenzae
  Name: NTH2636
MATYTTSDFKPGLKFMQDGEPCVIVENEFVKPGKGQAFTRTRIRKLISGKVLDVNFKSGTSVEAADVMDLNLTYSYKDDAFWYFMHPETFEQYSADAKAVGDAEKWLLDQADCIVTLWNGAPITVTPPNFVELEIVDTDPGLKGDTAGTGGKPATLSTGAVVKVPLFVQIGEVIRVDTRSGEYVSRVK

SEQ ID NO: 4733 - DNA, 1014 bp, Haemophilus influenzae
  Name: NTH2638
gtgcgtattttaccccaagaacccgtcattagagaagaacaaaattggctcacaattctaaaaaatgccatttcagatcctaaattattactaaaagccttaaatttaccagaagatgattttgagcaatccattgctgcgcggaaacttttttcgctccgcgtgccacaacctttcattgataaaatagaaaaaggtaatccgcaagatccccttttcttgcaagtgatgtgttctgatttagagtttgtgcaagcggagggatttagtacggatcccttagaagaaaaaaatgccaatgcggtgccaaatattcttcataaatatagaaatcgcttgctctttatggcaaaaggcggttgtgcggtgaattgtcgttattgctttcgccgacattttccttacgatgaaaacccaggaaataaaaaaagctggcaactggcgttagattacattgcggcacattctgaaatagaagaagtgattttttcaggtggcgatcctttaatggcgaaagatcacgaattagcgtggttaataaaacatttggaaaatataccgcacttacaacgtttgcgtattcacacccgtttgcctgttgtgattccgcaacggattactgatgaattttgcactttattagcagaaactcgtttgcaaacagttatggtgacacacattaatcacccgaatgaaattgatcaaatttttgctcatgcgatgcaaaaattaaacgccgtgaatgtcacgcttttgaatcaatctgttttgctaaaaggcgtgaatgatgatgcgcaaattctaaaaatattgagcgataaactttttcaaacaggcattttgccttattacttgcatttgctggataaagttcaaggggcgagccattttttgattagcgatattgaagctatgcaaatctataaaaccttgcaatctctgacttctggctatcttgttcctaaacttgcacgagaaattgcgggcgagccaaataagactttatacgcagaa

SEQ ID NO: 4734 - protein, 338 aa, Haemophilus influenzae
  Name: NTH2638
VRILPQEPVIREEQNWLTILKNAISDPKLLLKALNLPEDDFEQSIAARKLFSLRVPQPFIDKIEKGNPQDPLFLQVMCSDLEFVQAEGFSTDPLEEKNANAVPNILHKYRNRLLFMAKGGCAVNCRYCFRRHFPYDENPGNKKSWQLALDYIAAHSEIEEVIFSGGDPLMAKDHELAWLIKHLENIPHLQRLRIHTRLPVVIPQRITDEFCTLLAETRLQTVMVTHINHPNEIDQIFAHAMQKLNAVNVTLLNQSVLLKGVNDDAQILKILSDKLFQTGILPYYLHLLDKVQGASHFLISDIEAMQIYKTLQSLTSGYLVPKLAREIAGEPNKTLYAE

SEQ ID NO: 4735 - DNA, 1293 bp, Haemophilus influenzae
  Name: NTH2640
gtgaattctatggataaaaatcaacaatcatctcaaaatgaattggatttagggcttaatcaagagccaattacaccaaagaaaacaattcagccaagttcgtcaattttaggtaaagcaaaagggttatttgccaaaaaaaatcacgtgcaaactaactttcagcaacgtaaagaacctacttttggcgattcatcaacgcaagaaaatgatcctttaattccgagtgaaaatttgaaaaaagtgcaaaagcctgttcttcaaacttcttccacagaagaaaatatttctgcggttgatgaagaaatcagtgctgaaaataacgcggatgaacccgtcgaaaaggctgaaaaacctattttagctcaaccagaaaaatggaaaatattacaagtattgccagcaaaacatcgccgtttatttatggctatttttgtgttggttattttattgattattttcttcgcattaaaaccaagttctgacaccgttgagtcttttactcaatctaacagcaatgaagttcctgtgcagttccaatcgttagatcaaagtcagccactggaaaccacgattttagataatcctcctgcacaaaatcaaatggctgtagaacaagctaaccaatctgaatttgcaccaaaagcagaggaagcggcgaataatacgacggctcaaaacccattagtagaaaatgcgccaatgcaacaaaatgttgttcaatctccaagtcaaatgccaaatgaaatggctgcggcatctgttatgcctatgcaaccagctcaagcggaacagccaaaagcaactgtgccagttcagccgatgaaaaaagcggtagagccacaagttgcgcataaagatactgtgaaaaaagaagtgaaagtggcggagaatgcacaggctccatcaaaagcaacggaacaaaacgtcgctaaaacagcaggaaacgcaccgattgttgaagccaaacctgttcaagtaaaaaaagaaaagaaagttcaaatcgttgatgcaaaacctgtgagtaaatctgcagcctctcgtctttctgcgaaaacattaactgtgccgaaaggtgtttcgctgatgcaagtcttccgtgataatcaacttaatatttccgatgtaaacgcaatgagcaaagcagcaggggcgggcaatgttttaagtagctttaaatctggcgataaagtaacggtatctgtgaataatcaagggcgagtaaatgaaatgcgtttatccaatggtgcgcgttttgtgcgtcagtctgatggttcttatcaatataaaaaa

SEQ ID NO: 4736 - protein, 431 aa, Haemophilus influenzae
  Name: NTH2640
VNSMDKNQQSSQNELDLGLNQEPITPKKTIQPSSSILGKAKGLFAKKNHVQTNFQQRKEPTFGDSSTQENDPLIPSENLKKVQKPVLQTSSTEENISAVDEEISAENNADEPVEKAEKPILAQPEKWKILQVLPAKHRRLFMAIFVLVILLIIFFALKPSSDTVESFTQSNSNEVPVQFQSLDQSQPLETTILDNPPAQNQMAVEQANQSEFAPKAEEAANNTTAQNPLVENAPMQQNVVQSPSQMPNEMAAASVMPMQPAQAEQPKATVPVQPMKKAVEPQVAHKDTVKKEVKVAENAQAPSKATEQNVAKTAGNAPIVEAKPVQVKKEKKVQIVDAKPVSKSAASRLSAKTLTVPKGVSLMQVFRDNQLNISDVNAMSKAAGAGNVLSSFKSGDKVTVSVNNQGRVNEMRLSNGARFVRQSDGSYQYKK

SEQ ID NO: 4737 - DNA, 402 bp, Haemophilus influenzae
  Name: NTH2641
atgttgaaaaaaacatctcttatttttaccgcacttttactggctggctgtgcgcaaaatgcgaatgtgacaacacctcaaacgcaaaaaatgcaagtagaaaaagtggataaagccttacaaaaaggcgaagctgaccgatatttatgtcaagatgataaagttgttcgtgttgtacacgccacgcataaaaaatacaaaaaaaatttgcattatgttaccgtcacttttcaaggcgtatcagaaaaactaaccttaatgatttctgaacgtggtaaaaattacgccaatattcgttggatgtggcaagagcgtgatgattttagtacgctaaaaacgaatctcggcgaaattttagcaacgcaatgtgtctcacaaacaagtgaacgcttatctggacaa

SEQ ID NO: 4738 - protein, 134 aa, Haemophilus influenzae
  Name: NTH2641
MLKKTSLIFTALLLAGCAQNANVTTPQTQKMQVEKVDKALQKGEADRYLCQDDKVVRVVHATHKKYKKNLHYVTVTFQGVSEKLTLMISERGKNYANIRWMWQERDDFSTLKTNLGEILATQCVSQTSERLSGQ

SEQ ID NO: 4739 - DNA, 708 bp, Haemophilus influenzae
  Name: NTH2642
gtgcaaagcgaacttcaacgtggttttgttttgcatcgtcgcccttatagtgaaacgagcttattggtagatttattcactgaagaaagtgggcgtttaaccgtgattgcaaaaggggcgcgtgcaaagcgttcatcttggaaatcggttttgcaacctttcacacctttattgttgcgttggacgggaaaaagcacattgaaaaccctcactaaagctgaacctgccgcaattacactgcctttacaacaaattgccctttatagtggattttatgtaaatgaattactcactcgtgttattgagtctgaaactccaaatcctgcgctttttcaacattatttaaaatgcttaactggcttggcaacggaaactaacgttgagccaacgttgcgtctttttgaatttcaacttttacaaatgctcggttacggcgtggattttctgcattgtgcggggtctggcgagccagtggatttctcaatgacataccgttatcgtgaggaaaaaggtttcgttgcgtctttagtgaaagataatctcacgttttacggcagagatttgttagcctttgaagccctcgatttttccgatgatgcggtacgtcaagcagcaaaacgcttcactcgtattgcgctgaaaccttatcttggcgataaaccgctaaaaagccgagagttattcactcaaaatattttacttttaaaa

SEQ ID NO: 4740 - protein, 236 aa, Haemophilus influenzae
  Name: NTH2642
VQSELQRGFVLHRRPYSETSLLVDLFTEESGRLTVIAKGARAKRSSWKSVLQPFTPLLLRWTGKSTLKTLTKAEPAAITLPLQQIALYSGFYVNELLTRVIESETPNPALFQHYLKCLTGLATETNVEPTLRLFEFQLLQMLGYGVDFLHCAGSGEPVDFSMTYRYREEKGFVASLVKDNLTFYGRDLLAFEALDFSDDAVRQAAKRFTRIALKPYLGDKPLKSRELFTQNILLLK

SEQ ID NO: 4741 - DNA, 1314 bp, Haemophilus influenzae
  Name: NTH2643
atggttcttctttataccccaaagcaaaaaacaaacaatgttcaaaccattacggctgatattcttgatttagattatcaaggtttaggcgtggcgaaaattaatggtaaaacttggtttattgaaaatgcgcttccgcacgaaaaagtggaatgtcgtattttggaagataaacgccaatatgggcatgctacggcaaaaaaatggcgagtaaaaagttctgaacgtttagaacctaaatgtgctcattttatgcgttgtggtggttgccaaggacagcatattcctattgaaatgcagaggaaagcgaaacaatccgcattgtttaagcggttaagtaaattacagtcagaaccgatttcatttcaacctatgatttgtggcgatgcttgggcgtatcgtcgtcgtgtgcgtttgagtttatggtttaatccaaacacaaaacaaatcgacatgggctttcgtcagaaaaataccaacgatttaatacccgttcaatcttgcgaagtagcagaacctgcaattaattatttactgcctaaattaaccgcacttttagaaaaattttccacaccgaaacagcttgggcatattgaattggtggctgccgataatggcgtcgcaatgttgttacgttacacgaaaaaccttgcggaaattgaccgcactttattgctcaaatttgctgaacaagaaaaattaatgctgtttttacaaagcgacaaaggcattgaacaaatctatggcgatgcgccttattatcaattttctgatggcataaaattacattttgatattcgtgattttattcaagtaaatagtgcattaaatgaacgtatgatcaatacagcgttggattggcttgaattgagccaacaagattgcgtgttagatttattttgcggcatgggaaattttacgcttcctcttgccaaacgcgtgaaaagtgcggtaggaattgaaggcgtttttgaaatggtacaaaaagcggcgcaaaatgccgcaagaaaccaaatcaaaaatattgaatttttccaagccgatcttgaccaatcctttgttgaacaaccttgggctaatcagtcgttcaataaaattttgcttgatcctccacgcagtggcgcagctttcgcgttaaatgctttgtgcgagctgaaagcagagaaaattttatatgtgtcttgtaatcctgcaacattagtgcgtgatgcggaaattttatgtgattttggctacaagattgaaaaaagtgcggtgatagatatgttccctcatacggggcatttggaatcgataaccttattcactacaaaa

SEQ ID NO: 4742 - protein, 438 aa, Haemophilus influenzae
  Name: NTH2643
MVLLYTPKQKTNNVQTITADILDLDYQGLGVAKINGKTWFIENALPHEKVECRILEDKRQYGHATAKKWRVKSSERLEPKCAHFMRCGGCQGQHIPIEMQRKAKQSALFKRLSKLQSEPISFQPMICGDAWAYRRRVRLSLWFNPNTKQIDMGFRQKNTNDLIPVQSCEVAEPAINYLLPKLTALLEKFSTPKQLGHIELVAADNGVAMLLRYTKNLAEIDRTLLLKFAEQEKLMLFLQSDKGIEQIYGDAPYYQFSDGIKLHFDIRDFIQVNSALNERMINTALDWLELSQQDCVLDLFCGMGNFTLPLAKRVKSAVGIEGVFEMVQKAAQNAARNQIKNIEFFQADLDQSFVEQPWANQSFNKILLDPPRSGAAFALNALCELKAEKILYVSCNPATLVRDAEILCDFGYKIEKSAVIDMFPHTGHLESITLFTTK

SEQ ID NO: 4743 - DNA, 1953 bp, Haemophilus influenzae
  Name: NTH2644
atggactggatggaacaagaacaaaagcgtggtattaccattacctctgcggcaacaactgcattctggtctggtatgtcacaacaattcccacaacatcgtatcaatgttatcgatactccgggacacgtggactttactgttgaagtagaacgttctatgcgtgttcttgatggcgcagtaatggtttactgtgcggttggtggtgttcaaccacaatctgaaaccgtatggcgtcaagctaacaagtatgaagttccacgtattgcgttcgtaaataaaatggaccgtactggtgcgaacttcttacgtgttgttgaacaattaaaaacccgcttaggtgctaatgcggttccacttcaacttccaattggtgcagaagaaaacttcactggtgtagttgatttgatcaaaatgaaagcgatcaactggaatgaagcagaccaaggtatgactttcacttatgaagaagtgcctgcaaatatgcaagcagactgtgaagaatggcgtcaaaatcttgttgaagcggcagctgaagcgtcagaagaattaatggaaaaatacttaggtggcgaagacttaactgaagaagaaattaagtcagcattacgtcagcgcgtattagcaaatgaaattattttggtaacctgtggttctgcgttcaaaaacaaaggtgttcaagcaatgcttgacgcagttgttgaatacttaccagcaccaactgatatccctgcaattaaaggtatcaacccagatgaaactgaaggtgagcgtcatgcaagtgatgaagaaccattctcttcattagcatttaaaattgcaactgacccatttgtaggtaacttaacattcttccgtgtatattctggtgttattaattctggagatacagtattgaattctgtacgtcaaaaacgtgaacgttttggtcgtatcgtacagatgcacgctaataaacgtgaagaaattaaagaagttcgtgcaggtgatatcgcagcagctatcggcttaaaagatgtaactactggtgatacattatgtgcaattgaagcaccaatcatccttgagcgtatggaattcccagagccagtaatctctgttgcggtagaaccaaaaactaaagctgaccaagaaaaaatgggcttagcattaggtcgtttagcacaagaagacccttcattccgtgttcacactgatgaagaatctggcgaaaccattatttctggtatgggtgagttgcacttagatatcattgttgatcgtatgaaacgtgagttcaaagtggaagctaatattggtaaaccacaagtatcataccgtgaaactatccgtactcgtgttaatgatgtcgaaggtaaacatgctaaacaatctggtggtcgcggtcaatatggtcatgttgttatcgacttatacccattagatccagaaggccctggttatgaatttgtaaacgaaatcaaaggtggtgtaattcctggtgaatacattccagccgttgataaaggtattcaagaacaacttaaatctggtccattagctggttacccagtagttgatcttggtgtacgtttacacttcggttcataccatgatgtggattcatctgagttagcatttaaacttgctgcgtctttagcatttaaagcagcattctcaaaagcaaacccagtattacttgagccaattatgaaagttgaagttgaaactccacctgaatatgttggtgatgtaattggtgatttaagccgtcgtcgtgctatggttaacggtcaagaagcgaacgagtttgttgttaagatcgatgctgaagttccactttctgagatgttcggttatgcaacagatttacgttcacaaactcaaggtcgtgcatcatactcaatggaaccgttaaaatatgctgaagctccaacaagtgtggcagctgcagtaattgaagcgcgtaaaaaa

SEQ ID NO: 4744 - protein, 651 aa, Haemophilus influenzae
  Name: NTH2644
MDWMEQEQKRGITITSAATTAFWSGMSQQFPQHRINVIDTPGHVDFTVEVERSMRVLDGAVMVYCAVGGVQPQSETVWRQANKYEVPRIAFVNKMDRTGANFLRVVEQLKTRLGANAVPLQLPIGAEENFTGVVDLIKMKAINWNEADQGMTFTYEEVPANMQADCEEWRQNLVEAAAEASEELMEKYLGGEDLTEEEIKSALRQRVLANEIILVTCGSAFKNKGVQAMLDAVVEYLPAPTDIPAIKGINPDETEGERHASDEEPFSSLAFKIATDPFVGNLTFFRVYSGVINSGDTVLNSVRQKRERFGRIVQMHANKREEIKEVRAGDIAAAIGLKDVTTGDTLCAIEAPIILERMEFPEPVISVAVEPKTKADQEKMGLALGRLAQEDPSFRVHTDEESGETIISGMGELHLDIIVDRMKREFKVEANIGKPQVSYRETIRTRVNDVEGKHAKQSGGRGQYGHVVIDLYPLDPEGPGYEFVNEIKGGVIPGEYIPAVDKGIQEQLKSGPLAGYPVVDLGVRLHFGSYHDVDSSELAFKLAASLAFKAAFSKANPVLLEPIMKVEVETPPEYVGDVIGDLSRRRAMVNGQEANEFVVKIDAEVPLSEMFGYATDLRSQTQGRASYSMEPLKYAEAPTSVAAAVIEARKK

SEQ ID NO: 4745 - DNA, 1182 bp, Haemophilus influenzae
  Name: NTH2646
atgtctaaagaaaaatttgaacgtacaaaaccgcacgtaaacgtgggtacaatcggccacgttgaccacggtaaaacaactttaacagcagcaatcacaaccgtattagcaaaacactacggtggtgcagcgcgtgcatttgaccaaattgataacgcgccagaagaaaaagcgcgtggtattaccatcaacacttcacacgttgaatacgatacaccgactcgccactacgcacacgtagactgtccgggacacgccgactatgttaaaaatatgattactggtgcggctcaaatggatggtgctattttagtagtagcagcaacagatggtcctatgccacaaactcgtgaacacatcttattaggtcgccaagtaggtgttccatacatcatcgtattcttaaacaaatgcgacatggtagatgacgaagagttattagaattagtagaaatggaagttcgtgaacttctatctcaatatgacttcccaggtgacgatacaccaatcgtacgtggttcagcattacaagcgttaaacggcgtagcagaatgggaagaaaaaatccttgagttagcaaaccacttagatacttatattccagaaccagaacgtgcgattgaccaaccgttccttcttccaatcgaagatgtgttctcaatctcaggtcgtggtactgtagtaacaggtcgtgtagaacgtggtatcatccgtacaggtgatgaagtagaaatcgtcggtatcaaagatacagcgaaaactactgtaactggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtactatcgaattaccagaaggcgtggaaatggtaatgccaggggataacatcaagatgacagtaagcttaatccacccaatcgcgatggatcaaggcttacgtttcgcaatccgtgaaggtggccgtacagtaggtgcaggcgttgttgcgaaaatcatcaaa

SEQ ID NO: 4746 - protein, 394 aa, Haemophilus influenzae
  Name: NTH2646
MSKEKFERTKPHVNVGTIGHVDHGKTTLTAAITTVLAKHYGGAARAFDQIDNAPEEKARGITINTSHVEYDTPTRHYAHVDCPGHADYVKNMITGAAQMDGAILVVAATDGPMPQTREHILLGRQVGVPYIIVFLNKCDMVDDEELLELVEMEVRELLSQYDFPGDDTPIVRGSALQALNGVAEWEEKILELANHLDTYIPEPERAIDQPFLLPIEDVFSISGRGTVVTGRVERGIIRTGDEVEIVGIKDTAKTTVTGVEMFRKLLDEGRAGENIGALLRGTKREEIERGQVLAKPGSITPHTDFESEVYVLSKDEGGRHTPFFKGYRPQFYFRTTDVTGTIELPEGVEMVMPGDNIKMTVSLIHPIAMDQGLRFAIREGGRTVGAGVVAKIIK

SEQ ID NO: 4747 - DNA, 225 bp, Haemophilus influenzae
  Name: NTH2647
ttgaattcagccaaactatttggaaaattcctcttacctttttggctatgcttatcggtgtatcagttgggcgtattagctactggttttattcttgtcgcgattcaaggaaacagcccttattttccacgttatcaaggggcaacatcggtttcttgtctctatctttggcttgcaatttgtggggtgggttatggcattctaggtggcattttggacgattat

SEQ ID NO: 4748 - protein, 75 aa, Haemophilus influenzae
  Name: NTH2647
LNSAKLFGKFLLPFWLCLSVYQLGVLATGFILVAIQGNSPYFPRYQGATSVSCLYLWLAICGVGYGILGGILDDY

SEQ ID NO: 4749 - DNA, 105 bp, Haemophilus influenzae
  Name: NTH2648
gtggcattttggacgattattagcaaaggtatcgcaggattatcacctgaaaaaggcgtggctgggttcgccaacatcctatttatattgctttattattgggtt

SEQ ID NO: 4750 - protein, 35 aa, Haemophilus influenzae
  Name: NTH2648
VAFWTIISKGIAGLSPEKGVAGFANILFILLYYWV

SEQ ID NO: 4751 - DNA, 735 bp, Haemophilus influenzae
  Name: NTH2649
atgttatgtccactcaaatttcacttacgctattttttccataagaaattacgtcaaacatacagaatttcccacaaaagtttagaatttatctgcctaatcataggcatggcttgcctgacttggtttacgaaaaaatatactccatatgttggaggaagtggtattccacaagtgattgcatcaattaatcttcctcatagtagctataaaaccaaattagttgaattcagccaaactatttggaaaattcctcttacctttttggctatgcttatcggtgtatcagttgggcgtattagctactggttttattcttgtcgcgattcaaggaaacagcccttattttccacgttatcaaggggcaacatcggtttcttgtctctatctttggcttgcaatttgtggggtgggttatggcattctaggtggcattttggacgattattagcaaaggtatcgcaggattatcacctgaaaaaggcgtggctgggttcgccaacatcctatttatattgctttattattgggtttagtgcttgccgcactgttggagtggaaatgacaggcgcgcaactcgttctcatttggctcttgatttccagcattattgcatccataatctcgcgccaatttagtcctaaaccattttaccactttgctgcaggccggtttcgccagcaaatgcaagctcgtcaagccgaagaattacgcagcaaaaccaaacaagagaaa

SEQ ID NO: 4752 - protein, 245 aa, Haemophilus influenzae
  Name: NTH2649
MLCPLKFHLRYFFHKKLRQTYRISHKSLEFICLIIGMACLTWFTKKYTPYVGGSGIPQVIASINLPHSSYKTKLVEFSQTIWKIPLTFLAMLIGVSVGRISYWFYSCRDSRKQPLFSTLSRGNIGFLSLSLACNLWGGLWHSRWHFGRLLAKVSQDYHLKKAWLGSPTSYLYCFIIGFSACRTVGVEMTGAQLVLIWLLISSIIASIISRQFSPKPFYHFAAGRFRQQMQARQAEELRSKTKQEK

SEQ ID NO: 4753 - DNA, 141 bp, Haemophilus influenzae
  Name: NTH2650
atgcgtgctttgaaaattggcgatgaaaataacgacaatggcgtgttgtccaatctaacattggcgcaacagaaaaacggccgcggtaaaagtgcggtagattttgaggcatttttatttctcttgtttggttttgctgcg

SEQ ID NO: 4754 - protein, 47 aa, Haemophilus influenzae
  Name: NTH2650
MRALKIGDENNDNGVLSNLTLAQQKNGRGKSAVDFEAFLFLLFGFAA

SEQ ID NO: 4755 - DNA, 855 bp, Haemophilus influenzae
  Name: NTH2651
atggtcactgcgcctgcgattatccatgccaaatacgatcacttggattttgatttacaagaaaatcccgttgcgttacagctgggaggaagtgatcctgaacaactcaaatattgtgcaaaacttgctgaggaacgaggttatcacgaaattaatcttaatgtaggatgcccttctgatcgcgtacaaaatggaatgtttggcgcctgcttaatggcgaaagcagatttggtggccgactgtgtagaacaaatgcaaagtgcggtcaaaattccagtcacagtgaaaacacgtattggtattgatgaattagacagctatgaatttttatgtgattttattgagaaggttcaaggaaaaggttgccaagagtttattatccatgcacgaaaagcttggctttcagggttaagtcccaaagaaaatcgagaaattccaccattagattatgctcgagtgtatcaactaaaacgtgattttccacatctaactatcgcaattaatggcggcataaaaaccattgaagaaatgaaacaacatttgcaatatgtggacggcgtgatggttgggcgagaggcctatcaaaatccaagtttacttgggcaaattgaccaagccttatttgatcctaacgctgcaattgttaccgctcatgaagcggtacagtcaatgcttccttatattgaacaacaacttaaccaaggaatacaccttaatcatatcgtccgccatatgctaggcgcattccaaaattgcaaaggtgcccgtcaatggcgacgctatttaagtgaaaatgcgtttaaacaaggtgcgggagttgaagtaattgaaaccgccttaagctttgtagaacac

SEQ ID NO: 4756 - protein, 285 aa, Haemophilus influenzae
  Name: NTH2651
MVTAPAIIHAKYDHLDFDLQENPVALQLGGSDPEQLKYCAKLAEERGYHEINLNVGCPSDRVQNGMFGACLMAKADLVADCVEQMQSAVKIPVTVKTRIGIDELDSYEFLCDFIEKVQGKGCQEFIIHARKAWLSGLSPKENREIPPLDYARVYQLKRDFPHLTIAINGGIKTIEEMKQHLQYVDGVMVGREAYQNPSLLGQIDQALFDPNAAIVTAHEAVQSMLPYIEQQLNQGIHLNHIVRHMLGAFQNCKGARQWRRYLSENAFKQGAGVEVIETALSFVEH

SEQ ID NO: 4757 - DNA, 327 bp, Haemophilus influenzae
  Name: NTH2653
ttgttgctgcaaaataatctgaataaaagggataatattatggcaattcaaactgaaaaaccgattgaatgtgtaggttgtaacacatttgatatgaaatcacttttcgataatcgtgattgtagtcaggttattgaatatatttatgacagtgaagaacaagcgcaagaagcactcgcattttttactcagaaagcgcgtgatgtagaaagtgaaccttgtgaaattcaatctgaaattacaaaactggatgatggctatttattaaaggcagatttcactttctgttgccaagctgaattggtgatttttcaaatgcgtattgcg

SEQ ID NO: 4758 - protein, 109 aa, Haemophilus influenzae
  Name: NTH2653
LLLQNNLNKRDNIMAIQTEKPIECVGCNTFDMKSLFDNRDCSQVIEYIYDSEEQAQEALAFFTQKARDVESEPCEIQSEITKLDDGYLLKADFTFCCQAELVIFQMRIA

SEQ ID NO: 4759 - DNA, 1008 bp, Haemophilus influenzae
  Name: NTH2654
ttgattatggcaaaaccaattgtttttagtggcgtgcagccttctggtgaattaactatcggaaattatttgggtgcgttgcgcaactgggtgaaaatgcaagaagattatgaatgtattttttgcgtagttgatttacatgcgatcactgttcgtcaagatcctgttgcccttcgtaaagcaacgcttgatgtgcttgcactttatttagcgtgcggaattgatccaaataaaagtactatttttgttcaatctcacgttccagaacacacgcaattaagctgggtgttaaactgttacacctatttcggtgaaatgagccgaatgactcaatttaaagataaatcagcgcgttatgcagaaaatattaacgtgggtttgtttgattaccctgtgttaatggcggcggatattttactttatcaagcaaaaagcgtgcctgttggcgatgaccaaaaacaacacttagaaattacgcgtgatattgcaaaccgctttaatgcgctttatggcaatattttcactattcctgaaattttcattggaaaagcaggcgcgcgtattatgtcattgcaagatcccgaaaagaaaatgtcaaaatcagatgataaccgcaacaatgtagtgacacttttagaagatccaaaatctgtggcgaagaaaattaaacgtgccgtaacggattcagatgagccgcctgttgttcgttatgatgtgcaaaataaagcgggggtatctaatcttttagatattctttctgcggttacggataagccaattgctgatcttgaaaaagaatttgaaggtaaaatgtacggacatttaaaaactgcagtagcggatgaagtctcaactttacttgctggtttacaagaacgtttccatcaatatcgcaatgatgaaactttattagataatatcttacgacaaggtgcggaaaaagctcgtgcaaaagcacaagaaaccttggcgaaagtgtatgaagctgtaggttttgttgctgcaaaa

SEQ ID NO: 4760 - protein, 336 aa, Haemophilus influenzae
  Name: NTH2654
LIMAKPIVFSGVQPSGELTIGNYLGALRNWVKMQEDYECIFCVVDLHAITVRQDPVALRKATLDVLALYLACGIDPNKSTIFVQSHVPEHTQLSWVLNCYTYFGEMSRMTQFKDKSARYAENINVGLFDYPVLMAADILLYQAKSVPVGDDQKQHLEITRDIANRFNALYGNIFTIPEIFIGKAGARIMSLQDPEKKMSKSDDNRNNVVTLLEDPKSVAKKIKRAVTDSDEPPVVRYDVQNKAGVSNLLDILSAVTDKPIADLEKEFEGKMYGHLKTAVADEVSTLLAGLQERFHQYRNDETLLDNILRQGAEKARAKAQETLAKVYEAVGFVAAK

SEQ ID NO: 4761 - DNA, 102 bp, Haemophilus influenzae
  Name: NTH2655
ttgctgattggcacacgccagcaagggcaagaacaatatcgtggtagtttttcattagtaaatattaggaaaacgtttccgttaaatatagcatttttaacc

SEQ ID NO: 4762 - protein, 34 aa, Haemophilus influenzae
  Name: NTH2655
LLIGTRQQGQEQYRGSFSLVNIRKTFPLNIAFLT

SEQ ID NO: 4763 - DNA, 576 bp, Haemophilus influenzae
  Name: NTH2656
gtgtgccaatcagcaaaattggttcatcaacttgcaacagaaagtcgagcagattcagatacatttttaaccgcacttaatagccttttcattacccaaccacaacgaattgaagatgtttttggtggcgaagttcgtcatttaaaattaggtctagaaaccttaattcaccagctcaacgcgcaaggcgatcaaaatttaactcgctattggctaagccttttagcattagaaggaaaattatcgaaaaactccgatgccaaacaaacattgggcaatcgaatttctcgcctaaaagaacaagaaattcattacgctcgcgatagtgaaacaatgttatctattatggcaaatatttacagcgatattattagcccattgggtaaaaaaattcacatcctaggctcgcctgattatttgcgacaagaactcgtgcaaaataaaatccgtgcagttttacttgcaggcattcgctctgccgtgctgtggaaacaaatgggcggaacaaaatggcaaattttatttttccgcagaaaattacttgccaccgcaaaacagatttattcttctatttat

SEQ ID NO: 4764 - protein, 192 aa, Haemophilus influenzae
  Name: NTH2656
VCQSAKLVHQLATESRADSDTFLTALNSLFITQPQRIEDVFGGEVRHLKLGLETLIHQLNAQGDQNLTRYWLSLLALEGKLSKNSDAKQTLGNRISRLKEQEIHYARDSETMLSIMANIYSDIISPLGKKIHILGSPDYLRQELVQNKIRAVLLAGIRSAVLWKQMGGTKWQILFFRRKLLATAKQIYSSIY

SEQ ID NO: 4765 - DNA, 276 bp, Haemophilus influenzae
  Name: NTH2657
atgcaactctctacactgaccgcactttcccctcttgatggtcgttatcaagataaagtaacgccattacgtgctatttttagcgaattcgggttaatgaaattccgtgtagttgtggaagttcgttggttacaaaaattagcttcaacggcagatattaccgaagtaccgccattttctacgcaagcaaatgcttttttagatggaattgtggctaattttaatgaggccgatgctgcgcgtattaaagaaattgaacgcacactaatcacgatg

SEQ ID NO: 4766 - protein, 92 aa, Haemophilus influenzae
  Name: NTH2657
MQLSTLTALSPLDGRYQDKVTPLRAIFSEFGLMKFRVVVEVRWLQKLASTADITEVPPFSTQANAFLDGIVANFNEADAARIKEIERTLITM

SEQ ID NO: 4767 - DNA, 1092 bp, Haemophilus influenzae
  Name: NTH2659
gtgaaagccgttgagtattttctgaaagagaaaattcaaaacgaagtggaactagtgaacgtttctgaatttattcacttcgcttgcacctcagaagacattaacaatctctctcacgcattaatgttaagcaccgctcgtgacgaagtgattttaccagaatggcaaaaactgattgatgaaatcactcgtcttgcagaagaatataaaacgattccattactttctcgcacacatggccagccagcttcaccaagcaccgtgggcaaagaaatggcgaatgtcgtttatcgcctaaaacgtcaatttaaacaactccaaaatgcggagatcttaggtaaaatcaatggtgcagtaggtaactacaatgcgcatttatcggcatatcctaatattgattggcataaattcagcgaagaatttgtcacttcattaggtattcaatggaatccttataccacacaaattgagccgcacgattacatcgctgaattttttgatgctgtagttcgctttaataccattatcattgattttgatcgtgatttatggggatacattgcattaaatcactttaaacaacgaactatagcaggcgaaattggttcttctaccatgccacataaagtcaatccaattgattttgaaaactcagagggcaatctaggattagccaatgcagtgatgacccatttaggtcaaaaattaccaatttctcgctggcagcgtgacttaacagattcaaccgtattacgtaatttaggcgtaggattaggttattgtttgatcgcttatgcttcaacacgcaaaggcatgagtaaacttgaagtaaatcaaccgcacttattagaagaactcaatcaaaactgggaagttttggctgaaccaattcaaaccgtaatgcgtcgctacggaatagaaaaaccttacgaaaaattaaaagaattaacgcgaggtaaacgagtgacagaacaggctatgcgtgaatttattgataagttggatattccacaagaagaaaaattacgtttacaaaaattaacacccgctacttatattggggctgcagtggaattagtagagaagctatca

SEQ ID NO: 4768 - protein, 364 aa, Haemophilus influenzae
  Name: NTH2659
VKAVEYFLKEKIQNEVELVNVSEFIHFACTSEDINNLSHALMLSTARDEVILPEWQKLIDEITRLAEEYKTIPLLSRTHGQPASPSTVGKEMANVVYRLKRQFKQLQNAEILGKINGAVGNYNAHLSAYPNIDWHKFSEEFVTSLGIQWNPYTTQIEPHDYIAEFFDAVVRFNTIIIDFDRDLWGYIALNHFKQRTIAGEIGSSTMPHKVNPIDFENSEGNLGLANAVMTHLGQKLPISRWQRDLTDSTVLRNLGVGLGYCLIAYASTRKGMSKLEVNQPHLLEELNQNWEVLAEPIQTVMRRYGIEKPYEKLKELTRGKRVTEQAMREFIDKLDIPQEEKLRLQKLTPATYIGAAVELVEKLS

SEQ ID NO: 4769 - DNA, 489 bp, Haemophilus influenzae
  Name: NTH2660
atggcattaaatcttcaagacaaacaagcaattgttgctgaagtaaatgaagcagccaaaggtgcactttcagcagtaatcgcggattctcgcggtgtaactgttgagaaaatgactgaattacgtaaatcagcacgtgaagctggcgttacaatgcgtgtagttcgtaatactttattacgtcgcgcagttgaaggcacagattacgaatgcttaaaagatacgtttgtaggtccaacacttatcgcgttctctaacgaacacccgggcgaagctgctcgtttgttcaaagagtttgctaaagcaaacgataagtttgaaattaaaggtgcagcctttgaaggtaaaatccaagatgttgaattcttggcaacattaccaacttacgaagaagcgattgcacgtttaatgggcacaatgaaagaagctgcagcaggcaaacttgctcgcaccttcgcggcattacgcgacaaattacaagaagcagct

SEQ ID NO: 4770 - protein, 163 aa, Haemophilus influenzae
  Name: NTH2660
MALNLQDKQAIVAEVNEAAKGALSAVIADSRGVTVEKMTELRKSAREAGVTMRVVRNTLLRRAVEGTDYECLKDTFVGPTLIAFSNEHPGEAARLFKEFAKANDKFEIKGAAFEGKIQDVEFLATLPTYEEAIARLMGTMKEAAAGKLARTFAALRDKLQEAA

SEQ ID NO: 4771 - DNA, 378 bp, Haemophilus influenzae
  Name: NTH2661
ttgattgttatgtcattaactaacgaacaaatcattgaagcgattgcttcaaaaactgtaactgaaatcgttgaattaatcgcagcgatggaagaaaaattcggtgtttcagcagcggcagcagtagcagcagctccagcagcaggcggcgcagcggcagcagaagaaaaaactgaattcgacgttgtacttaaatctgcaggtgcgaacaaagtagcagtaattaaagcagtacgtggtgcaactggtttaggcttaaaagaagctaaagatttagttgaatctgctccagctaacttaaaagaaggcgtttctaaagaagaagctgaagcacttaagaaagaattagaagaagcgggtgcagaagtagaagttaaa

SEQ ID NO: 4772 - protein, 126 aa, Haemophilus influenzae
  Name: NTH2661
LIVMSLTNEQIIEAIASKTVTEIVELIAAMEEKFGVSAAAAVAAAPAAGGAAAAEEKTEFDVVLKSAGANKVAVIKAVRGATGLGLKEAKDLVESAPANLKEGVSKEEAEALKKELEEAGAEVEVK

SEQ ID NO: 4773 - DNA, 1368 bp, Haemophilus influenzae
  Name: NTH2663
atgacaaaaaaagcattaagtgcggtaattttagcagctggaaaaggaacgcgcatgtattccgatttacccaaagtgctacatacaatcgctggtaaaccaatggtaaaacacgtgattgatattgcccatcaattaggctcagaaaatattcatttaatctatggtcacggtggggacttaatgcgtacccatcttgcaaatgaacaagtaaactgggtattacaaacagaacaacttggcacagcacatgcagttcaacaagcagctcctttttttaaggataacgaaaacattgttgtactttacggcgatgcaccattaattactaaagaaacattagaaaaattaattgaagcgaaaccagaaaatggcattgcattgcttaccgtaaatttagataacccaacaggctatggacgaattatccgtgaaaatgggaatgttgtagccattgtagaacaaaaagatgcaaatgcagagcaactaaatattaaagaagtcaatactggcgttatggtatctgatggtgcaagtttcaaaaaatggctagctcgtgtaggtaataataatgctcaaggcgaatattacttaacggatcttattgctctcgcaaaccaagataattgccaagttgttgctgtacaagcaacagatgtcatggaagttgaaggcgcaaataatcgcttacaattagccgcacttgaacgttatttccaaaataaacaagcctccaaattattacttgaaggcgtaatgatctacgatcccgctcgttttgacctacgtggaacattagagcatggaaaagatgtggaaatcgatgttaatgttattatcgaaggtaatgttaaactcggtgattgcgtaaaaattggcgcaggttgcgtattgaaaaatgttgttattggcaatgatgtagaaataaaaccctattcagtgctagaggattctatagtaggagaaaaagccgcaattggcccattttctcgtttacgcccaggtgcagaactcgcagctgaaacgcatgtcggtaactttgtagaaattaaaaaatctaccgttggtaaaggttctaaagtaaatcatctaacttatgttggcgattcagaaatcggctcaaattgtaatattggagcgggtgtcataacctgcaactacgatggtgcaaataaatttaaaacgatcatcggtgatgatgtgtttgtgggatctgatacacaattagtcgcgccagtgaaagtcgcaaatggcgcaactattggtgctgggactacaattacacgtgatgttggcgaaaatgaattagtgattacaagagttgctcaacgacatattcaaggttggcaacgaccaataaagaaaaaa

SEQ ID NO: 4774 - protein, 456 aa, Haemophilus influenzae
  Name: NTH2663
MTKKALSAVILAAGKGTRMYSDLPKVLHTIAGKPMVKHVIDIAHQLGSENIHLIYGHGGDLMRTHLANEQVNWVLQTEQLGTAHAVQQAAPFFKDNENIVVLYGDAPLITKETLEKLIEAKPENGIALLTVNLDNPTGYGRIIRENGNVVAIVEQKDANAEQLNIKEVNTGVMVSDGASFKKWLARVGNNNAQGEYYLTDLIALANQDNCQVVAVQATDVMEVEGANNRLQLAALERYFQNKQASKLLLEGVMIYDPARFDLRGTLEHGKDVEIDVNVIIEGNVKLGDCVKIGAGCVLKNVVIGNDVEIKPYSVLEDSIVGEKAAIGPFSRLRPGAELAAETHVGNFVEIKKSTVGKGSKVNHLTYVGDSEIGSNCNIGAGVITCNYDGANKFKTIIGDDVFVGSDTQLVAPVKVANGATIGAGTTITRDVGENELVITRVAQRHIQGWQRPIKKK

SEQ ID NO: 4775 - DNA, 309 bp, Haemophilus influenzae
  Name: NTH2664
atgaaaaaacaatctttaccaactaaatttagtccatttgcttggggtcttgctgccttttgttcgcctatattattgtgtccaatggcattattaatttctacagcatttagtaaaaatccctatctatcaagctggcaaatcaatttattttcaacgcttttttgggtttatccctttattctagctgttacagctagaatgctataccgtcttcatcaacataaacctaaactagcaaataaattattaacattaagtgcggtcattttttatgtgattttaattacgatttgtaaaattggttta

SEQ ID NO: 4776 - protein, 103 aa, Haemophilus influenzae
  Name: NTH2664
MKKQSLPTKFSPFAWGLAAFCSPILLCPMALLISTAFSKNPYLSSWQINLFSTLFWVYPFILAVTARMLYRLHQHKPKLANKLLTLSAVIFYVILITICKIGL

SEQ ID NO: 4777 - DNA, 933 bp, Haemophilus influenzae
  Name: NTH2665
atgatcagagaaccttattttcatcaatttgctcttgcagaattattgcctttttttgagcaatttcctacccaatatctttctggtaaacgaaatataaaattagcttatcgtcatttgattcaacctgaaagtgcggtcagaaaattgatgattttagtaaatggtcgtgcagaaaatatgttgaaatggtcagagctcgcttatgatttttatcatcaaggttatgatgtattgctatttgatcatcgcggtcaaggctattcacagcgtattattcctcaaaaagggcatttagacgaatttcgtttctatgttgatgatatggcgaaaatcatcgaaaaagtaaccgcacttttcagctattcaacgcagcatttgcttgctcattcgatgggcgcattgattgcaacctattatttggcaaattatgatcatcacattaataaagcggtactttcttcgcctttttacggtattcttttaaaacatcccattagagatgaactgattattgccctaatgaatattttaggacaaggcgagcgttatgtttttggtaaagggccttatcaacaagcccacttggaatacaatgaattaactttctgtaaaaccagaatgaaatggatgaatcgtgtaaatcgtaaaaatccagcaattaatcttggcgggccaacattccgttgggtacatttgtgtttgaacgcaattaaacgcttgccgaaagttattcctaagattgaaattccaatcctaattttacaagccgaaaaagaaaaaatagtagataacaacaatcttgaaaaattaaccgtactttttccgaatgctagatgtgaagttgtattcaatgctaaacacgaaattctatttgaacaggacaaattaagaaaggaaacaatctttaaaatattagaatttttaaataat

SEQ ID NO: 4778 - protein, 311 aa, Haemophilus influenzae
  Name: NTH2665
MIREPYFHQFALAELLPFFEQFPTQYLSGKRNIKLAYRHLIQPESAVRKLMILVNGRAENMLKWSELAYDFYHQGYDVLLFDHRGQGYSQRIIPQKGHLDEFRFYVDDMAKIIEKVTALFSYSTQHLLAHSMGALIATYYLANYDHHINKAVLSSPFYGILLKHPIRDELIIALMNILGQGERYVFGKGPYQQAHLEYNELTFCKTRMKWMNRVNRKNPAINLGGPTFRWVHLCLNAIKRLPKVIPKIEIPILILQAEKEKIVDNNNLEKLTVLFPNARCEVVFNAKHEILFEQDKLRKETIFKILEFLNN

SEQ ID NO: 4779 - DNA, 1113 bp, Haemophilus influenzae
  Name: NTH2666
atgaaaaatgtaggctttatcggctggcgcgggatggtgggttccgtattaatggatcgtatgtcgcaggaaaatgattttgcaaatcttaatcccgtattttttacaacttcacaagcaggtcaaaaagcacctgtttttggtggcaaggatgcaggcgacctgaaaagtgcattcgatattgaagaacttaaaaaattagacattatcgtgacttgccaaggtggcgattacaccaatgaagtctatccaaaattaaaagcaacaggctgggatggttattgggttgatgccgcttctgcgttgcgtatgaaagatgatgcaattattgtgcttgatccagtaaaccaacacgtgatttctgaaggtttgaaaaaaggcattaaaactttcgtgggcggtaactgtactgtaagcttaatgcttatggctatcggcggtctatttgaaaaagatttggtggaatggatttctgtggcaacttaccaagcggcttcaggtgctggcgcaaaaaatatgcgtgaattactttcacaaatgggtttattagaacaagcagtttcaagtgaattaaaagaccctgcttcatctattttagatattgaacgtaaagtgacggcaaaaatgcgtgctgataacttcccaacagataactttggcgcggcattgggcggtagcttaatcccttggattgacaaacttcttcctgaaacagggcaaactaaagaagaatggaaaggttatgcagaaaccaacaaaattttaggtttaagcgacaatccaattcctgttgatggtttatgtgtgcgtatcggtgcattacgttgccacagccaagcgtttaccattaaattgaaaaaagacttaccattagaagaaatcgaacaaattattgcatcacataatgaatgggtaaaagtaattccaaatgacaaagaaaccacattacgtgaattaacgccagcgaaagtaacaggtacattaagcgtgccagtggggcgtttacgtaaattggctatggggcctgaatatttggcagcttttaccgtgggtgaccaattattatggggtgcggcagagccagttcgccgtatcttaaaacaattggtggcg

SEQ ID NO: 4780 - protein, 371 aa, Haemophilus influenzae
  Name: NTH2666
MKNVGFIGWRGMVGSVLMDRMSQENDFANLNPVFFTTSQAGQKAPVFGGKDAGDLKSAFDIEELKKLDIIVTCQGGDYTNEVYPKLKATGWDGYWVDAASALRMKDDAIIVLDPVNQHVISEGLKKGIKTFVGGNCTVSLMLMAIGGLFEKDLVEWISVATYQAASGAGAKNMRELLSQMGLLEQAVSSELKDPASSILDIERKVTAKMRADNFPTDNFGAALGGSLIPWIDKLLPETGQTKEEWKGYAETNKILGLSDNPIPVDGLCVRIGALRCHSQAFTIKLKKDLPLEEIEQIIASHNEWVKVIPNDKETTLRELTPAKVTGTLSVPVGRLRKLAMGPEYLAAFTVGDQLLWGAAEPVRRILKQLVA

SEQ ID NO: 4781 - DNA, 729 bp, Haemophilus influenzae
  Name: NTH2667
atggaaaattcatctttacttttaaccgcacttttcaatcctgatcacttaattatttttagcaaaatgctattagcgatggtgcttggcagtgttattggcttagaacgtgaacttaaacgtaaacctgtgggtgtaaaaacttgtgccattattgccgttaccacttgtgtgctaaccattgtttcaattcaagccgcagagcattatgcacaagtttcagaaaatattcgtacagatccaatgcgtcttgcggctcaagtgattagtggcatcggttttttaggtgctggtgtgattttgcataagaaaaatgatgcgatttcaggtttaaccactgcggcgattatttgggcttctgcggggatcggtattgctgctggggcgggtttcgtgtttgatgcggtcatcgccactgtgatgattttggtgtctattcgattaagtccgttggttcaacgttgggttcatcgtaaatcacaacgtcgtcggacgaaattcaatattcttgtcaatgatgcggaaagcatagggaaagttacccaattgttagtaaataatcagtatcgtattgaacatatacaagtcaaagatcaaagtagtggagaagtgcggttacaaattcgttgcttttccattgattccacaatgttgaaagatgcgtatgctttacttaaagcagaagatggcgtaataagtgttgaagtagataacttagaaaagagtgat

SEQ ID NO: 4782 - protein, 243 aa, Haemophilus influenzae
  Name: NTH2667
MENSSLLLTALFNPDHLIIFSKMLLAMVLGSVIGLERELKRKPVGVKTCAIIAVTTCVLTIVSIQAAEHYAQVSENIRTDPMRLAAQVISGIGFLGAGVILHKKNDAISGLTTAAIIWASAGIGIAAGAGFVFDAVIATVMILVSIRLSPLVQRWVHRKSQRRRTKFNILVNDAESIGKVTQLLVNNQYRIEHIQVKDQSSGEVRLQIRCFSIDSTMLKDAYALLKAEDGVISVEVDNLEKSD

SEQ ID NO: 4783 - DNA, 168 bp, Haemophilus influenzae
  Name: NTH2668
ttgcgaaaattgagtaaaatcttgcgtttgaaattttatagagcgaaaacggttatttttatgcaaaattcaaccccaagcattggctttgtaagccttggttgcccaaaaaacttggcatttgggttcgcttacattatgtgtatccctatccccatgtggatgatt

SEQ ID NO: 4784 - protein, 56 aa, Haemophilus influenzae
  Name: NTH2668
LRKLSKILRLKFYRAKTVIFMQNSTPSIGFVSLGCPKNLAFGFAYIMCIPIPMWMI

SEQ ID NO: 4785 - DNA, 615 bp, Haemophilus influenzae
  Name: NTH2669
gtgtatccctatccccatgtggatgatttaattccattaatggctgacggtacgctattgccgtatttagacattccattacaacacgccagccctaaaatcttaaaagcaatgaaaagaccaggcagtattgaccgcactttagaacgcattaaacaatggcgtgaaatttgcccagatttaacattgcgctcaacctttattgttggtttccctggcgaaacggaagaagatttccaattattactcgatttcttaaaagaagcccaacttgatcgcgtaggctgtttcaaattcagccctgttgaaggtgcacccgcaacagatatggctgaccaagtaccagaagatgtaaaagaagaacgtttccatcgcttcatgcaattacaacaagaaatttctgcaaaccgtttaaaacaaaaaattggtaaaacccttgatgtattagtggatgaaattgacgaagatggtattattggtcgttcaaaagccgatgcccctgaagtagatgggttagtttacgtagataatttaagcggaatcaatgtcaaagtcggtgacgtgattaaagtaaccatcacaaattctgatgaatatgatttgtggggcagttgt

SEQ ID NO: 4786 - protein, 205 aa, Haemophilus influenzae
  Name: NTH2669
VYPYPHVDDLIPLMADGTLLPYLDIPLQHASPKILKAMKRPGSIDRTLERIKQWREICPDLTLRSTFIVGFPGETEEDFQLLLDFLKEAQLDRVGCFKFSPVEGAPATDMADQVPEDVKEERFHRFMQLQQEISANRLKQKIGKTLDVLVDEIDEDGIIGRSKADAPEVDGLVYVDNLSGINVKVGDVIKVTITNSDEYDLWGSC

SEQ ID NO: 4787 - DNA, 408 bp, Haemophilus influenzae
  Name: NTH2670
ttgtggatggatgccgtgatttggcaaatgccgagctggtggatgcatgagccttggacagtgaaaaaatacatagacgaagtattaaccagtgggcacggcaagttatatcacagtgatggcagacacagcgttaatccaaccgagggctatggcacaggcggcttgttgcaaggcaaaaaacacatgctttcactgacttggaatgcaccgattgaagcctttactcgcgaaggcgatttctttgaaggcaaaggcgtggatgttttgtatatgcatttccacaaactcaacgagttcatcggcttgactcgcctgccgacattcttatgtaacgatgtggttaaaagtccgcaagtagaacaatacttagcagactaccaagcacacttggaaaaagtgttcggc

SEQ ID NO: 4788 - protein, 136 aa, Haemophilus influenzae
  Name: NTH2670
LWMDAVIWQMPSWWMHEPWTVKKYIDEVLTSGHGKLYHSDGRHSVNPTEGYGTGGLLQGKKHMLSLTWNAPIEAFTREGDFFEGKGVDVLYMHFHKLNEFIGLTRLPTFLCNDVVKSPQVEQYLADYQAHLEKVFG

SEQ ID NO: 4789 - DNA, 126 bp, Haemophilus influenzae
  Name: NTH2671
atgaatattttattattagacggcggtaaggcgtttggtcattctcacggcgagttgaaccattcgcttcacaaaaaacgaaagagttttgaccgcacttggacacaatgtcaaagaaactgtaat

SEQ ID NO: 4790 - protein, 42 aa, Haemophilus influenzae
  Name: NTH2671
MNILLLDGGKAFGHSHGELNHSLHKKRKSFDRTWTQCQRNCN

SEQ ID NO: 4791 - DNA, 2028 bp, Haemophilus influenzae
  Name: NTH2672
gtgggctcaataattcttatgaaactcaatcctcaacaacaacaagccgttgaatatgtgacaggcccttgccttgtgcttgctggcgctggttcaggcaaaactcgcgtaatcattaataaaatcgcccatttaattgaaaagtgcgggtattctccgaaacaaattgccgccgtcacttttacgaataaagccgcacgcgagatgaaagagcgtgtggcacattccattggcaaagaacaatccaaaggattgcttgtttccacttttcatacgctcggttttgacattattaagcgtgaatataaagcgttgggctttaaatcaaatatgaccttgtttgatgagcacgatcaatttgcgttgttaaaagagctaaccgctgatgtgttaaaagaagataaggatttattgcgcgagttaatttcagtgatttctaactggaagaacgatttgatttcgccaaaacaggcatttgccttggcacgtgatgctaaatatcaaactttcgcaaaatgttatgagcgttacgccacacaaattcgagcttacaacgctctcgattttgatgatttgattatgctgccgacattattgttcaagcaaaatgaagaagtgcggtcaaaatggcaggcaaaaattcgttatttgttggtggatgaatatcaagacaccaacaccagtcaatatgaactgattaaacttttagtgggtgagcgtgcttgtttcactgtggtgggcgatgatgaccaatctatttattcgtggcgtggcgcacgaccagaaaatatggtgcgtttacgcgatgattttcctcgtttgaacgtgattaagctagagcaaaattaccgttcaacccagcgtattttgcattgtgccaatattttgattgataacaatgagcacgtgtttgataagaaacttttttcaaccattggtacaggggaaaaattgcttgtcatcgaagcaaaaaatgaagaacacgaagcagagcggattgtcgccgagttgatcgcccatcgttttagccgtaaaaccaaatataaagattatgcgattttgtatcgaggcaatcatcaatcccgattactcgaaaaagtactgatgcaaaaccgtattccttacaaaatttcgggcggtacttcttttttctctcgtgcagaaatcaaagatatgatggcgtatttgcgcttggtggtaaatcaagatgatgacggagcattcctgcgtattgtgaatacaccgaagcgtgaaattggcaccgcaaccttacaaaaacttggagagttggctcaagaaaaacacatcagtttgtttgatgctatttttgagtttgaacttattcaacgcattacaccaaaagcctatgattcattgcaaaaatttggccgttggattgtagaacttaatgatgaaattcaacgttctgaaccagaacgtgcggtacgttctatgttatctgcgattcattatgaagaatatttgtacgaatacgcaacaaaccctaaagcagcagaaatgcaaagtaagaatgtcgccacgttatttgactgggttgcggatatgttaaaaggcgatgaaaccaatgagccgatgaaccttaatcaagtggtaacccgcctgacattacgcgatatgttggagcgaggcgaagacgatgacgacagcgatcaagttcaactgatgacattacacgcatctaaaggattggaatttccttatgtttatttgattggtatggaggagggcattttaccccaccaaaccagcattgatgaagacaacgtggaagaagaacgccgcttggcttatgtgggtatcacaagagcacaaaaagaacttactttttctttatgtcgtgagcgtcgtcaatatggagaattagttcgcccagaacccagccgatttttagctgaattacctaatgacgatgtgctatgggaacgcgataaaccaaaactcaccaccgagcaaaaacaagaaaaaacacaaaaccaacttgatagattgagggcgattttgaaaagt

SEQ ID NO: 4792 - protein, 676 aa, Haemophilus influenzae
  Name: NTH2672
VGSIILMKLNPQQQQAVEYVTGPCLVLAGAGSGKTRVIINKIAHLIEKCGYSPKQIAAVTFTNKAAREMKERVAHSIGKEQSKGLLVSTFHTLGFDIIKREYKALGFKSNMTLFDEHDQFALLKELTADVLKEDKDLLRELISVISNWKNDLISPKQAFALARDAKYQTFAKCYERYATQIRAYNALDFDDLIMLPTLLFKQNEEVRSKWQAKIRYLLVDEYQDTNTSQYELIKLLVGERACFTVVGDDDQSIYSWRGARPENMVRLRDDFPRLNVIKLEQNYRSTQRILHCANILIDNNEHVFDKKLFSTIGTGEKLLVIEAKNEEHEAERIVAELIAHRFSRKTKYKDYAILYRGNHQSRLLEKVLMQNRIPYKISGGTSFFSRAEIKDMMAYLRLVVNQDDDGAFLRIVNTPKREIGTATLQKLGELAQEKHISLFDAIFEFELIQRITPKAYDSLQKFGRWIVELNDEIQRSEPERAVRSMLSAIHYEEYLYEYATNPKAAEMQSKNVATLFDWVADMLKGDETNEPMNLNQVVTRLTLRDMLERGEDDDDSDQVQLMTLHASKGLEFPYVYLIGMEEGILPHQTSIDEDNVEEERRLAYVGITRAQKELTFSLCRERRQYGELVRPEPSRFLAELPNDDVLWERDKPKLTTEQKQEKTQNQLDRLRAILKS

SEQ ID NO: 4793 - DNA, 210 bp, Haemophilus influenzae
  Name: NTH2673
atgataaaaacctttatttttttaaccgcacttatcgttttatctggttgtggttccgtggtcaaacttatcgatccaacagaaaaatataccgcctatgcaggggttgcttatgatcttgaaatggcgcaacaatggggattgccaatcttagatttgcctctctcatttttattagacactgtattactgccctatgcgtgggctcaa

SEQ ID NO: 4794 - protein, 70 aa, Haemophilus influenzae
  Name: NTH2673
MIKTFIFLTALIVLSGCGSVVKLIDPTEKYTAYAGVAYDLEMAQQWGLPILDLPLSFLLDTVLLPYAWAQ

SEQ ID NO: 4795 - DNA, 468 bp, Haemophilus influenzae
  Name: NTH2674
atgacgagcgtgatttatcctggtacttttgatccgattacgaacggtcatttagacattattgaaagaagtgcggtaatttttcctcgtgttttagtggcggtggcgaatagcccaagtaaaaagccactattttcgttggaggaacgcgtggagcttgttcgtcaatctgttgcacatttatccaatgtggaggtgtttggcttttctgatttgttggcaaatgtgattaaacagcacaatatttctgccattattcgcggcgtacgcacaacaacagattttgaatatgaactgcaattggccgcccttaatcgtttactcacaaaaggcgtagatagtctgtttttcccaccagcagaaaaatgggcgtttgtttcttctaccattgtgcgtgaaatttatttacatggcggagatgtcgctgagctagttcctgagcctgtattcaatgcgttaaaagcacga

SEQ ID NO: 4796 - protein, 156 aa, Haemophilus influenzae
  Name: NTH2674
MTSVIYPGTFDPITNGHLDIIERSAVIFPRVLVAVANSPSKKPLFSLEERVELVRQSVAHLSNVEVFGFSDLLANVIKQHNISAIIRGVRTTTDFEYELQLAALNRLLTKGVDSLFFPPAEKWAFVSSTIVREIYLHGGDVAELVPEPVFNALKAR

SEQ ID NO: 4797 - DNA, 1281 bp, Haemophilus influenzae
  Name: NTH2675
atgtggcgttttttttataccagcttgcttttaatttgccagccgttgatattgtgttttattggcttgctcagtgttaaatctccacgttatcgtcagcgtttggctgaacgttatggtttttatggcaatgtgccttgtccaccaccacaaggaatctttatccacgcagcctccgtaggggaagtgattgctgcgataccgctggttcgtcaattgcaacaagattatccgcatttatccattacttttacgacttttacgccaacaggttcagagcgcgtcaaagccacttttggagacagcgtttttcattattatctcccccttgatttacctttttcgatccatcgttttattaattttgtacaacctaaattatgtatcgtgatggaaacagaactttggcctaatcttattcatcaattatttttacgcaatattccatttgttatcgctaatgcacgtttatctgcgcgttctgcacatcgttacggaaaaataaaagcgcacttacaaacaatgtggtcgcaaattagcttgattgcagcgcaggataacattagtggaaaacgctatgccactttgggctatccaaaggaaaaattgaatatcacgggcaatattaaatatgatctcaatacgaatgatgaactattacgtaaaattgattcattgcgaacgctttggaaacaagatcgcccaatatggattgctgccagcacgcataatggagaagatgaaatcattttaaaatctcaccgcgctttgttagcaaaatacccgaatttattgttattgctcgttccgcgccatccagagcgttttaatgtggtggctgatttacttaaaaaggaaaaatttcaatttattcgtcgttccacaaatgaattaccaaatgaaaatacccaagtgattttgggcgatagtatgggcgaactgatgttgatgtatggcatttccgatattgcttttgtgggtggaagccttgtgaaacacggggggcataatccactggaacctcttgcgtttaaaatgcctgtaattactggcaagcatacttttaattttcccgagatatttagaatgttggtggaagtgcaaggtgtgttggaagttaattcaaccgcagattccttagaacgcgccgtagaagccttattaaactcaaaagaagcccgcgaacgtttaggcaatgctggctatgaagtgctgatggaaaaccgaggggcattacagcgtttgttagatttattaaaaccttatttggagcgcaatgta

SEQ ID NO: 4798 - protein, 427 aa, Haemophilus influenzae
  Name: NTH2675
MWRFFYTSLLLICQPLILCFIGLLSVKSPRYRQRLAERYGFYGNVPCPPPQGIFIHAASVGEVIAAIPLVRQLQQDYPHLSITFTTFTPTGSERVKATFGDSVFHYYLPLDLPFSIHRFINFVQPKLCIVMETELWPNLIHQLFLRNIPFVIANARLSARSAHRYGKIKAHLQTMWSQISLIAAQDNISGKRYATLGYPKEKLNITGNIKYDLNTNDELLRKIDSLRTLWKQDRPIWIAASTHNGEDEIILKSHRALLAKYPNLLLLLVPRHPERFNVVADLLKKEKFQFIRRSTNELPNENTQVILGDSMGELMLMYGISDIAFVGGSLVKHGGHNPLEPLAFKMPVITGKHTFNFPEIFRMLVEVQGVLEVNSTADSLERAVEALLNSKEARERLGNAGYEVLMENRGALQRLLDLLKPYLERNV

SEQ ID NO: 4799 - DNA, 762 bp, Haemophilus influenzae
  Name: NTH2676
atgcctacaattagcgttgcgatgattgtaaaaaatgaagcacaagacctcgccaattgcttagacaccgtaaaagattgggtggatgagattatcattctagattctggtagcacagataacactaaagaaattgcgctcagttatggggctaaattctatgaaaatagcgactggcaaggatttggtaaacaacgccaattagcccaacaatatgtaaccagtgattatgtactctggttagatgctgacgaacgcgttacgcccaagttacaacaggctatcttaagtgcggttaaaaatgatcgagaaaataccgtttatgaaattccacgagtgagtgaagtatttgggcgtgaaattcgccattcaggctggtatcccgattatgtagttcgtctctatcgcacaaactatgcgcaatataatgattcacttgtacatgaaaaagtggaatttccagctggcacaaaagtagaaaaattgacaggggatttagagcatttcacttataaaagtattcatcattatctagtgaaatccgcaggttatgccaaagcctgggcagaccaacgccaagctaaaggaaaaaaagccacactttggcaaggaatttcgcacgcgcttggttgttttgtgaagatgtatttgttaaaagcgggttttttagatggcaaacaaggatttttattagcggtgttatcagcgcattcaacctttgtaaaatacgccgatttatgggagcgagatcagcataaacac

SEQ ID NO: 4800 - protein, 254 aa, Haemophilus influenzae
  Name: NTH2676
MPTISVAMIVKNEAQDLANCLDTVKDWVDEIIILDSGSTDNTKEIALSYGAKFYENSDWQGFGKQRQLAQQYVTSDYVLWLDADERVTPKLQQAILSAVKNDRENTVYEIPRVSEVFGREIRHSGWYPDYVVRLYRTNYAQYNDSLVHEKVEFPAGTKVEKLTGDLEHFTYKSIHHYLVKSAGYAKAWADQRQAKGKKATLWQGISHALGCFVKMYLLKAGFLDGKQGFLLAVLSAHSTFVKYADLWERDQHKH

SEQ ID NO: 4801 - DNA, 576 bp, Haemophilus influenzae
  Name: NTH2678
ttgtcaagttttaatatgcaacaaataaccagatgcccttgggttggcgaacaacctatttatattgattatcatgacaaggaatggggaaagcctgaattcgacagccaaaagctatttgaaaaaatttgtttggaagggcagcaagcgggactttcgtggattacggttttgaaaaaacgtgaatcttaccgtgcagcctttcatcaatttgatccgaaaaaaatcgcaaaaatgaccgcacttgatattgatgcttgcatgcaaaattcaggattaattcgccatcgagccaagttagaagccattgtcaaaaatgcgaaagcttatttggcaatggaaaagtgcggtgaaaatttcagtaattttatttggtcatttgtgaatcataaaccgattgtcaatgatgtgcctgatttgcgatctgtgccaactaaaacagaagtatcgaaagcactttctcaagccttaaaaaaacgtggtttcgtctttgttggcgaaaccacgtgctatgcgtttatgcaatctatggggctggtggacgatcatttaaatgattgtccttgcaaaactcgc

SEQ ID NO: 4802 - protein, 192 aa, Haemophilus influenzae
  Name: NTH2678
LSSFNMQQITRCPWVGEQPIYIDYHDKEWGKPEFDSQKLFEKICLEGQQAGLSWITVLKKRESYRAAFHQFDPKKIAKMTALDIDACMQNSGLIRHRAKLEAIVKNAKAYLAMEKCGENFSNFIWSFVNHKPIVNDVPDLRSVPTKTEVSKALSQALKKRGFVFVGETTCYAFMQSMGLVDDHLNDCPCKTR

SEQ ID NO: 4803 - DNA, 756 bp, Haemophilus influenzae
  Name: NTH2679
ttggcaatggaaaataaatacagcgattttatggtgtatgtcgatgaaagtggagatcacagtttacagtcaattgataaaaactatcctgtgtttgtacttgcattctgtattttttataaagaccattatcgaaataatattgttccacagatacagaagataaaatttgattattttggtcatgatatggtgatattgcatgagcatgaaatccgcaaagaaaaaggcgattttaatattttcacttctcgtgaacagcgtgaaggttttatggaacgtatttcatctattattgaaaatactaattttattcttgctgcctgtgtgattgataagcgaaaaacgccacaaaatgaaacaacacacccttatcatttttcactcaaacattgtttagaaaccctatacgaatttgtttgtgaaaagcatcaagaagataaaatcacttttgttgccgtggaaagccgtggacgtaatgaggatagagagttagagctggaatttttacgtatttgtgatggacaaaataaatttaaaaagtccttgccttttcaagtaaagattgtgccaaaacaaattaattctgtggggttgcaagttgcggatttagtggcaagacctatcgggagacatattttagatagtaatcaaccaaatcgagcctttgagatccttaaaaagaaattttattgtgaaggtggaagaaaaatactgggggaaaattttgatcaaaaaggactgaaacatttccct

SEQ ID NO: 4804 - protein, 252 aa, Haemophilus influenzae
  Name: NTH2679
LAMENKYSDFMVYVDESGDHSLQSIDKNYPVFVLAFCIFYKDHYRNNIVPQIQKIKFDYFGHDMVILHEHEIRKEKGDFNIFTSREQREGFMERISSIIENTNFILAACVIDKRKTPQNETTHPYHFSLKHCLETLYEFVCEKHQEDKITFVAVESRGRNEDRELELEFLRICDGQNKFKKSLPFQVKIVPKQINSVGLQVADLVARPIGRHILDSNQPNRAFEILKKKFYCEGGRKILGENFDQKGLKHFP

SEQ ID NO: 4805 - DNA, 804 bp, Haemophilus influenzae
  Name: NTH2680
atggatctttatgctgtatggggcaatccgattacgcaaagtaaatcgccattaattcaacgtcagttagccgcgcaaacccatcaaactatggaatacatcgcaaaattaggcaatcttgattcttttgaacaacagcttttggcattttttgaggagggtgcgaaaggttgcaatattacttcgccttttaaagaacgtgcctatcaactggcagacgaatatagccaacgagcaaaattggcggaagcctgtaatacgctaaaaaaactcgatgatggaaaactttatgcggataacaccgatgggattggtttagtgacggatttggagcgtttaaattggcttcgtccaaatcaacacgtattaatcttgggggcaggcggagcaacaaaaggcgtattattgccacttttacaagctcaacaaaacattgtgcttgctaaccgcactttttcgaaaaccaaagaattagctgaaagatttcagccttacggcaatattcaagctgtctctatggattcgattccactacaaacctatgatgtagtgattaatgcaacttccgctggattaagtggtggaactgctccagttgatgttgaaattttaaaattaggcttagctttttacgatatgcaatatgcgaaaggcacagacacgccatttatcgcattatgcaaaagtttaggtttaaccaatgttagcgatggctttggaatgttagtcgcgcaagcagcacattctttccatttatggcgaggcgtaatgccagattttgtcgcggtttatgagcaattaaaa

SEQ ID NO: 4806 - protein, 268 aa, Haemophilus influenzae
  Name: NTH2680
MDLYAVWGNPITQSKSPLIQRQLAAQTHQTMEYIAKLGNLDSFEQQLLAFFEEGAKGCNITSPFKERAYQLADEYSQRAKLAEACNTLKKLDDGKLYADNTDGIGLVTDLERLNWLRPNQHVLILGAGGATKGVLLPLLQAQQNIVLANRTFSKTKELAERFQPYGNIQAVSMDSIPLQTYDVVINATSAGLSGGTAPVDVEILKLGLAFYDMQYAKGTDTPFIALCKSLGLTNVSDGFGMLVAQAAHSFHLWRGVMPDFVAVYEQLK

SEQ ID NO: 4807 - DNA, 549 bp, Haemophilus influenzae
  Name: NTH2681
atgaatagagaacaaatcgccgaagcccttcgacaaaatcaagtggttgcttatcccactgaagctgtgtttggtttgggctgtaatccgcaaagtgaaagtgcggtaaaaaaattactcgatttaaagcaacgtccagtggaaaaagggctgattttagtcgctcctagcttggattttttccgtccttttgtcgattttgagcagattaacgatgaacagctttctcatctgcaaggtaaatatgaacgtccaacgacttggattgtgccagctaaatccaccacctcgcattttctcacaggaaaatttgatagcattgcaatacgtttgtgcgatcacccatctgtgaaagccttatgtgaactcacgggttttgcattaacttcgactagcgcaaacctaacaggagagccaccttgccgtaccgccgatgaagtgcggttacaattcggtgcagattttcctgtattggatgaaattgtgggagatgcacgcaatccatctgaaattcgagacttacgcacaaatcaactttttagacaggga

SEQ ID NO: 4808 - protein, 183 aa, Haemophilus influenzae
  Name: NTH2681
MNREQIAEALRQNQVVAYPTEAVFGLGCNPQSESAVKKLLDLKQRPVEKGLILVAPSLDFFRPFVDFEQINDEQLSHLQGKYERPTTWIVPAKSTTSHFLTGKFDSIAIRLCDHPSVKALCELTGFALTSTSANLTGEPPCRTADEVRLQFGADFPVLDEIVGDARNPSEIRDLRTNQLFRQG

SEQ ID NO: 4809 - DNA, 534 bp, Haemophilus influenzae
  Name: NTH2682
atgaatcaaagcctttttcatcatagcaaacaacaggaatattgccctcaatgtggtgcgcttttgcaaattaaacaaggcaaaaaagggctgtttttaggttgctctgcttatcctgaatgtgattatttgcgtcctttgcaacgatcggagcataaagtattaaaaacatttgatgaaatttgcccgaagtgcggtaatttattgcagttgaaacaaggcagttttgggatgtttattggttgtagccattatcctgaatgcgattttgtggtgcgggaagaatctgaatctgaggaaaaaattacttgtcctgaatgtaaaacggggcatttgatttctcgtcgtggtcgccaaggaaagattttttacggctgtgataatttccctaaatgtaaattttctttgcctgccaagccttattccgtgccttgcccaacgtgccattttcctctttctttgttaaaaagcgaaaatggggaaaaacaaattttccagtgtgcaaataaaacttgccgtcatatttttgagcaa

SEQ ID NO: 4810 - protein, 178 aa, Haemophilus influenzae
  Name: NTH2682
MNQSLFHHSKQQEYCPQCGALLQIKQGKKGLFLGCSAYPECDYLRPLQRSEHKVLKTFDEICPKCGNLLQLKQGSFGMFIGCSHYPECDFVVREESESEEKITCPECKTGHLISRRGRQGKIFYGCDNFPKCKFSLPAKPYSVPCPTCHFPLSLLKSENGEKQIFQCANKTCRHIFEQ

SEQ ID NO: 4811 - DNA, 189 bp, Haemophilus influenzae
  Name: NTH2683
atgaataaattttcttctgagcttgcgaacatagaaaatcaactggcagatactgaatttattaatgcggaaaataaagaaaaattgaccgcacttttggctcaacaagtggatgtgaagaaagcattagatgatgtagaaacggaatggatgactgcacaggaagaattggaagaaatgcttcaagcg

SEQ ID NO: 4812 - protein, 63 aa, Haemophilus influenzae
  Name: NTH2683
MNKFSSELANIENQLADTEFINAENKEKLTALLAQQVDVKKALDDVETEWMTAQEELEEMLQA

SEQ ID NO: 4813 - DNA, 102 bp, Haemophilus influenzae
  n 97, 98, 99, 100, 101: n is any nucleotide
  Name: NTH2684
ttgcgggattttttacgtatggggggcaagttgggtgggcgtactctgctcacggcgggttttggttcttacgattttgaccgaatttcattacgannnnnt

SEQ ID NO: 4814 - protein, 34 aa, Haemophilus influenzae
  Xaa 33, 34: Xaa is any amino acid
  Name: NTH2684
LRDFLRMGGKLGGRTLLTAGFGSYDFDRISLRXX

SEQ ID NO: 4815 - DNA, 345 bp, Haemophilus influenzae
  n 10: n is any nucleotide
  Name: NTH2685
gtggactcgngaaaaaatcataaaacgcctgtatttccaaaacttgttttcaccatcaaaaaaggtttgaaccaaaataaaggcgatccgaattacgatatcaaacaactcgcattagaatgcgcatcaaaacgtatgtatccagatattctcaattacgatcaagttgtcaaagtcacaggctcttttaaagccccaatgggatgtcgtagctttttaggtgcatacgaagaaaatagtcatgaaattcacgatgggcgtaataatcttggcgtagtgagtttgaatttaccgcgtatcgcgttggagtccataaaacgaagaagatttctaccgcactttaga

SEQ ID NO: 4816 - protein, 115 aa, Haemophilus influenzae
  Xaa 4: Xaa is any amino acid
  Name: NTH2685
VDSXKNHKTPVFPKLVFTIKKGLNQNKGDPNYDIKQLALECASKRMYPDILNYDQVVKVTGSFKAPMGCRSFLGAYEENSHEIHDGRNNLGVVSLNLPRIALESIKRRRFLPHFR

SEQ ID NO: 4817 - DNA, 816 bp, Haemophilus influenzae
  Name: NTH2686
ttggctattgcgaaaaaagcattaatgacgcgtgttgcccgccttgagaataccaaagctcgcgttgctcccattctttatatggaaggtgcatgcggagtgcggttaaaagcggatgaaaatgtggcacaaattttcaaaaatggacgagcctctatttcgctcggctatatcggtattcatgaaaccattaatgcgctatataaaaaagggcatatttttgatgatgaacaattacgcgaaaaaggcattgcgattgttcgccaccttagcgaggcagtaaaacgctggcaaaaagaaactggctatgccttcagcctttactccacgccaagcgaaaacttatgcgaccgcttctgccgtctagataccaaaaaatttggcgtgattgaaggcatcacggataagggctactacacgaacagttaccacttagatgtagaaaagaaagtgaatccttacgacaaactggattttgaaatgtcatatcccccactcgccagcggcggttttatttgctacggcgaatatccaaatattcaacacaacttaaaagcattggaagatgtgtgggattatagctacgatcgcgtaccttactacggcacaaacacaccgattgacgaatgttatgaatgtggtttcactggcgagtttgaatgtaccagcagaggttttgtttgcccaaaatgtggcaatcacgacagcacaaaagtgtctgtcactcgccgcgtctgtggctatctaggcagccctgatgcccgcccatttaatgcgggaaaacaggaagaagtgaagagaagagttaaacacctt

SEQ ID NO: 4818 - protein, 272 aa, Haemophilus influenzae
  Name: NTH2686
LAIAKKALMTRVARLENTKARVAPILYMEGACGVRLKADENVAQIFKNGRASISLGYIGIHETINALYKKGHIFDDEQLREKGIAIVRHLSEAVKRWQKETGYAFSLYSTPSENLCDRFCRLDTKKFGVIEGITDKGYYTNSYHLDVEKKVNPYDKLDFEMSYPPLASGGFICYGEYPNIQHNLKALEDVWDYSYDRVPYYGTNTPIDECYECGFTGEFECTSRGFVCPKCGNHDSTKVSVTRRVCGYLGSPDARPFNAGKQEEVKRRVKHL

SEQ ID NO: 4819 - DNA, 858 bp, Haemophilus influenzae
  Name: NTH2687
atgtcagatattctcaataacctcattcatcttcttaaacttgaaaaaattgatgatttaatctttcgtggtgaaagccaagatttaggttttcgtcaagtatttggcgggcaagtagtggcacaggcgttatctgcagcaatgcaggtggcgccagaagatcgcattttacattcttgtcatgcctattttcttgccccaggagacagccaatatccgattatttacgatgtggaaaccttgcgtgaagggcgtaatttttctgcattacgcgtaaaagccattcaacataaaaataccatttgtcatgtaaccacttctttccaagtgctggaaaaaggttttgaacatcaaaattcaatgccaaatgttggcgcgcctgaagactttacagatgaaaatgtgatgctacaaaaagtggctcaaaccttgccagaaccactcaatgaaaaatttgcggcagagcgtccatttgaggtacgtaccaaatatttgaataacccatttaacgggacaaaattgccagccgagcaatattcttggtttaaaaccaatggtgaaacgccgcttgatataaaaattcagcaatgtttattggcttatttttccgattttcactgtattttgaccgcacttcatccgcacgaaaaaggctttttacaaaaaggaatgaaagtggcaaccattgatcatagtatttggttccatcgtccgtttgatttaaatcactggcatttgcacgcaattgaaagcaataatgcttttggagggcgaggcttagctcgcgggcaaattttctcgcaaaatggtcaattaatcgcgacaacacaacaagaagttttgatccgttttaatgaa

SEQ ID NO: 4820 - protein, 286 aa, Haemophilus influenzae
  Name: NTH2687
MSDILNNLIHLLKLEKIDDLIFRGESQDLGFRQVFGGQVVAQALSAAMQVAPEDRILHSCHAYFLAPGDSQYPIIYDVETLREGRNFSALRVKAIQHKNTICHVTTSFQVLEKGFEHQNSMPNVGAPEDFTDENVMLQKVAQTLPEPLNEKFAAERPFEVRTKYLNNPFNGTKLPAEQYSWFKTNGETPLDIKIQQCLLAYFSDFHCILTALHPHEKGFLQKGMKVATIDHSIWFHRPFDLNHWHLHAIESNNAFGGRGLARGQIFSQNGQLIATTQQEVLIRFNE

SEQ ID NO: 4821 - DNA, 1407 bp, Haemophilus influenzae
  Name: NTH2688
ttgtttttatttcattttacgagcttaaaaatgctaaaaattttcaataccttaacgagagaaaaagaaatctttaaacctatccacgaaaataaagtgggaatgtatgtttgtggcgtcactgtttatgatttgtgccatatcggtcatggacgcacttttgtgtgttttgatgtgattgcccgttatttacgttctttgggttacgatttaacttatgtgcgcaatattacggacgtagatgacaaaatcatcaaacgtgcattagaaaacaaagaaacctgcgatcagctagtggatcgtatggtgcaggaaatgtataaagattttgatgcacttaatgtattacgccctgattttgagcctcgcgcaacccatcatattcctgaaattattgaaattgtggaaaaattgattaaacgtggacatgcttatgttgcagataatggcgatgtgatgtttgatgtagaaagcttcaaagaatacggcaaattatcccgtcaagatcttgagcaattacaagctggtgcacgtattgaaatcaatgaaatcaagaaaaatccaatggatttcgtgctttggaaaatgtcgaaagaaaacgaaccaagttgggcttccccttggggtgcaggtcgtcctggctggcatattgaatgttcggctatgaactgcaaacagcttggcgaacattttgatattcacggtggtggctctgatttaatgttcccacaccacgaaaatgaaattgcacaatcttgctgtgcgcatggtggccaatatgtgaattattggatccattctggcatgattatggtggataaagaaaaaatgtcgaaatctctcggcaatttcttcacaattcgtgatgtattaaaccattacaatgcagaagctgtacgttatttcttattaacggcacattatcgtagccagctaaattacagcgaagaaaacttgaatttagcgcaaggtgcgttggaacgtttatacacggctttacgtggaacggatcaaagtgcggttgtttttggcggagaaaattttgtggaaaccttccgtgaagcaatggacgatgattttaatacgccaaatgcactttctgttttattcgaaatggcgcgtgaaattaacaagttaaaaacagaggatgctgagaaagccaatggacttgccgcgcgtttgcgtgaattgggggcgattttaggattacttcaacaagatccagaaaaattcttacaagcaggttctgacgatgatgaagtggcaaaaattgaagcactgattaaacaacgcaatgaggcccgcgctgctaaagattgggctactgctgatgctgcgcgtaatgagcttatcgctatgggcatcgtattagaagatgggccgaatggaacaacttggcgtaagcaa

SEQ ID NO: 4822 - protein, 469 aa, Haemophilus influenzae
  Name: NTH2688
LFLFHFTSLKMLKIFNTLTREKEIFKPIHENKVGMYVCGVTVYDLCHIGHGRTFVCFDVIARYLRSLGYDLTYVRNITDVDDKIIKRALENKETCDQLVDRMVQEMYKDFDALNVLRPDFEPRATHHIPEIIEIVEKLIKRGHAYVADNGDVMFDVESFKEYGKLSRQDLEQLQAGARIEINEIKKNPMDFVLWKMSKENEPSWASPWGAGRPGWHIECSAMNCKQLGEHFDIHGGGSDLMFPHHENEIAQSCCAHGGQYVNYWIHSGMIMVDKEKMSKSLGNFFTIRDVLNHYNAEAVRYFLLTAHYRSQLNYSEENLNLAQGALERLYTALRGTDQSAVVFGGENFVETFREAMDDDFNTPNALSVLFEMAREINKLKTEDAEKANGLAARLRELGAILGLLQQDPEKFLQAGSDDDEVAKIEALIKQRNEARAAKDWATADAARNELIAMGIVLEDGPNGTTWRKQ

SEQ ID NO: 4823 - DNA, 507 bp, Haemophilus influenzae
  Name: NTH2689
atggttacattacacacaaattttggcgacattaaaattaaattggattttgataaagctccagttacagcagaaaatttcttaaattactgcaaagaaggtttttataataacacaatttttcatcgtgttattgatggctttatgattcaaggtggcggtatggaaagcggtatgcatgaaaaagcaaccaaagcaccaatccaaaatgaagcgaacaatcgtttaagcaacaaacgtggaaccattgcaatggcacgcacgtcagatccacattcagcgaccgcacaatttttcattaacgtggcagacaatgatttcttaaattatcgttcaaaagaaatgtttggtcgagaagtcgttcaagaatggggctatgcggtatttggtgaagtggttgaagggatggatgttgttgataaaatcaaaaaagtgaaaacaggcaacaaaggctttcatcaagatgttcctactgaagatgtagtgattacattggtttctattgag

SEQ ID NO: 4824 - protein, 169 aa, Haemophilus influenzae
  Name: NTH2689
MVTLHTNFGDIKIKLDFDKAPVTAENFLNYCKEGFYNNTIFHRVIDGFMIQGGGMESGMHEKATKAPIQNEANNRLSNKRGTIAMARTSDPHSATAQFFINVADNDFLNYRSKEMFGREVVQEWGYAVFGEVVEGMDVVDKIKKVKTGNKGFHQDVPTEDVVITLVSIE

SEQ ID NO: 4825 - DNA, 429 bp, Haemophilus influenzae
  Name: NTH2690
atgagcataaaacaacatcgccctaaagttggagaaattctagaatgtgattatggtcaattttcgcatacctgtcacgttgatggacatattccacctgaaatggttaaaaaacgtttagttgttgttttgaatgcgaaactgaacgggcttattttagttgcaccaatttcatctacaattaatttagatggtataaaaaatggctatcatattgaaatagattcagaattaataaaagcaacaagcttttatgataaaaggactcgctggattaaatctgaattaattcaatcagtaagtcgtctccgtctgtatcatatttatgataaaggaactaaaattactcaatatttgccaagggatgttgtaacaaaagttcaaagagctatcataaaagcaatcaatgcaagctcattacttgacaag

SEQ ID NO: 4826 - protein, 143 aa, Haemophilus influenzae
  Name: NTH2690
MSIKQHRPKVGEILECDYGQFSHTCHVDGHIPPEMVKKRLVVVLNAKLNGLILVAPISSTINLDGIKNGYHIEIDSELIKATSFYDKRTRWIKSELIQSVSRLRLYHIYDKGTKITQYLPRDVVTKVQRAIIKAINASSLLDK

SEQ ID NO: 4827 - DNA, 132 bp, Haemophilus influenzae
  Name: NTH2691
atgcacttcttcgacactcacacgcatcttgattatctccaacaatttactggggaaccgttgtcacaacttattgataatgctaagcaagccgatgtgcaaaaaaatactggttgtggcggtgaaagaagc

SEQ ID NO: 4828 - protein, 44 aa, Haemophilus influenzae
  Name: NTH2691
MHFFDTHTHLDYLQQFTGEPLSQLIDNAKQADVQKNTGCGGERS

SEQ ID NO: 4829 - DNA, 147 bp, Haemophilus influenzae
  Name: NTH2693
atgaccgcactttttcctgataatttgtgctatgggcttgggctccatcctcttttattcaagaacacgccgaaaagatttgattctgttagaacaagccttaaaaaaatcgtgatgcaaattgcacggcagtggcagaaattggtt

SEQ ID NO: 4830 - protein, 49 aa, Haemophilus influenzae
  Name: NTH2693
MTALFPDNLCYGLGLHPLLFKNTPKRFDSVRTSLKKIVMQIARQWQKLV

SEQ ID NO: 4831 - DNA, 129 bp, Haemophilus influenzae
  Name: NTH2694
ttgccaaataaagttggctttcaaaaaaatgacattgctttgcccaaagttcattcggtgagcaaatcaggaattgcgcgttctaaaccaatttctgccactgccgtgcaatttgcatcacgatttttt

SEQ ID NO: 4832 - protein, 43 aa, Haemophilus influenzae
  Name: NTH2694
LPNKVGFQKNDIALPKVHSVSKSGIARSKPISATAVQFASRFF

SEQ ID NO: 4833 - DNA, 351 bp, Haemophilus influenzae
  n 329: n is any nucleotide
  Name: NTH2695
ttggcaaagcaatttaatttacccgtcaatattcacagtcgaaaaactcatgatcaaatttttacttttttaaaacgtattccattatctaaacttggcgtggtacacggtttttcaggaagttacgatcaagcaaaacgctttgttgatttaggctataaaatcggagttggcggcactatcacttatgaacgagccaataaaactcgtcaagcaatcgcgaagttgccgcttgatgccttagtgttggaaacagacagtccagatatgcctgtatttggttttcaaggccaacctaatcgaccagacgcgtattgtggaaagtttangagccctttgcaccttaagaaa

SEQ ID NO: 4834 - protein, 117 aa, Haemophilus influenzae
  Xaa 110: Xaa is any amino acid
  Name: NTH2695
LAKQFNLPVNIHSRKTHDQIFTFLKRIPLSKLGVVHGFSGSYDQAKRFVDLGYKIGVGGTITYERANKTRQAIAKLPLDALVLETDSPDMPVFGFQGQPNRPDAYCGKFXSPLHLKK

SEQ ID NO: 4835 - DNA, 255 bp, Haemophilus influenzae
  Name: NTH2696
atggtcacatcgggcaattatgcctcttattatttagcgcttttgccttccgaaaatggcgaaactattgataactgggtgcttccacttggtactcaaggcttaacttttgaagctgatagctggaatagcttaggtatgcgtagcaatgtttcttgctttatgcgcatgaccgatatgccattagatcgtagctggcgtgtagcgtggaactctcccctaattacatgtatgccgtggcaactggagcaaaga

SEQ ID NO: 4836 - protein, 85 aa, Haemophilus influenzae
  Name: NTH2696
MVTSGNYASYYLALLPSENGETIDNWVLPLGTQGLTFEADSWNSLGMRSNVSCFMRMTDMPLDRSWRVAWNSPLITCMPWQLEQR

SEQ ID NO: 4837 - DNA, 273 bp, Haemophilus influenzae
  Name: NTH2697
ttgcgcgggccttatacatcattagtggatttatttgaatcggcattacctgatattttaatgctcgaattttctacgccaagagcgggagaattaagttcgttattagaaagtgaaatattaagacaaaaatgtattttaggcttaggcgtcatcaatcctcgttctgatgaagtggaaactgtaacacaaattgttcagcgcgcagaaaaagccttaaattaccttccaccagagcaaatatcaaaatttcagacaaaaaaattgccccat

SEQ ID NO: 4838 - protein, 91 aa, Haemophilus influenzae
  Name: NTH2697
LRGPYTSLVDLFESALPDILMLEFSTPRAGELSSLLESEILRQKCILGLGVINPRSDEVETVTQIVQRAEKALNYLPPEQISKFQTKKLPH

SEQ ID NO: 4839 - DNA, 321 bp, Haemophilus influenzae
  Name: NTH2698
atgagcgaagtattacacattaatgacgcagattttgaaagtgttgtagttaattcagatatccccgttttattagacttttgggcaccttggtgtggtccttgcaaaatgattgcaccagtgttagatgaacttgcacctgaatttgcaggtaaagttaaaattgtgaaaatgaatgtggatgacaaccaagcaacgccagcacaatttggtgttcgtagtatcccaacattattattgattaaaaatggtcaagttgttgcaactcaagttggtgcattaccaaaaactcaattggctaacttcattaaccaacatatt

SEQ ID NO: 4840 - protein, 107 aa, Haemophilus influenzae
  Name: NTH2698
MSEVLHINDADFESVVVNSDIPVLLDFWAPWCGPCKMIAPVLDELAPEFAGKVKIVKMNVDDNQATPAQFGVRSIPTLLLIKNGQVVATQVGALPKTQLANFINQHI

SEQ ID NO: 4841 - DNA, 1005 bp, Haemophilus influenzae
  Name: NTH2701
ttggagcaaaccatgaaaattgcaatctatagcactaaaagttatgacagaaaatatattgagctcattaatgcgaaatataatttcgatttagaattttttgattttatgctgaacgagagcactgtgcgtttggcagagcattgcgaagtagtatgcattttcgtgaatgataatggtagccgaaaagtattagaaaaattagccgcacttggtgtgaaaattgtggctttgcgctgtgccggtttcaataatgttgatttaaaagcagctcaagaattaggcatccaagtcgtccgcgttccagcttattcgcctgaagcggtggcggaacataccatcggtttgatgatgactctgaaccgtcgaattcatcgtgcttatcagcgtacccgagaagcgaatttctctcttgaggggttaattggtttcaatatgtacggacgcacagtcggcgtaatcggaacaggaaaaatcgggatcgcagtgatgcgaattttgaaaggttttggcatgaatattttggcgtacgatccttttaaaaatccactggtggaagagcttggtggacaatatgttgaattagatgagctttatgctaaatctcatgtcattacgcttcattgcccagcaacgccagaaaactatcatttattaaatcgcgaggcttttgcaaaaatgaaagatggtgtgatgatcgttaatacgagtcgtggctctttgattgatactcaggctgcaattgatgcgttaaaacagcgtaaaatcggggcgttaggtatggatgtgtatgagaatgaacgagatttgttctttgaagataagtctaacgaagtcattcaagatgatattttccgccgtttatcttcttgccataatgtattgctaacaggccaccaagcatttttaaccgaagaagcactaaccaatattgcggatgtgactttatcaaatgtttataaattgaaatcgggtaaagtgtgtgaaaatattgttttgccgtct

SEQ ID NO: 4842 - protein, 335 aa, Haemophilus influenzae
  Name: NTH2701
LEQTMKIAIYSTKSYDRKYIELINAKYNFDLEFFDFMLNESTVRLAEHCEVVCIFVNDNGSRKVLEKLAALGVKIVALRCAGFNNVDLKAAQELGIQVVRVPAYSPEAVAEHTIGLMMTLNRRIHRAYQRTREANFSLEGLIGFNMYGRTVGVIGTGKIGIAVMRILKGFGMNILAYDPFKNPLVEELGGQYVELDELYAKSHVITLHCPATPENYHLLNREAFAKMKDGVMIVNTSRGSLIDTQAAIDALKQRKIGALGMDVYENERDLFFEDKSNEVIQDDIFRRLSSCHNVLLTGHQAFLTEEALTNIADVTLSNVYKLKSGKVCENIVLPS

SEQ ID NO: 4843 - DNA, 1179 bp, Haemophilus influenzae
  Name: NTH2702
ttgtgccaaaatgctaaacgttttttaacacgtaaagtgcggtcaattttttcattatttttagaggatgttatgacacaacaatatgctattgatactttattagctcaagctggcaatcgcagtgatgagcgtacgggcgcggtttctgcaccaatttttctttctacggcttatggtcattgtggtatcggtgaaagtacgggatttgattacacacgtaccaaaaatccaactcgcacagtattagaagaaacgatagctaaattagagaatggagatcgtggttttgcgttttcttctggtatggctgcaattcaagttttgatgacgctttttaccgccccagatgaatggattgtttctagcgatgtgtatggtggtacttatcgattattagatttttcttataaaaataacaatagtgtaaaacctgtttatgttaatacagcatctgcttcagcaattgaggctgccattaacccaaatacgaaagcgatttttattgaaaccccatcgaatcctttaatggaagaatgtgatgtggttgaaattgcaaaacttgcgaaaaaacataacttaatgttgatcgtggataatacgtttttaacgcctgtgctttctcgtccattagatttaggtgcggatgtggtaattcacagcggaactaaatatattgctgggcataatgatgcacttgttggtttaattgttgcgaaagggcaagaactttgtgatcgcattgcttatattcaaaatggtgcaggggcggtgctttctccttttgattcttggctgactattcgtggtatgaagaccctttctttgcgtatgaaacgccatcaagaaaatgcacaagccattgcggaatttttaaaagctcaaccacaagtggaatcggtgctttatccaaataaaggtgggatgttgtctttccgtttgcaagatgaagcttgggttaatacattcttaaaatccatcaaattgattacttttgcagaaagtctaggcggcacagaaagttttattacttatcctgccactcaaactcatatggatattccagaacccgagcgtgtagctcgtgggattactaataccttgttgcgtttttcagtcggtattgaagatgtagaagatattaaagcggacttattacaggcttttgcaaacttaaaa

SEQ ID NO: 4844 - protein, 393 aa, Haemophilus influenzae
  Name: NTH2702
LCQNAKRFLTRKVRSIFSLFLEDVMTQQYAIDTLLAQAGNRSDERTGAVSAPIFLSTAYGHCGIGESTGFDYTRTKNPTRTVLEETIAKLENGDRGFAFSSGMAAIQVLMTLFTAPDEWIVSSDVYGGTYRLLDFSYKNNNSVKPVYVNTASASAIEAAINPNTKAIFIETPSNPLMEECDVVEIAKLAKKHNLMLIVDNTFLTPVLSRPLDLGADVVIHSGTKYIAGHNDALVGLIVAKGQELCDRIAYIQNGAGAVLSPFDSWLTIRGMKTLSLRMKRHQENAQAIAEFLKAQPQVESVLYPNKGGMLSFRLQDEAWVNTFLKSIKLITFAESLGGTESFITYPATQTHMDIPEPERVARGITNTLLRFSVGIEDVEDIKADLLQAFANLK

SEQ ID NO: 4845 - DNA, 525 bp, Haemophilus influenzae
  Name: NTH2703
atggacttctcttctgtttctaaaaaaccttatattattactgtcgcttgtactaaaggcggttctgcaaaaagtacaaatgctgccaatattggggcgttctgcgctgaccacggtttaagaactcttcttattgatactgatactcaaccaaccttaagctcttattatgctttaactgaagaagctcccggtggtatttatgagtttttaacccgtcgtgatattgaaccttcccatatcatttcaaaaacatccattcctaatttggatttaattcaatcaaatgacccatcaaacaatgtaagtcaaactctacgtaatgcccctgatggtgcaattcgatttagtcacttaattaaaaacattgataattatgatgttattgtggttgatactcgaggtactagagacattactgtcgatatgtctgtcttagcagctgacatcctattctgccctattcttccacacattcttttgcgaaagaatttatccgtggaactatcggaatgtatcaagatt

SEQ ID NO: 4846 - protein, 175 aa, Haemophilus influenzae
  Name: NTH2703
MDFSSVSKKPYIITVACTKGGSAKSTNAANIGAFCADHGLRTLLIDTDTQPTLSSYYALTEEAPGGIYEFLTRRDIEPSHIISKTSIPNLDLIQSNDPSNNVSQTLRNAPDGAIRFSHLIKNIDNYDVIVVDTRGTRDITVDMSVLAADILFCPILPHILLRKNLSVELSECIKI

SEQ ID NO: 4847 - DNA, 321 bp, Haemophilus influenzae
  Name: NTH2704
atgtatcaagatttagaaacctttgaatcatttggcttcaaattaccacctctcaaagctatcgcaaattgcgttgataatactaatgacgtgaaatttgtactcaatcaattgcatgtcctatttgaaaccaattttgatgaaagcaaaaccttccttgatttttcaatccctgcgcatgtggcatatagagaagctgcaacttattcattgccagtttatcgccatagccaagctgaatatcctgttatcaaagaactgtgttgcttgttactccctcaatttaaaacactttttgataaaccaatgaaaaaggaaggc

SEQ ID NO: 4848 - protein, 107 aa, Haemophilus influenzae
  Name: NTH2704
MYQDLETFESFGFKLPPLKAIANCVDNTNDVKFVLNQLHVLFETNFDESKTFLDFSIPAHVAYREAATYSLPVYRHSQAEYPVIKELCCLLLPQFKTLFDKPMKKEG

SEQ ID NO: 4849 - DNA, 1353 bp, Haemophilus influenzae
  Name: NTH2705
atgactgataaacttattgcttctattgaagcggaaagtgcggtcattggtgctctcattattgataatgacaaatttgatgagatcgcaactttactgcgctctgatgatttttatgtctcagctcataaagtattgtttgaaggtgttagccatctattaacacaaggaaaacccgctgatattttaactttggagcagtatttcaaagataaaaaactgattgatcagatagggggattagcatacttagctgacattattcacaataccccttctgcatctaatatcactgcgtatgctgagattatttctcgttatagcaaacaacgtcgttttttgactctgggccagtttattgtaactgaaatgcaatcttcaaaagatgagattgaattaacttcttttgaggaaagtgttgataagcaatataccaatattgtcatcgaacaagagacggatggtgttgctgatcttaatgcaagtttcgagcgaatcctttctcgcatggaaacgtcctctattaatgccgatccagttagtggaacaccaacaggcattattgaattagatagagcaacaacaggcggtcaaccaggagaacttatcattattgcagctcgtccagcaatgggtaaaacaacctttgcacaaacgattgccgcaagtacgttagataaatttcctgacagccctatccaattttacagtcaagaaatgccagctgatcaactattagaacgttttatggcaatgcgctctcgcgtcagcttgcaatctattcgtcaagcgactgagcttgaagaggaagaatggactcgccttgctaatgcaatggggacaattaaaaaagactggaaagatcgtttgttaattgatgatgaagcttctttaacacctcatcgtttacgcgccaaagtacgtaaaaacactcgtctatacggcaaacctaaagcgattttcattgattatatccaactaatgagaactggaaataaaactgaaaatcgcaatttagaacttgccgaaatatccaatgatttaaagaaattagccaaagaaactggatgcccaatttatgcattatctcaactaaaccgaggtttagaaaatcgagctaataagcgtccaatcaatgccgacttacgtgactccggctctcttgaacaagatgctgatgtcatcattcatctttatagagatgaaatctataaccctgacacagaagataaaggcattgcggaaatcatcattggtaaacagcgtaatggcccgttagccacagtaaaaacactgtttcaaggtcaatacagcatttttgagaatttaacgacacaggatagatattatgaa

SEQ ID NO: 4850 - protein, 451 aa, Haemophilus influenzae
  Name: NTH2705
MTDKLIASIEAESAVIGALIIDNDKFDEIATLLRSDDFYVSAHKVLFEGVSHLLTQGKPADILTLEQYFKDKKLIDQIGGLAYLADIIHNTPSASNITAYAEIISRYSKQRRFLTLGQFIVTEMQSSKDEIELTSFEESVDKQYTNIVIEQETDGVADLNASFERILSRMETSSINADPVSGTPTGIIELDRATTGGQPGELIIIAARPAMGKTTFAQTIAASTLDKFPDSPIQFYSQEMPADQLLERFMAMRSRVSLQSIRQATELEEEEWTRLANAMGTIKKDWKDRLLIDDEASLTPHRLRAKVRKNTRLYGKPKAIFIDYIQLMRTGNKTENRNLELAEISNDLKKLAKETGCPIYALSQLNRGLENRANKRPINADLRDSGSLEQDADVIIHLYRDEIYNPDTEDKGIAEIIIGKQRNGPLATVKTLFQGQYSIFENLTTQDRYYE

SEQ ID NO: 4851 - DNA, 252 bp, Haemophilus influenzae
  Name: NTH2706
atgaataatccatttattgctaaaaataaaaaacaacaaagtcaattagacgcgattgcgaaaggattaaatgttcaacctattaataatcagtctgctgcttatcaaacaacaacagcaacacattatcctgcgcaatctaaatacattaccgttacgttagataaattacgcccttatgaacacaaccctcgtaagacacgtaatcctaactttgaaatgattaaagagtcaattcgtcgtcgtgggtct

SEQ ID NO: 4852 - protein, 84 aa, Haemophilus influenzae
  Name: NTH2706
MNNPFIAKNKKQQSQLDAIAKGLNVQPINNQSAAYQTTTATHYPAQSKYITVTLDKLRPYEHNPRKTRNPNFEMIKESIRRRGS

SEQ ID NO: 4853 - DNA, 1455 bp, Haemophilus influenzae
  Name: NTH2707
gtgggtcttgatcataaaccaaatatcactcaacgacctggcgaacctttttatatcatcgctgacggtgggaatactcgtattcaagcattaaaagaactgtttacagagactcaagatcaacgtttttggtctattgaatgcttatataaaccctggaaaggtgaaagtgctgatagtgtagaagcggaattagatttgcttattggtcatttaattgaaaatgatacacgtgcagatttaacctttattgagaaagcgttgggaattcagcaagcgaaagaatactacgagaaaaagttaggaaaatccctttctgctcgcgagctttcaagtgagttagaaaaagatgggtatatcattcaattttcaatgattgcgaagatgggacgttgcattgagtatctttatccttatatcccggatgtactttttaacggtttaggtaatgcgccaattgataaattgcttgcgattcgtaataacgccttagccatttggcaaaattatcaatttgaattggaagtgtcctttgatgaaatttggggacacagcctagctcgttgtaatgatgaccaaccgtttcatatcaaagtattccaagaccatctcattgatgaaatgtcatccatgttaggtgatcgtgtaagttatgaagtcctttaccttgaaattgatctcgatgagcaaaaattcaagaaaatggcgcaaaaacaacacgaaatacaacaaagcgtacaagaaagcatccaagatgttcaagcgtttaatacgccacagccacaagaaaccgcattagacacattatctcaacctagcgtagtcaatactccaaaaatgactacccctgaaaaaaaatcaatacctgcgccagtattaaagcaagcaagtgttgaaatttctccttcatttgagaatgaagcagatgataaaacagaggatgaagagtttgatgaaactaatgctagttcagatggcctttcttttgattttgctaaaaatttaactcaacaatttggtattactccaggcatgagcattcaggagcaacgccaacaacgtgcagaagaaaatggattaggctttgcttgcgtaggccgtcaaccagttgatgatatttggaaaatttatcctggtcgtcagcataaagtagaagcttattcactagcactcgacattgcggaaagtgttggattaactgactacattgaacatgtagtaaaagagcctgttgattacacttaccgcgtaaaaccattagataaagatgtgagcggtgtagcacagatgtgttatgacttcttaaatttattacaaacagatgtgcacccacagacatctttcaccttattaccggaatatttactcaatactcaagaaattgatgataccacgctagttaaattattccgtttaattcgcctcgttcgctatattcgttcagaaggagatgca

SEQ ID NO: 4854 - protein, 485 aa, Haemophilus influenzae
  Name: NTH2707
VGLDHKPNITQRPGEPFYIIADGGNTRIQALKELFTETQDQRFWSIECLYKPWKGESADSVEAELDLLIGHLIENDTRADLTFIEKALGIQQAKEYYEKKLGKSLSARELSSELEKDGYIIQFSMIAKMGRCIEYLYPYIPDVLFNGLGNAPIDKLLAIRNNALAIWQNYQFELEVSFDEIWGHSLARCNDDQPFHIKVFQDHLIDEMSSMLGDRVSYEVLYLEIDLDEQKFKKMAQKQHEIQQSVQESIQDVQAFNTPQPQETALDTLSQPSVVNTPKMTTPEKKSIPAPVLKQASVEISPSFENEADDKTEDEEFDETNASSDGLSFDFAKNLTQQFGITPGMSIQEQRQQRAEENGLGFACVGRQPVDDIWKIYPGRQHKVEAYSLALDIAESVGLTDYIEHVVKEPVDYTYRVKPLDKDVSGVAQMCYDFLNLLQTDVHPQTSFTLLPEYLLNTQEIDDTTLVKLFRLIRLVRYIRSEGDA

SEQ ID NO: 4855 - DNA, 549 bp, Haemophilus influenzae
  Name: NTH2708
atgagcatgttcagcaatttaaaccaagtggtattgaatgagattttggttaatttacaagaaggcaatatcaatgtttgccggaactatggtttctcaaaacaagaattgcaagaaattgaaaaactcagcacagaggaagtttatgaactggctaacaccaaagctccctttgccaaagttgaaattaatcacgatgcattttggcgattagtggctcgagtacgcatgtcgtcacaagaacgtcgccttattgatcgcgcattaatgttaggtgcatccatccaaatgctcaattcctacttcggcttaaccacttcaaaagtatctgctcgtcgtagcctacttggaaaacaagaaccaatgggacgtaagccagctgcaaccgaagaggaagaaaaattaatttgggacttatggcaagagcataaaggtgatgttcaaacaattgaatcaacagaaggactagagctgttaattttaattgcggaagaaaccggtattaatttaactgaaatttggaaacttgttagccgctggaatgcagct

SEQ ID NO: 4856 - protein, 183 aa, Haemophilus influenzae
  Name: NTH2708
MSMFSNLNQVVLNEILVNLQEGNINVCRNYGFSKQELQEIEKLSTEEVYELANTKAPFAKVEINHDAFWRLVARVRMSSQERRLIDRALMLGASIQMLNSYFGLTTSKVSARRSLLGKQEPMGRKPAATEEEEKLIWDLWQEHKGDVQTIESTEGLELLILIAEETGINLTEIWKLVSRWNAA

SEQ ID NO: 4857 - DNA, 900 bp, Haemophilus influenzae
  Name: NTH2709
atggaaacaaaattacaagagcatgggttgctcttttttggcaaccagcatgaaacagttccaacccgtttgctatttgatccttatttaacatcaagagcaaaattggcatggcaacttataaaatacaaagcaagagaatttcaatcaggcatgttcccatcatacgaagtgcttgcaaaattactttcagataaaccttatgatgaagcagaactctcgcgtaagctagttagccaaacgttgttattacttagattaactcgttggctaacactttgtgaaactgtacgtaatgagcaaggtcaagtattgggtaatttttacatccttcatgatgaacctatgccaatcattgatacgattcaattaaaccatgattacatcgcactccttgaaaaatccattcagcatcgagataactttgtgcgaggtgtagcaaaccatattgtagaaaacctgctctcagataatactcagtggcattatatttctcacattgactggatgcgagctcgccttcaagactatcaaaaacgtccaaaaatggatatttcagagcaagaagaatcaacatttattcaagaaaacttactaagttccaataaggaactcagtgaaaaaacaggggaactcagtaaaaatcaccttagttccaaaatggaactcagtaaaatcaagcagagttccaaaaaggaactcagtacccaaaatgatgataagtcattgatttcaggcttagttccaaaagggaactcaggtttttcacagtacagtacaggtactagtatttatataaatacgtactgtactggtaatgcggatgaaattgactggccgactaatattcagttttcatcattggaaaaaacagcaatttatgcaagcaatgcgtggact

SEQ ID NO: 4858 - protein, 300 aa, Haemophilus influenzae
  Name: NTH2709
METKLQEHGLLFFGNQHETVPTRLLFDPYLTSRAKLAWQLIKYKAREFQSGMFPSYEVLAKLLSDKPYDEAELSRKLVSQTLLLLRLTRWLTLCETVRNEQGQVLGNFYILHDEPMPIIDTIQLNHDYIALLEKSIQHRDNFVRGVANHIVENLLSDNTQWHYISHIDWMRARLQDYQKRPKMDISEQEESTFIQENLLSSNKELSEKTGELSKNHLSSKMELSKIKQSSKKELSTQNDDKSLISGLVPKGNSGFSQYSTGTSIYINTYCTGNADEIDWPTNIQFSSLEKTAIYASNAWT

SEQ ID NO: 4859 - DNA, 342 bp, Haemophilus influenzae
  Name: NTH2710
atgcaagcaatgcgtggacttgatttaggaatctgtaaagcgattttatttgagctagaacagcgtgtggcaaaaggtgaagtgaaaaaacccacaaggtatgtagtgacattaatccaacgtgcacaccgtggtgaatttaaaccatatttgtatgaacaatttttggctacacaagcgcaatcattatcatcaaaaaatcggttatcacaacatgatgaaactagcttagttaataatgtgaaagccgatagcacaataaaaccaatgcgagtgcaatctgaagaagagcgaaaagcgagagctgatcgcattcgacaatttaaggcttcaatttgcaat

SEQ ID NO: 4860 - protein, 114 aa, Haemophilus influenzae
  Name: NTH2710
MQAMRGLDLGICKAILFELEQRVAKGEVKKPTRYVVTLIQRAHRGEFKPYLYEQFLATQAQSLSSKNRLSQHDETSLVNNVKADSTIKPMRVQSEEERKARADRIRQFKASICN

SEQ ID NO: 4861 - DNA, 681 bp, Haemophilus influenzae
  Name: NTH2711
ttggttgtatgttgttgtcatgttatgtcaccttttatcatttggttaaaatttgtactttgtccagcccctggacagtggttaatttttgttcactgtgcaaccctagcacagtggttaatttttgttcactgtgcaaccctagcacagtggttaatttttgttcactgtgcaaccctagcacagtggttaatttttgttcactgtgcagtccccgcacactggttaaaatttgtactttgtaaagtccctttacagtggttaaattttgtactttgtagaacccttctacactattcactttttatacagcttattcaattgcaaattgaagccttaaattgtcgaatgcgatcagctctcgcttttcgctcttcttcagattgcactcgcattggttttattgtgctatcggctttcacattattaactaagctagtttcatcatgttgtgataaccgattttttgatgataatgattgcgcttgtgtagccaaaaattgttcatacaaatatggtttaaattcaccacggtgtgcacgttggattaatgtcactacataccttgtgggttttttcacttcaccttttgccacacgctgttctagctcaaataaaatcgctttacagattcctaaatcaagtccacgcattgcttgcataaattgctgttttttccaa

SEQ ID NO: 4862 - protein, 227 aa, Haemophilus influenzae
  Name: NTH2711
LVVCCCHVMSPFIIWLKFVLCPAPGQWLIFVHCATLAQWLIFVHCATLAQWLIFVHCATLAQWLIFVHCAVPAHWLKFVLCKVPLQWLNFVLCRTLLHYSLFIQLIQLQIEALNCRMRSALAFRSSSDCTRIGFIVLSAFTLLTKLVSSCCDNRFFDDNDCACVAKNCSYKYGLNSPRCARWINVTTYLVGFFTSPFATRCSSSNKIALQIPKSSPRIACINCCFFQ

SEQ ID NO: 4863 - DNA, 753 bp, Haemophilus influenzae
  Name: NTH2712
atgacaacaacatacaaccaacagcttgggccgttacgcagtgagattacatttacgcttcatactcagtatgcaacacgtctttggaatggtcgtgacttagttaaaaatgaagccggggaagtcgttacatcatcaattctcagtattcctaatgctctatctctattgagtcaaattcagcaagctgccgaacaagatgatccttatgctgatgattatcttcttcgttttgaacaaaaagtattagggtttcgtaaagaaatgcaagatatgacctggagaatggttaatctctacagtgagaaaattcctgaaaactttcaaattgagcgttgtgccaatattgctccgattcaataccctatttttgtgaatactcagctgggttatcaattattgtatcttttggctgactttgattcgttagctcgtacagtgatgaccgcttcacatattgcattacttacaaaagatgatgcgtatgattggttagaatccggagctaaattaattcgtcgtgcatttggtgtgcttgagaattacagaaattccggtattacacgccaagatgcgcttgaaaataacgctcgctatcaagctgctgtaaaacgtatgaaatataccttaacgcctgacgtgctttccggtacaacacgtgcaacatttgctccaacaattaaaaaatcatcacttgctgaatcagatgataatggctctgttgaagtccaaattacagcaaataaaactgaa

SEQ ID NO: 4864 - protein, 251 aa, Haemophilus influenzae
  Name: NTH2712
MTTTYNQQLGPLRSEITFTLHTQYATRLWNGRDLVKNEAGEVVTSSILSIPNALSLLSQIQQAAEQDDPYADDYLLRFEQKVLGFRKEMQDMTWRMVNLYSEKIPENFQIERCANIAPIQYPIFVNTQLGYQLLYLLADFDSLARTVMTASHIALLTKDDAYDWLESGAKLIRRAFGVLENYRNSGITRQDALENNARYQAAVKRMKYTLTPDVLSGTTRATFAPTIKKSSLAESDDNGSVEVQITANKTE

SEQ ID NO: 4865 - DNA, 459 bp, Haemophilus influenzae
  Name: NTH2713
atggagattgggattatggataacgtgctcattccttctgatatgtataaacaattaggacgcacaaccccacttaatgactcgctgaaacagttattcagtgagttagactcagtgcaacagtatgaattactagctgaatcccttgctacagtccgtgaagctttaatgttgcagcagaatgaaatgttgcagaacgttcgtaaaagtgaacttagtgtattacctattcacatgatccgagataaagcttcatcatccggtgggacgtttttacgctggcgcagttttcaagcctctaagactggtgatgctgtgttaaatccggtatttaataatcctcagttatcttcagacttacgacaaaaacttgtctcagctgagaaagaacgcattttgattaatctgcaggtctccgtactaaattttatgatgagacagggtatcaagtgcggtaga

SEQ ID NO: 4866 - protein, 153 aa, Haemophilus influenzae
  Name: NTH2713
MEIGIMDNVLIPSDMYKQLGRTTPLNDSLKQLFSELDSVQQYELLAESLATVREALMLQQNEMLQNVRKSELSVLPIHMIRDKASSSGGTFLRWRSFQASKTGDAVLNPVFNNPQLSSDLRQKLVSAEKERILINLQVSVLNFMMRQGIKCGR

SEQ ID NO: 4867 - DNA, 420 bp, Haemophilus influenzae
  Name: NTH2714
atggctggaattaataaagtaattatcgtgggacatttaggtaatgatcctgaaatgcgaagcatgccgaatggtgaagcagttgcaaatatcagtgtagcaactagcgaagcttggacggataaaaacaccggtgaacgtcgtgaagtgactgaatggcatcgaatcgttttttatcgcaaattagctgaaatttgcggccaatatctcaagaaaggagcgcaagtttatattgaaggacgcttgcgtactcgtaaatggcaagatcaaaacgggcaagatcgttataccacggaaatccaaggtgatgtaatgcaaatgttaggtactcgccctcaaagtgcagatggtgcaaataattctcagccaatgccacaacaagatgcatcggcaaatgcttttgatgattcaataccattc

SEQ ID NO: 4868 - protein, 140 aa, Haemophilus influenzae
  Name: NTH2714
MAGINKVIIVGHLGNDPEMRSMPNGEAVANISVATSEAWTDKNTGERREVTEWHRIVFYRKLAEICGQYLKKGAQVYIEGRLRTRKWQDQNGQDRYTTEIQGDVMQMLGTRPQSADGANNSQPMPQQDASANAFDDSIPF

SEQ ID NO: 4869 - DNA, 519 bp, Haemophilus influenzae
  Name: NTH2715
gtgatgaaaaaaataatttttgttttatctgccgtcgctgctttaagtggttgtgctgaattaaactcattgaatgatgcggttggtaatgttgcaggtcaactcagcagtgttcttggcggggggaatagttcctctagttcttccggtgtggcttacactcaaagttctcgttctcatcgctataacgtagaggattcaattacatcatctaaaaatattgactctctttacgtaaaaattaaacgtaatttaaaattcaaaacacgggaggaagcattaagtggattatccgggtatgagcgtcaacgttacgaatcgcttttagatgaagaaggacatgctcatgaagcgactcctggggtctattatcacatggcaaatagctatgttggcggtcgaaaaattgacataacgcttgcaaaagaggatggcaaggttagaatttcctggattgcatcctcaaatgaatctgattttgctcaatttgttaaatcagaagtgataaaagcaattaaa

SEQ ID NO: 4870 - protein, 173 aa, Haemophilus influenzae
  Name: NTH2715
VMKKIIFVLSAVAALSGCAELNSLNDAVGNVAGQLSSVLGGGNSSSSSSGVAYTQSSRSHRYNVEDSITSSKNIDSLYVKIKRNLKFKTREEALSGLSGYERQRYESLLDEEGHAHEATPGVYYHMANSYVGGRKIDITLAKEDGKVRISWIASSNESDFAQFVKSEVIKAIK

SEQ ID NO: 4871 - DNA, 555 bp, Haemophilus influenzae
  Name: NTH2716
atgataaaactgaccccttcatcaattggagtgatggttgatacgcttagatattcaggtcgagatagatatattatttttagaatgaaaacgagagagcagaaagtcgtgtatatgcgttatccacagcatattgaaaatatggctaatcaagagaacatgattgtcatcgtagatgctcaaaagtttctttctttatggcagcgatcaccgtatgaggtagataaaaatacatgtgcgggcgatgagtcaacatggagaaaagattataagtttcatcatgctgaaaacggatttgctaaaagtatggattctccagttccacttgcagatgtaaatgttcatattaaagatggagaaataagctgtagtcttaatgatggtatgacaagaacgctttggttgcttgcaaatggtgtaaaggagtttcctattttggttagaaaccataaagagaaagctaaaattctgtcaaagtatgcaagcccattatcttcacttcattttgagccacttaatttattttttgcaattacaggagaaaaataccccttg

SEQ ID NO: 4872 - protein, 185 aa, Haemophilus influenzae
  Name: NTH2716
MIKLTPSSIGVMVDTLRYSGRDRYIIFRMKTREQKVVYMRYPQHIENMANQENMIVIVDAQKFLSLWQRSPYEVDKNTCAGDESTWRKDYKFHHAENGFAKSMDSPVPLADVNVHIKDGEISCSLNDGMTRTLWLLANGVKEFPILVRNHKEKAKILSKYASPLSSLHFEPLNLFFAITGEKYPL

SEQ ID NO: 4873 - DNA, 2058 bp, Haemophilus influenzae
  Name: NTH2717
atgagagaaaacatcatgaaattatttttatgtgaaaaaccatcacaaggcaatgatattgcaaaagtattaggtgcgacaaagcgtggtgagggttgtttatcaacacctgacggtcagcttacagttacctggggaattggtcatctagtagagcaatttaatcctgaagaatatgatcctgcctttaaaaagtgggcatttgagaccttgccaattatcccgggtaaatgggggctttcacctaaaaaagaaacaaaaaaacagttcaatgtcgtcatgaaacttatcaaacaagctaaacttgttgtcattgcaaccgatattgatagagagggcgaaactatagcaagagaattgctggatttggcaggatttcgagggcaaataaaacgcctttggttgtctgcactagatgataccagtattcgcaaagccttgggcgcacttaaaaataatgaggagacactacctctttactatgcgggacttgcacgtagtcgagctgattggcttattggtatgaatttctctcgtctctataccttattagcgcaacaacaagggtatcaagggaaacctttaagtgttggtcgggtacaaactccaacattaagcttggttgttaatcgtgaccgtgagataaaaaacttcattcctaagcaacattttgctttgcaagtaatgctttctgatggaaatcagcattttgctacgcaatatgttattccggagcaatattgtgatcctgatggactttgtttgtctgcccaagttatacaagcagcaaatcagcaaattcgccaatttggccaagcgaaagtggaatcagttgaaactaaacgtgaaagacaaaatgccccactttgctttgcattaagtgacttacaatcagaagctaaccgcctttatggactgggtgcgcaaagagtattggatatagctcaatcactttatgagactcacaaagcgacaacctatcctagaacagattgtggttatttaccggagtctcagtttgcagaagcgcctcaaattatccaatgtttgttgcaatccgataatcgattacacccccttgcaggtatgttaaaccttaatcaaaaatcacgagtttggaatgataaaaaaattactgctcaccatggcattattccgactatgattaaagctgatattagcaaaatgtctgatgaagaattaaagctctatgatctcatacgtcgtcgttatttagctcaattcttacctgtttctgaaacagataagacacaaattattttgaagtgcggtcaacatatattaagtgcacgtgggaatgtgcttattgctccaggttggaaaattctatttggcaaatcacttgatgaagatgatgacgcacctcaagccttgccgacgttaaagcaaggacaaatctgtcagatttctgattcagaaataaaaaccttacaaacatcaccacctaatcacttcacggaaggtacattgctcaccgcaatgaaaaatgcagctcgctttgtaactgatgagcgtttaaaacaacgcttacgagaaactgaagggcttggaacagaagctactcgggcgggaacgattcaaggtttgattgataaaggtttcttgaaaaagaaaggtaaatcactattagcgacagatgaagcaatgacgctaattgataatttacctcagatgttaaaagatccgggtttaaccgcactttgggagcaagcgctcaatcaaattgctgaaagaacgctttcgctagaagtgtttatgcaaaaacaagaagtctttgtgcggcatttgatggctgattgccttaaaaagggaatgagtttggggaatattgaaattcgtaaatgccctaagtgcggtgcaccaatgattaaaagaaatggtaaaaatggggctttttttgggtgttctgcttatccaaattgccaacatattgaaaatattgatagcaagaagaatactaaaagtacaaaaaatttaaagaaaaagtcgagtaaaagtgtgagtgagcaaatttcatctttacgaagcttattgaac

SEQ ID NO: 4874 - protein, 686 aa, Haemophilus influenzae
  Name: NTH2717
MRENIMKLFLCEKPSQGNDIAKVLGATKRGEGCLSTPDGQLTVTWGIGHLVEQFNPEEYDPAFKKWAFETLPIIPGKWGLSPKKETKKQFNVVMKLIKQAKLVVIATDIDREGETIARELLDLAGFRGQIKRLWLSALDDTSIRKALGALKNNEETLPLYYAGLARSRADWLIGMNFSRLYTLLAQQQGYQGKPLSVGRVQTPTLSLVVNRDREIKNFIPKQHFALQVMLSDGNQHFATQYVIPEQYCDPDGLCLSAQVIQAANQQIRQFGQAKVESVETKRERQNAPLCFALSDLQSEANRLYGLGAQRVLDIAQSLYETHKATTYPRTDCGYLPESQFAEAPQIIQCLLQSDNRLHPLAGMLNLNQKSRVWNDKKITAHHGIIPTMIKADISKMSDEELKLYDLIRRRYLAQFLPVSETDKTQIILKCGQHILSARGNVLIAPGWKILFGKSLDEDDDAPQALPTLKQGQICQISDSEIKTLQTSPPNHFTEGTLLTAMKNAARFVTDERLKQRLRETEGLGTEATRAGTIQGLIDKGFLKKKGKSLLATDEAMTLIDNLPQMLKDPGLTALWEQALNQIAERTLSLEVFMQKQEVFVRHLMADCLKKGMSLGNIEIRKCPKCGAPMIKRNGKNGAFFGCSAYPNCQHIENIDSKKNTKSTKNLKKKSSKSVSEQISSLRSLLN

SEQ ID NO: 4875 - DNA, 426 bp, Haemophilus influenzae
  Name: NTH2718
atgtctactcaaaacgcacaaccaaaatatttcaatcttcatacttctggcattggttatttaagcgatattcgcgaaatcaagccgaaaaaaggagatgcattttgggcttgtcgaattgctgctcttacaggttcttccgattctccggaatatcgtttttttgatatgaacgtatccggtgaagaaactgtaaatttaatcaaacgctgtcaagaagctgttgaagctaagaaaaaagtcttggtttcctttgtaatgagtgatttgtggtatgacacattcacttattcaaaagatagcgaatatcacaaaaaaggtgatactggcgtgtcgattaaaggacgactctatcgtattaactttattaaagttgatggtgagttgaaatatcaagcaaaacgccaagatgagcaagggaatgac

SEQ ID NO: 4876 - protein, 142 aa, Haemophilus influenzae
  Name: NTH2718
MSTQNAQPKYFNLHTSGIGYLSDIREIKPKKGDAFWACRIAALTGSSDSPEYRFFDMNVSGEETVNLIKRCQEAVEAKKKVLVSFVMSDLWYDTFTYSKDSEYHKKGDTGVSIKGRLYRINFIKVDGELKYQAKRQDEQGND

SEQ ID NO: 4877 - DNA, 90 bp, Haemophilus influenzae
  Name: NTH2719
atgaaagccaacaacaaaatttgttggctttttctttaccctgaaggggaaactccccttatgggtggtttctccttttttatttctatt

SEQ ID NO: 4878 - protein, 30 aa, Haemophilus influenzae
  Name: NTH2719
MKANNKICWLFLYPEGETPLMGGFSFFISI

SEQ ID NO: 4879 - DNA, 678 bp, Haemophilus influenzae
  Name: NTH2720
gtggtttctccttttttatttctatttgaggagaaacctatgaatacttacgctaaattttgccctaatgtttttgttgctaaatgtccggatgctcaccaaaaaggtgacgttatcatcttaaccagtaaatacggtaaagagactgaagtggagattcataatctcgtaaaaacctctgaggatgcgtatttttattccttcacccggtgtgatggagtgaatagtcaagttcgtgcagaacaaaaagctgagcgttatcaaaacgcagctaataatgcattaaaacgcagtgaacaatattgtgaagctgctaatgaaggccgtgaatttcttagcttgggagaaccaattaaaattggtcatcatagcgaaaaacgccatagagccttgattgaacgtaatgcaagacgcatggataagtctattgaagaaatgcgtaaagcagaaagttatgacggtaaaatcgcttattgggaacagatggcagggaaaattgatttatccatgccggaaagtcttgagttcttcaagtttgaattggaaaaagccaaagaaaaacaccaagagcttaaagataaacctgaattgcgaacacatgctttttctctcacttatgctaaaaaagcagtcaatgagcttgagaaaaaagtaaaattagccgaattactttgggcg

SEQ ID NO: 4880 - protein, 226 aa, Haemophilus influenzae
  Name: NTH2720
VVSPFLFLFEEKPMNTYAKFCPNVFVAKCPDAHQKGDVIILTSKYGKETEVEIHNLVKTSEDAYFYSFTRCDGVNSQVRAEQKAERYQNAANNALKRSEQYCEAANEGREFLSLGEPIKIGHHSEKRHRALIERNARRMDKSIEEMRKAESYDGKIAYWEQMAGKIDLSMPESLEFFKFELEKAKEKHQELKDKPELRTHAFSLTYAKKAVNELEKKVKLAELLWA

SEQ ID NO: 4881 - DNA, 417 bp, Haemophilus influenzae
  Name: NTH2721
ttggagaaatatatgttttactatgtaaatagtggattagagctaattactttaacaacgcaagagtttataagtgagtttctaggaaaggcaactacccctaaagggattgagccaaatcatttctatgatcctcaaaccaagctagtttatgcatggtactctggcaaatgtgtagcaacttctgagtaccaatatacacctcaagaagcagaagctttacttgttgaattggcattggaaaatgctagtaataatggggatggatcaattatgttccaaccttcgccaacaaaagaagcactaattgctgatatgagtaattatttggaatattgtatagatgatgaatctgagcacgatttagaatttgcagcaaaaattaaacagattatcgacagtttaaaaacttctgat

SEQ ID NO: 4882 - protein, 139 aa, Haemophilus influenzae
  Name: NTH2721
LEKYMFYYVNSGLELITLTTQEFISEFLGKATTPKGIEPNHFYDPQTKLVYAWYSGKCVATSEYQYTPQEAEALLVELALENASNNGDGSIMFQPSPTKEALIADMSNYLEYCIDDESEHDLEFAAKIKQIIDSLKTSD

SEQ ID NO: 4883 - DNA, 468 bp, Haemophilus influenzae
  Name: NTH2722
atgtttaaattaaacgagcaacaacaagctattttagaacaggcacaggttattttaactaaagtgatggaagaaaagcccttttaccaaggtgcacaggaatttactgagccatcaatagctaaactctattttcaaaccattataggtaatgaggaaagagaaaatttcgtggtacttttcttggatagaatccacagattgattaaatctgaggtgatgtttcaaggatctgtttcagaaacttctgtgtcaattcgggagattattcgacaagcattaaagctaaatgcatcagcaattatcattgggcacaatcatccaactggaaatgttgagcctagtgatgctgataaatatataaccaagagattaaaggaagcttgtgaattaatggatattaaattacttgatcactttatcgtttctggttcagcatctttttgctttactgataatcatcttatt

SEQ ID NO: 4884 - protein, 156 aa, Haemophilus influenzae
  Name: NTH2722
MFKLNEQQQAILEQAQVILTKVMEEKPFYQGAQEFTEPSIAKLYFQTIIGNEERENFVVLFLDRIHRLIKSEVMFQGSVSETSVSIREIIRQALKLNASAIIIGHNHPTGNVEPSDADKYITKRLKEACELMDIKLLDHFIVSGSASFCFTDNHLI

SEQ ID NO: 4885 - DNA, 594 bp, Haemophilus influenzae
  Name: NTH2723
atgtgtaaggaaaatcgtattttagaacttggaaaaatcttcgtctctcgtcgtatcttagcggaattaactaccgaaaagatcaatgaggtcatctcgtggcatcaaaatggctgcattatcatgctggggaataaagattggattgaaaaaccgccacatccgctttcagaaattgttatgaatttctatcaagcagataatggtaaagacaccattcaactctctacttcagtagatgatgacgggaatcgaacaactaagatttctttttctgatgaaagtgaagatgagcaaagaggacactttgattgggatatatatcaatcaaaaagaacaccacttaagttaggggatgtttcgtgtactatctgcgctaaacagttattgggaatgccaaccattcatcgcttaattgaaaaacaattaggttatgattggggtgctacctgcgttgaagattggattgaaaacgatcatgccgtagagaaggataaacgcattgtgagccagcattttattgatggcgaaagtgtttttgtcatcactgaagcagatcgtagttctacaacgattatgctcggatatgaatat

SEQ ID NO: 4886 - protein, 198 aa, Haemophilus influenzae
  Name: NTH2723
MCKENRILELGKIFVSRRILAELTTEKINEVISWHQNGCIIMLGNKDWIEKPPHPLSEIVMNFYQADNGKDTIQLSTSVDDDGNRTTKISFSDESEDEQRGHFDWDIYQSKRTPLKLGDVSCTICAKQLLGMPTIHRLIEKQLGYDWGATCVEDWIENDHAVEKDKRIVSQHFIDGESVFVITEADRSSTTIMLGYEY

SEQ ID NO: 4887 - DNA, 666 bp, Haemophilus influenzae
  Name: NTH2724
atgataaataaaactctttttaacagtataacgatgccttatttaacttcttcacaaactgaatgcctaaaatggttagctcttatcacgatgattatcgatcacattggtgtggctttttcaaatgcttacccagccctatcctggtgtcgggtgataggtcgattttcctacgtggcgtttggatttatcatcgcgcttaatttatctcgagataaagtaaactttaaaagttatttcacttggatgatagcaaccgcatttttatctgaaatcagttttacgcttttcgagcctaattatgaccgtttaaatgtcctatttcagtttttgtctgtaatcggggtaatatgggtatataaaaaccgtcaagacttaaatagctgggtcatgttttttggattgggcttttttattattctttccgcactctctgattatggtttacctgggcttttatattgcattggttgttacctattcttgcaaacaaaagatactcaatttcgtcttattacgatgctaacctgtgtattgctcgcacttttcgtcaatcacagttttattgataatttcggggaaactattgttgaaacaatcagtgttgttactgttgtggtcggtacaatgatatttattcttcaccctaaagggccttcgtcaatg

SEQ ID NO: 4888 - protein, 222 aa, Haemophilus influenzae
  Name: NTH2724
MINKTLFNSITMPYLTSSQTECLKWLALITMIIDHIGVAFSNAYPALSWCRVIGRFSYVAFGFIIALNLSRDKVNFKSYFTWMIATAFLSEISFTLFEPNYDRLNVLFQFLSVIGVIWVYKNRQDLNSWVMFFGLGFFIILSALSDYGLPGLLYCIGCYLFLQTKDTQFRLITMLTCVLLALFVNHSFIDNFGETIVETISVVTVVVGTMIFILHPKGPSSM

SEQ ID NO: 4889 - DNA, 681 bp, Haemophilus influenzae
  Name: NTH2725
gtgagagttatccatattaaggcattatttaaataccttaattggagcctcatcatgaaaaaatttctattaaccacttttgcattggttgtgctttcaggttgtgcacataaacaacaaacagccgatgagcaacaagcactagaaaatccaaatattcaacaaggtcagcatcaagttttacaaccggaagatcgaattgttcgtccggatatttacacagactatcagcctgaacgtacagaagtgttacgtgaaggtcgatacactttaattaatttctctccagaagaaggtcaaaaataccttctagaccaaagtgtcactgtcaacatgttaggtaaaaagaaacgagccttaacggcaaccgttgagcagggattacgcacgacgttaaaagatacaggcctttcactttgtcatggttttggtcagaatgaaccaacactttctacgctttattcccgtccattaccaaaagtacattatcaatttggcccgatggctttacgtgatgcccttcaaatgttagcagggccggcttatgaaattactatcaatgacgtttctcgtaccgtttgttttaaattacgcccagctgtaccggaacgtgctacaggggaaaagccgaaagtagaaaccacaacaacgacaacaactacaacagaaatcatcgaggaa

SEQ ID NO: 4890 - protein, 227 aa, Haemophilus influenzae
  Name: NTH2725
VRVIHIKALFKYLNWSLIMKKFLLTTFALVVLSGCAHKQQTADEQQALENPNIQQGQHQVLQPEDRIVRPDIYTDYQPERTEVLREGRYTLINFSPEEGQKYLLDQSVTVNMLGKKKRALTATVEQGLRTTLKDTGLSLCHGFGQNEPTLSTLYSRPLPKVHYQFGPMALRDALQMLAGPAYEITINDVSRTVCFKLRPAVPERATGEKPKVETTTTTTTTTEIIEE

SEQ ID NO: 4891 - DNA, 738 bp, Haemophilus influenzae
  Name: NTH2726
atgaatcatgtcaaaaaaatatcctatgtggcgatgatattagggatgttttctactgctgtatttgctgaagtcactgcggctaatacacttgctactcaatccctcaatcaacaaaacttggtgacaaataaattaaatcaacaagagttattagctaagtctcaagagtggggtttaactgagcaagaatggcaacgctaccaagagcttaatcaaggtgctcgtggtatatggtcgccaggtcttgaccctttaacctcgcttggtgtggagtctcgaaatgagcaggaaagagagcgttatgctcgactactggcaaaaaaaatgcacgaccgcatggagagagagctgcagttccaacgcacttatgatcgcgtatttgctgaaatgtatccaaatgagcaaccatttaaggttgaacctcatatttcagagcggtttggacgggtgatttattttactcgcctagaaaattgtgacaaatgtgaagcgaatgctgatcgtgtactgcaatatgtgaatgataaaacgcctatagatatttattttgttggcgtgaataataatgagcaaatctataattgggcgaaaaaacataacatcgacccaaataaagtgaatagaaaattaattacccttaatcatgataatggagcctggttacagtatgcagatggcaaaatgcctgctgcattccaaattcaacaggatgggcaatggcaacaaatcgtctat

SEQ ID NO: 4892 - protein, 246 aa, Haemophilus influenzae
  Name: NTH2726
MNHVKKISYVAMILGMFSTAVFAEVTAANTLATQSLNQQNLVTNKLNQQELLAKSQEWGLTEQEWQRYQELNQGARGIWSPGLDPLTSLGVESRNEQERERYARLLAKKMHDRMERELQFQRTYDRVFAEMYPNEQPFKVEPHISERFGRVIYFTRLENCDKCEANADRVLQYVNDKTPIDIYFVGVNNNEQIYNWAKKHNIDPNKVNRKLITLNHDNGAWLQYADGKMPAAFQIQQDGQWQQIVY

SEQ ID NO: 4893 - DNA, 699 bp, Haemophilus influenzae
  Name: NTH2727
atggcaacaaatcgtctattaaaaatcgtatttagcttaatcggtcttggcgttgcgactcactccgttgcatttaatggctttggaactgatattgatggctatattaaagatgcatctaatcgctaccaggtcgatgaagcgatgctacgtgggttagtaaaaattgaagatgggtggtatggaaatgtttccccaaccggggcaaccggtgtggggcaatttacccggggcacctggaattggcttgcaacaactgatgaggggcgagccttaggtatgactcaaatcactcgttacaatcgtgatacacctttcgaccctagaaaaaacaatcaacttaacactctagcaaccgcacttttagctagatggcatattaatcagttttttgagcgaggcataaaaccatcccatgaaaatttatatcttgctcataatatcggtatagatggtttacatcgagcgctacaaggtagagcaacacgtgaagatattctaaatatgaagcgtaacgggatgaaaaaaggaatgtcggtacaaggctttcttgtttatcaaagtgagcgttttaatgtcagtaaacaaatagctaacttccagcgcccttcagtatcaccacgttatcaaattgagaataaaccattaccagccaatttacattgggtttctcccaacagaaaccgctatgcgttgggt

SEQ ID NO: 4894 - protein, 233 aa, Haemophilus influenzae
  Name: NTH2727
MATNRLLKIVFSLIGLGVATHSVAFNGFGTDIDGYIKDASNRYQVDEAMLRGLVKIEDGWYGNVSPTGATGVGQFTRGTWNWLATTDEGRALGMTQITRYNRDTPFDPRKNNQLNTLATALLARWHINQFFERGIKPSHENLYLAHNIGIDGLHRALQGRATREDILNMKRNGMKKGMSVQGFLVYQSERFNVSKQIANFQRPSVSPRYQIENKPLPANLHWVSPNRNRYALG

SEQ ID NO: 4895 - DNA, 366 bp, Haemophilus influenzae
  Name: NTH2729
atggttcaagcctaccctaatagcgttccttcaacattgaccgaagcggatattttacctgttatctcacatagaatgacaccgggccaaatacaaccagtcagaatgaatcttcctggaatgttgcctatttttcttattggaacagataacttatctaaaaattggctacacgctaattataattaccttaaaaaaattggtgcaatgggacttgtagtaagcgttaaaacaacaaacgaattaagcgagttacgccaattagcaccggatttaaccttaatgccaacgccaggggatgacttagcttcaagattaaatcttgctcactaccctgctttattgacttcagaaggattgtcgcaa

SEQ ID NO: 4896 - protein, 122 aa, Haemophilus influenzae
  Name: NTH2729
MVQAYPNSVPSTLTEADILPVISHRMTPGQIQPVRMNLPGMLPIFLIGTDNLSKNWLHANYNYLKKIGAMGLVVSVKTTNELSELRQLAPDLTLMPTPGDDLASRLNLAHYPALLTSEGLSQ

SEQ ID NO: 4897 - DNA, 531 bp, Haemophilus influenzae
  n 487, 526, 527, 528, 529, 530: n is any nucleotide
  Name: NTH2730
atgagtcaaaaacatgtattagaaggtttacttagaccgcctgttgaattttttccagctgccgtccatggtacttgtgctttggtttgttgcggtgcgccttggtcgctcgcattaaatcctcttattggatatggattaggggccgctttcgcaggtatgggggttatgcgttttcgtcaaggcatggaaattgtacgctatcaccgaaatttacgcagactccctcactatgctttgaccagtcgtcaaattccagtaagtaaaaaagccttgttcttaggacgaggctttgaatgggaaccaaagcatacgcaacgtctttatgactgtttctctgcaaatgggcaaatttattggaaaaatgggaagtggtttaaagccgctcgtgattatgaaaaagtgcatgataattggttatctagactcacttcaatggactctccattaaatccagtcagaccgctaccgccagttggcggcattnccagtgatgcatgggtaccgagtcgatattcgataacannnnnt

SEQ ID NO: 4898 - protein, 177 aa, Haemophilus influenzae
  Xaa 163, 176, 177: Xaa is any amino acid
  Name: NTH2730
MSQKHVLEGLLRPPVEFFPAAVHGTCALVCCGAPWSLALNPLIGYGLGAAFAGMGVMRFRQGMEIVRYHRNLRRLPHYALTSRQIPVSKKALFLGRGFEWEPKHTQRLYDCFSANGQIYWKNGKWFKAARDYEKVHDNWLSRLTSMDSPLNPVRPLPPVGGIXSDAWVPSRYSITXX

SEQ ID NO: 4899 - DNA, 666 bp, Haemophilus influenzae
  Name: NTH2731
ttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatcccgtgggcg

SEQ ID NO: 4900 - protein, 222 aa, Haemophilus influenzae
  Name: NTH2731
LHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIPWA

SEQ ID NO: 4901 - DNA, 255 bp, Haemophilus influenzae
  n 246, 247, 248, 249, 250: n is any nucleotide
  Name: NTH2732
atgcgaaatccgattcataaacgcttagaaaacttagacagttggcaacatcttacttttatggctgctttatgtgaacgtatggcaccaaattttaaattgttctgtcaaatgaacgagcttagcgttgaaaccaaaacgtatcaaaatattctcaatttggtgtgggaatatttaacaattaaagatgtcaaaatcaacttgaaatcagttggagaaagggtaccgagtccgaatcgtaaacannnnnttaat

SEQ ID NO: 4902 - protein, 85 aa, Haemophilus influenzae
  Xaa 82, 83, 84: Xaa is any amino acid
  Name: NTH2732
MRNPIHKRLENLDSWQHLTFMAALCERMAPNFKLFCQMNELSVETKTYQNILNLVWEYLTIKDVKINLKSVGERVPSPNRKXXXN

SEQ ID NO: 4903 - DNA, 450 bp, Haemophilus influenzae
  Name: NTH2733
gtgcaatgtaatcactgggggtatcaaacttatcctgtgatttgcccatcaaatattgttgcggttcgtcgtggtcacgaaaatctattggcaaatcataagcgacattatagtcctaacggaggaatatacacgacgcttgcaggttttgtcgaagtaggggaaacatttgaacaagcggtgcagagagaggtttttgaagaaacagggatttcaataaaaaatcttcgttatttcggtagccaaccttgggcatttccaaattctcaaatggtcggttttctggctgattatgaaagcggagaaataacattgcaggaaagtgaaattcatgatgcacaatggttttcttatgatcaacccttgccagaattaccgccaacgggtactatcgctcgcaaattaattcatgtgacgcttgaactttgtaaagcggaacataaatgcgat

SEQ ID NO: 4904 - protein, 150 aa, Haemophilus influenzae
  Name: NTH2733
VQCNHWGYQTYPVICPSNIVAVRRGHENLLANHKRHYSPNGGIYTTLAGFVEVGETFEQAVQREVFEETGISIKNLRYFGSQPWAFPNSQMVGFLADYESGEITLQESEIHDAQWFSYDQPLPELPPTGTIARKLIHVTLELCKAEHKCD

SEQ ID NO: 4905 - DNA, 510 bp, Haemophilus influenzae
  Name: NTH2735
gtgttcttctctggcttaatttctgtgctttactatctcggcattatgcaagtcgtgattaaagtattaggtggcgcattacaaaaagcattgggtacgtcaaaagcggaatcaatgtcagcggcggcgaatatcttcgtcggtcaaactgaagcaccattagttgttcgcccttacattaaaaatatgacccaatctgaattatttgccattatggtgggtggtacagcgtctattgcgggttcagtaatggcaggttatgctggaatgggcgtgccattgacatacttaatcgctgcgtcatttatggcggcaccagcaggtttattatttgcgaaattaatgttcccacaaaccgaacaattcacagataaacaaccagaagacaatgattcagaaaaaccaactaacgtacttgaagcaatggcgggcggtgcgagtgcaggtatgcaacttgcgttaaacgtaggtgcaatgttaatcgcattcggttggtttaattgcattaat

SEQ ID NO: 4906 - protein, 170 aa, Haemophilus influenzae
  Name: NTH2735
VFFSGLISVLYYLGIMQVVIKVLGGALQKALGTSKAESMSAAANIFVGQTEAPLVVRPYIKNMTQSELFAIMVGGTASIAGSVMAGYAGMGVPLTYLIAASFMAAPAGLLFAKLMFPQTEQFTDKQPEDNDSEKPTNVLEAMAGGASAGMQLALNVGAMLIAFGWFNCIN

SEQ ID NO: 4907 - DNA, 840 bp, Haemophilus influenzae
  Name: NTH2736
ttgatcgataaaattcaatatttacacgacggttttgataataaagcaaaagagtttgcaaatatcttaaaaatgggtcgtacccaattgcaagatgcggtgccaatgactgttggtcaagaattcaaagctttctccgtattacttgaagaagaagtgcgtaacttaaaacgtacagcaggtttattacttgaagtaaaccttggtgcgactgcaatcggtactggtttaaatacgccacaaggctatacagaattagttgtaaaacaccttgctgaagtgactggattagcttgtgtaccagcagaaaacttaattgaagcaacatctgactgtggtgcttatgtcatggttcacggtgcattaaaacgtactgcagtgaaactttctaaagtatgtaatgacttacgtttactttcttctggccctcgtgcaggtttaaaagaaattaatcttcctgaattacaagcaggttcttctattatgccagcaaaagtaaacccagttgttccagaggtggtaaaccaagtgtgctttaaagtaattggtaacgataccactgtgactttcgcatctgaagctggtcaattacaattaaacgtaatggaaccagtgattggtcaagcaatgttcgaatctatcgacatcttaaccaatgcttgtgtgaacttacgcgataaatgcgtggatggcatcactgtaaacaaagaaatttgtgaaaactacgtgtttaattcaatcggtatcgtgacttacttaaatccatttattggtcaccacaacggcgacttagtgggtaaaatctggcgcaaacaggtaaaggcgtaccgtgaggtgtgg

SEQ ID NO: 4908 - protein, 280 aa, Haemophilus influenzae
  Name: NTH2736
LIDKIQYLHDGFDNKAKEFANILKMGRTQLQDAVPMTVGQEFKAFSVLLEEEVRNLKRTAGLLLEVNLGATAIGTGLNTPQGYTELVVKHLAEVTGLACVPAENLIEATSDCGAYVMVHGALKRTAVKLSKVCNDLRLLSSGPRAGLKEINLPELQAGSSIMPAKVNPVVPEVVNQVCFKVIGNDTTVTFASEAGQLQLNVMEPVIGQAMFESIDILTNACVNLRDKCVDGITVNKEICENYVFNSIGIVTYLNPFIGHHNGDLVGKIWRKQVKAYREVW

SEQ ID NO: 4909 - DNA, 111 bp, Haemophilus influenzae
  Name: NTH2737
ttgtttaaagcgggtgctaaagggtacatatgtgttcctgtcagacaattattggcaaaaggcggtattcttaatttttccgttgaatatggagaatcaacaaaaacgggt

SEQ ID NO: 4910 - protein, 37 aa, Haemophilus influenzae
  Name: NTH2737
LFKAGAKGYICVPVRQLLAKGGILNFSVEYGESTKTG

SEQ ID NO: 4911 - DNA, 708 bp, Haemophilus influenzae
  Name: NTH2738
gtggtgttgatggcaggttttactgcgggtaatgaaaaaggcgagttggtattgctcggtcgtaatggctcagactattctgccgcctgttttagccgcttgtttaggcgcaagtgtatgcgaatttggcccgatgtgggcggcgtttatacttgcgatccgcgtttagtgcctgatgcacgtttattaccaacgctttcttatcgtgaagcgatggaactctcttatttcggtgcgaaagtgattcatcctcgtacgattgggccattgttgccacaaaatattccttgtgtcattaaaaatacaggaaatccttctgcgccaggttcgattattgatggcaatgtgaaatcagaaagtttgcaagttaaaggtatcactaacttagacaatttggcgatgtttaatgtgtcaggccccggtatgcaaggtatggtaggcatggcatctcgcgtattttcagccatgtcaggcgcaggcatttcagttattttaattactcagtcttcgtctgaatatagtattagtttctgtgtgcctgtgaaatctgcagaagtagcgaaaaccgtactagaaacggagtttgctaatgaattaaatgaacatcaattagaatcaattgaagtgattaaagatttatccattatttctgttgtgggcgatggaatgaagcaagcgaaaggcattgctgctcgttcttctcggcat

SEQ ID NO: 4912 - protein, 236 aa, Haemophilus influenzae
  Name: NTH2738
VVLMAGFTAGNEKGELVLLGRNGSDYSAACFSRLFRRKCMRIWPDVGGVYTCDPRLVPDARLLPTLSYREAMELSYFGAKVIHPRTIGPLLPQNIPCVIKNTGNPSAPGSIIDGNVKSESLQVKGITNLDNLAMFNVSGPGMQGMVGMASRVFSAMSGAGISVILITQSSSEYSISFCVPVKSAEVAKTVLETEFANELNEHQLESIEVIKDLSIISVVGDGMKQAKGIAARSSRH

SEQ ID NO: 4913 - DNA, 951 bp, Haemophilus influenzae
  Name: NTH2739
atgacaacacagttagattcacttcgtaatatgaccgtcgtcgtagctgatactggcgatattgatgcaatcaaaaaataccaaccacaagatgcaacaacaaacccatctttaattttaagtgcttcagcattaccacaatacgccccattaattgatgaagcggttgcttatgcaaaagctcaaagcaatgataaagcacagcaacttattgatgcagaagataaattagcggtaaatattggtttagaaattttaaaaatcgttccagggcgtatttctactgaagtggatgcgcgtctttcttacaacacacaagcaacggttgaaaaagcgcgtaaattaatcgcactttataatgcagcaggcatctcaaatgatcgtattttgattaaaatcgcttccacatggcaaggtatccgagctgcagaaatccttgaaaaagaaggcattaactgtaacttaaccttattattctctgaagctcaagctcgtgcttgtgcagaagcaggcgtttacttaatttctccatttgtaggtcgtattttagactggtacaaagcaaactccgacaaaaaagaatatgcgccagcagaagatccaggcgttatttctgtcaccaaaatctacaattactacaaagaatatggctacaatacagttgtgatgggcgcaagtttccgtaatgtaggcgaaattactgaacttgcaggttgcgatcgcttaaccattgcaccagcattactgaaagaattacaagaaaattcaaccgcacttatacgcaaactagaatacaaaggcgaagtaaaagcgaaaccacaaccattaacagaagctgagttctactggcaacataacagcgatgctatggctgttgaaaaattagcagagggtattcgtaaatttgctattgaccaagaaaaattggaaaccatgctttcagcaaaactt

SEQ ID NO: 4914 - protein, 317 aa, Haemophilus influenzae
  Name: NTH2739
MTTQLDSLRNMTVVVADTGDIDAIKKYQPQDATTNPSLILSASALPQYAPLIDEAVAYAKAQSNDKAQQLIDAEDKLAVNIGLEILKIVPGRISTEVDARLSYNTQATVEKARKLIALYNAAGISNDRILIKIASTWQGIRAAEILEKEGINCNLTLLFSEAQARACAEAGVYLISPFVGRILDWYKANSDKKEYAPAEDPGVISVTKIYNYYKEYGYNTVVMGASFRNVGEITELAGCDRLTIAPALLKELQENSTALIRKLEYKGEVKAKPQPLTEAEFYWQHNSDAMAVEKLAEGIRKFAIDQEKLETMLSAKL

SEQ ID NO: 4915 - DNA, 651 bp, Haemophilus influenzae
  n 497: n is any nucleotide
  Name: NTH2740
gtggaaaatcttatggcaattaaaattggtatcaatggttttggtcgtatcggccgtatcgtattccgtgcagcacaacatcgtgatgacattgaagttgtaggtattaacgacttaatcgacgttgaatacatggcttatatgttgaaatatgattcaactcacggtcgtttcgacggcactgttgaagtgaaagatggtaacttagtggttaatggtaaaactatccgtgtcactgcagaacgtgatccagcaaacttaaactggggtgcaatcggtgttgatatcgctgttgaagcgactggtttattcttaactgatgaaactgctcgtaaacatatcactgcaggcgcaaaaaaagttgtattaactggcccatctaaagatgcaacccctatgttcgttcgtggtgtatacttcaacgcatacgcaggtcaagatatcgtttctaacgcatcttggacaacagactgtttagctcctttagcacgtgttgntcatgagactttcggtatgaaagatgggttaatgaccactgttcacgctgcgactgcaactgttataattgcggatggttccatcatcctaaagactggcgtggatgctcgccttgtttttccaagacatcatttaatttttaccaggtgcagg

SEQ ID NO: 4916 - protein, 217 aa, Haemophilus influenzae
  Xaa 166: Xaa is any amino acid
  Name: NTH2740
VENLMAIKIGINGFGRIGRIVFRAAQHRDDIEVVGINDLIDVEYMAYMLKYDSTHGRFDGTVEVKDGNLVVNGKTIRVTAERDPANLNWGAIGVDIAVEATGLFLTDETARKHITAGAKKVVLTGPSKDATPMFVRGVYFNAYAGQDIVSNASWTTDCLAPLARVXHETFGMKDGLMTTVHAATATVIIADGSIILKTGVDARLVFPRHHLIFTRCR

SEQ ID NO: 4917 - DNA, 102 bp, Haemophilus influenzae
  Name: NTH2741
gtgttccgtttgaaaattgatacattgggtggcgatgtaattagctctgaaatattaaaatatgatgcagaattggattcaaaaaacacccgtttgaattat

SEQ ID NO: 4918 - protein, 34 aa, Haemophilus influenzae
  Name: NTH2741
VFRLKIDTLGGDVISSEILKYDAELDSKNTRLNY

SEQ ID NO: 4919 - DNA, 612 bp, Haemophilus influenzae
  n 19, 599, 600, 601, 602, 603: n is any nucleotide
  Name: NTH2742
ttggtaaaaacggtattgnatactcgttctggtcgtgcgcaatatcaaattgaaggcgataattttaaattagcagaggggcaagaatctctttctgtaccgcttctttttgaaaaagatggcgtaacttatcaaaaaatctttgtgttaaaacgtggtagctatgatttaggcgtagattacaagattgataaccaaagtggtcaagccattgaagttgagccttatggtcaattgaagcattctattattgaaagctctggtaatgttgcaatgcctacttatactggcggtgcatattcttcttcagaaactaactataaaaaatatagttttgctgatatgcaagataataatctttctattgatactaaagctggttgggttgcagtgttacaacattatttcgtttctgcgtggatcccaaatcaagatgtaaataatcaactttataccattacagatagtaaaaataatgttgcatcaattggttatcgtggtcctgttgtcactattcctgctggtagccaagagacgattacaagttcattgtggactggccctaaacttcaaaatcaaatggcaactgtcgcaaatannnnnttaattaat

SEQ ID NO: 4920 - protein, 204 aa, Haemophilus influenzae
  Xaa 7, 200, 201: Xaa is any amino acid
  Name: NTH2742
LVKTVLXTRSGRAQYQIEGDNFKLAEGQESLSVPLLFEKDGVTYQKIFVLKRGSYDLGVDYKIDNQSGQAIEVEPYGQLKHSIIESSGNVAMPTYTGGAYSSSETNYKKYSFADMQDNNLSIDTKAGWVAVLQHYFVSAWIPNQDVNNQLYTITDSKNNVASIGYRGPVVTIPAGSQETITSSLWTGPKLQNQMATVANXXLIN

SEQ ID NO: 4921 - DNA, 798 bp, Haemophilus influenzae
  n 793, 794, 795, 796, 797: n is any nucleotide
  Name: NTH2743
ttggggcaattattttgcgatgagggtgcagaacaaatcgttgaaatgctgaaatctgaatgcgataaatatggtgctaagattttattgcgtagcgaagtttctcaagttgaacggattcaaaatgatgaaaaagtgcggtttgttttacaggtaaattcaacccaatggcaatgtaaaaatttgattgttgcgacaggtgggctttctatgcctgggcttggcgcaacgccatttggttatcaaattgcggaacaatttggcattcctgttattccgcctcgtgcgagtttagtgccttttacttatcgagaaacagataaatttttaaccgcactttcaggtattagcttgcctgtcactatcacggcactgtgcggaaaatctttttacaaccagcttttgtttactcatcgtggtatttcaggccctgcggtgttacaaatttctaattattggcagcccactgagtcagtggaaatcgatttattaccgaaccacaatgtggaagaggaaattaatcaagcaaaacaacattcaccaaaacaaatgttgaaaaccatcttggttcgattattgccgaaaaaattggtcgaactttggattgaacaaggcattgtgcaagatgaagttagcgctaacatcagcaaagtgcgggtaaaaaatctggtggattttattcatcactgggaatttactccaaatggcacagagggctatcgtacagctgaagtcacaatgggtggggtggatactaaagtatttcttctaaaacaatggaaagcaaccaagnnnnnt

SEQ ID NO: 4922 - protein, 266 aa, Haemophilus influenzae
  Xaa 265, 266: Xaa is any amino acid
  Name: NTH2743
LGQLFCDEGAEQIVEMLKSECDKYGAKILLRSEVSQVERIQNDEKVRFVLQVNSTQWQCKNLIVATGGLSMPGLGATPFGYQIAEQFGIPVIPPRASLVPFTYRETDKFLTALSGISLPVTITALCGKSFYNQLLFTHRGISGPAVLQISNYWQPTESVEIDLLPNHNVEEEINQAKQHSPKQMLKTILVRLLPKKLVELWIEQGIVQDEVSANISKVRVKNLVDFIHHWEFTPNGTEGYRTAEVTMGGVDTKVFLLKQWKATKXX

SEQ ID NO: 4923 - DNA, 177 bp, Haemophilus influenzae
  Name: NTH2744
atgtcgggcggtggttttgtatttcaccatttagaggtacgccagctcatatctttcgcaaaatcctcatttcgtcaaatcggcactagctcgttataccaactgggattttatttctttagtggcggagcaagggattacttatcacgaaaaggaattggggcaattattttgcga

SEQ ID NO: 4924 - protein, 59 aa, Haemophilus influenzae
  Name: NTH2744
MSGGGFVFHHLEVRQLISFAKSSFRQIGTSSLYQLGFYFFSGGARDYLSRKGIGAIILR

SEQ ID NO: 4925 - DNA, 687 bp, Haemophilus influenzae
  Name: NTH2745
atggaatttaacaatgatggtctccaattattcaaacaaaatcaaccgcactttgtaggcaatcgcttattagtgaatggtattgaagcaccatatttagatgttgcacggggttggattcgtttacgtttgctcaatgcctcattagcgcgtgcttatgatttacgcttggataatgatcaagaaatgctacttattgcacaagatttaagtttcttacccaaagcgaaatcagtcaaatctttggttctctcgccaggagaacgcgcagaaatactggttaatatgaatgaaattgacaacgtatctctcattagcggaagtaaacgtagcttgtacgaaaaaataaaaaatatgttgttctcaggcgatgaactcgctaataacaccgtccttgaattacgtgctcaaggacaactatccgcatttaacaaacaaccgaatctaactttcgaaacggatgcaccagcaatattacaacaagccgttgcacaaactcgagaatttaatattgatgtcacaaacggtttaattaatcaaagacgttttgacccgcgcaaggttgatgttatggctcgtaaaggcaccattgaacgctggattttaaatgcaagtttacctgttggatttactattcaaggtgccaaatttgttggtggaaagccaaggagaacatcaattacaagc

SEQ ID NO: 4926 - protein, 229 aa, Haemophilus influenzae
  Name: NTH2745
MEFNNDGLQLFKQNQPHFVGNRLLVNGIEAPYLDVARGWIRLRLLNASLARAYDLRLDNDQEMLLIAQDLSFLPKAKSVKSLVLSPGERAEILVNMNEIDNVSLISGSKRSLYEKIKNMLFSGDELANNTVLELRAQGQLSAFNKQPNLTFETDAPAILQQAVAQTREFNIDVTNGLINQRRFDPRKVDVMARKGTIERWILNASLPVGFTIQGAKFVGGKPRRTSITS

SEQ ID NO: 4927 - DNA, 501 bp, Haemophilus influenzae
  Name: NTH2747
gtgcaacgtgatttacttccgttagtggaaggctcgacagttagcaccaagcacggaatggttaaaactgatcatatcttatttattgcatctggtgcattccaagttgctcgtccttcagatttaatccctgaactacaagggcgtttgccgattcgtgttgaacttaccgcattaagtgcggcggatttcgagcgcattttaacagaacctcacgcctctttaaccgaacaatataaagccttgatggcaacagaaggggtgaatattgaatttacaacagaggcggttaagaaaattgctgaggctgcattccgagtgaatgaaaaaacggaaaatatcggtgcacgtcgtttacatacggtaatggaacgtttgatggataaaatttctttcagcgcaagcgatatgaatggtcaaacggtcaatattgatgcggcttatgttgcggatgcacttggcgaagtggttgaaaatgaagatttgagccgttttattctt

SEQ ID NO: 4928 - protein, 167 aa, Haemophilus influenzae
  Name: NTH2747
VQRDLLPLVEGSTVSTKHGMVKTDHILFIASGAFQVARPSDLIPELQGRLPIRVELTALSAADFERILTEPHASLTEQYKALMATEGVNIEFTTEAVKKIAEAAFRVNEKTENIGARRLHTVMERLMDKISFSASDMNGQTVNIDAAYVADALGEVVENEDLSRFIL

SEQ ID NO: 4929 - DNA, 282 bp, Haemophilus influenzae
  n 18, 62, 86, 168: n is any nucleotide
  Name: NTH2748
gtgcaattggatatttgnaatgttcagctatttagcgcagaaggaaatcaattctctcaatntgtgatccaaaagaaggcgcaatnttctggatggataatatgctatccgaattccgctcaaaacgtggaagggcgtatagttcatcgacttttacttcgccctganaatgcaaaaattgttatcgaacgcatgggcttttctatgccaaataatggggcgaaaacattgctaagcgcggaagttgctaatgatccaaattatttccaccagcggaagaag

SEQ ID NO: 4930 - protein, 94 aa, Haemophilus influenzae
  Xaa 6, 21, 29, 56: Xaa is any amino acid
  Name: NTH2748
VQLDIXNVQLFSAEGNQFSQXVIQKKAQXSGWIICYPNSAQNVEGRIVHRLLLRPXNAKIVIERMGFSMPNNGAKTLLSAEVANDPNYFHQRKK

SEQ ID NO: 4931 - DNA, 861 bp, Haemophilus influenzae
  n 35, 151: n is any nucleotide
  Name: NTH2749
atggtggctagaattttgcatcggcagcgtgtgancatatcaagggcaggcagagaattagatggacaggtttttactctttgcatggggttagttggtatacgctttggtttggatttactcggagaaagtcagcataattcaagtgtancttatagcatattagttgttggtattctgttactcgtaacttattgtggctatgctaaaaacaatgaaaatgccattttacctttatcccttttccgaactcgtacattcagattaggtattattgctaatatttttatccgattatctgcatctggtgtgccctttttattgcctttgatgttccaattatctttcggttacagtgctgaaatgtctggctggctattagcaccgattgcgttaatttctgtgatgttgaaaatattaattggacgaattttaaatcgttggggttataaaaccacgttaatttcatccgcacttttgatggcaggttctgtgatttcaatggcttggttagataaacaaagctctctaacttggattatttgtaatcttatgtggtatggggcttgtatgtcgatcatttttacttcaattaatacgctggctgtaggcgatctttcaaaacaacagtctggcacaggctctaccgtattaagtattgtacagcaagttgggattggatttggtattgctgtgtcatcaataatcttaaatctttatcgacatttctttaacgcaagtgattgcttacaacaggcattcagctatacttttttaacttcatcactttttgtaatcgcccttgtttggtcgcttatgaaattacacaaaaatgatggcgatcatttacgaaaaatgcct

SEQ ID NO: 4932 - protein, 287 aa, Haemophilus influenzae
  Xaa 12, 51: Xaa is any amino acid
  Name: NTH2749
MVARILHRQRVXISRAGRELDGQVFTLCMGLVGIRFGLDLLGESQHNSSVXYSILVVGILLLVTYCGYAKNNENAILPLSLFRTRTFRLGIIANIFIRLSASGVPFLLPLMFQLSFGYSAEMSGWLLAPIALISVMLKILIGRILNRWGYKTTLISSALLMAGSVISMAWLDKQSSLTWIICNLMWYGACMSIIFTSINTLAVGDLSKQQSGTGSTVLSIVQQVGIGFGIAVSSIILNLYRHFFNASDCLQQAFSYTFLTSSLFVIALVWSLMKLHKNDGDHLRKMP

SEQ ID NO: 4933 - DNA, 975 bp, Haemophilus influenzae
  n 966, 967, 968, 969, 970: n is any nucleotide
  Name: NTH2750
atgaagggaatggatggtgatgcagccttacgggcgatctcgtcagagaaaacaaagagtgaaaagtatagcgggggcgatgtacagaagttctatatctatcaagcaaatcagcttggagcaaaccttactggcgatatgatgatgcatatcagatgcacaaggttcaaaagcacccattgctcgattgctgacaaagttgcttccgtgtttgttcctgtcgttttagtgattcacttgtactttcgcactcactatattctgacgaatgatagtgtgtcttcactaattcacgcggtatccgtgcttgtgattgcttgcccttgtgccttgggattagccacaccagcagccataatggttggtttaggtaaagcagtcaatgctggcgtatggtttaaagatgcggctgcaatggaggaaaccgcccacgtggataccgttgtacttgataaaactggcacattaacaaaaggagagcttgaaatctctgctttatggcagccacaaagtgcggtgtattctgaagacgatttgtatcgttttgcagcagcagttgaacgacaagctaaccacccaattgcaaaagctattgtgcaagcagcagaacaaaaaatgttagaaattcccaccgcacttttttcaaagatggaagtgggtcaaggcattcaagccgaattagaacaagtgggaacaataaaagtcggtaaacctgattattgcggtttaatcttgcctaaaaatttagaggatatttggcaaattgcgagcattgtcgcagtatccataaatgatgaacccatcggtgcatatgcactgacggatactttaaaaaacgatagcttgcacgccattcaacgcttacaacagcaaaatattgatgtcgtaattatgagtggcgatcaacaatttgtcgttgattacatagcaaaacaggccgggtaccgagtcgatatcgtatacagnnnnnttaat

SEQ ID NO: 4934 - protein, 325 aa, Haemophilus influenzae
  Xaa 322, 323, 324: Xaa is any amino acid
  Name: NTH2750
MKGMDGDAALRAISSEKTKSEKYSGGDVQKFYIYQANQLGANLTGDMMMHIRCTRFKSTHCSIADKVASVFVPVVLVIHLYFRTHYILTNDSVSSLIHAVSVLVIACPCALGLATPAAIMVGLGKAVNAGVWFKDAAAMEETAHVDTVVLDKTGTLTKGELEISALWQPQSAVYSEDDLYRFAAAVERQANHPIAKAIVQAAEQKMLEIPTALFSKMEVGQGIQAELEQVGTIKVGKPDYCGLILPKNLEDIWQIASIVAVSINDEPIGAYALTDTLKNDSLHAIQRLQQQNIDVVIMSGDQQFVVDYIAKQAGYRVDIVYXXXN

SEQ ID NO: 4935 - DNA, 1047 bp, Haemophilus influenzae
  Name: NTH2751
atgttgaaagaaacatattgtggctcaattggcttggagtttatgcacgtgcaggatatggagcagaaaatgtggctccagagcaagatggaaagcctgttagataaaccgctttttacatctgaagaacgtgtcaattttcttcgtgaactgacagctgcagacggtttagaacgttatcttggtgcgaaattccctggggcgaaacgcttttctttagaaggaagtgatgcgtttattccattgatgaaagaaattattcgccattctagtcgtcaaggggtaaatgatgtggtaatgggaatggcacaccgtgggcgtttgaatatgctcgtgaatgtattaggtaaaaagcctgaaaatttattcgatgaatttgcaggtaaacattccagcgaacgtacgggggatgtgaaatatcatcaaggtttttcttctgattttgccgtagatgataagagagtccacttaacgttggcatttaatccatctcatttggaaatcgtaagccctgttgtgattggttctgttcgatctcgacaaactcgtatgaatgatacagaacatagcaaagtgcttgctattactgttcacggagattcagctgtggcaggacagggggttgttcaagaaacattgaatatgtcaaatgcccgtggttacagtgtgggcggtactattcgcatcgtgattaataaccaaattggttttacgacatctaatccgaatgacacgcgctctacagaatattgcaccgatattgcgaaaatgattcaagcaccgattattcatgttaatggcgatgatcctgaagcggtggcatttactgcgcgtatggcggtggaatatcgtaatttattcaaacgagatatttttattgatttaatttcttatcgtcgccatggccataacgaggcagatgaaccattagccactcaaccaatgatgtatagcatcatcaaaaaacatcctacaccgcgtaaagtttatgcagatcgcttagttttcagaggcgtgatgactgaagacaagtacccggatggcgaa

SEQ ID NO: 4936 - protein, 349 aa, Haemophilus influenzae
  Name: NTH2751
MLKETYCGSIGLEFMHVQDMEQKMWLQSKMESLLDKPLFTSEERVNFLRELTAADGLERYLGAKFPGAKRFSLEGSDAFIPLMKEIIRHSSRQGVNDVVMGMAHRGRLNMLVNVLGKKPENLFDEFAGKHSSERTGDVKYHQGFSSDFAVDDKRVHLTLAFNPSHLEIVSPVVIGSVRSRQTRMNDTEHSKVLAITVHGDSAVAGQGVVQETLNMSNARGYSVGGTIRIVINNQIGFTTSNPNDTRSTEYCTDIAKMIQAPIIHVNGDDPEAVAFTARMAVEYRNLFKRDIFIDLISYRRHGHNEADEPLATQPMMYSIIKKHPTPRKVYADRLVFRGVMTEDKYPDGE

SEQ ID NO: 4937 - DNA, 102 bp, Haemophilus influenzae
  Name: NTH2752
atggcgaatgattatcgcgatgcgctagataatggcgatcgcgtggtatctgaatggcgagaaatggatcggccaaaatgggttgggttgcatatcccattt

SEQ ID NO: 4938 - protein, 34 aa, Haemophilus influenzae
  Name: NTH2752
MANDYRDALDNGDRVVSEWREMDRPKWVGLHIPF

SEQ ID NO: 4939 - DNA, 561 bp, Haemophilus influenzae
  n 548, 549, 550, 551, 552: n is any nucleotide
  Name: NTH2753
gtgatttacgtcaggttagatttgaagtgcaacatcaaaaaaatcactaacccagcattattaactgaagtgcagcaatttgtgcaacaatgctatatcccggctcgtcaaaaattacaaacaagccaacttgccttgagtccggcacaaatccgcgaaacatcctggttaggtggtaaattgcttattaataacagcgagctctaccctcgttttagggctcagcaacctattagcacgttcccttatgatgcaaatcgagatgcggcattacctaattcgggaaaaggtggtttcccaagttgtgatcaatggtgggatgaaagtggagctggattaaaatctcgcttacttacagatatgcgtcaaaacttatctgcccaggtgagtgatttctttaactctatcgacaaccaagatgaagctttattgagaacacttttacgctctgaaaacatagatgtttcaaaagggaaaatgtatcaaggttacggtggtagcgtggatgctggattttggaatgcggttactcgactcactcaactgtnnnnnttaattaat

SEQ ID NO: 4940 - protein, 187 aa, Haemophilus influenzae
  Xaa 183, 184: Xaa is any amino acid
  Name: NTH2753
VIYVRLDLKCNIKKITNPALLTEVQQFVQQCYIPARQKLQTSQLALSPAQIRETSWLGGKLLINNSELYPRFRAQQPISTFPYDANRDAALPNSGKGGFPSCDQWWDESGAGLKSRLLTDMRQNLSAQVSDFFNSIDNQDEALLRTLLRSENIDVSKGKMYQGYGGSVDAGFWNAVTRLTQLXXLIN

SEQ ID NO: 4941 - DNA, 618 bp, Haemophilus influenzae
  n 605, 606, 607, 608, 609: n is any nucleotide
  Name: NTH2754
gtgaaattaattgcaaccttaggtatggcagcattgctgtctggctgttcaatgtttgatagtcaacaatccgcaattccagcggaatttgctggggctgattaccaactttccgatcaacatgcaaaacaatgggcgattgcaagtaagcaagtagaacaatgcgtttacccaaatttaactcgaattttgcaacagcatttttcaaaagaagatagctatattcactcacaatatgtctttttctatccgttggaaaaaattattggcgaacaatatgtgaagattatccaagccgatgaaaaatcaatgaattatgcaagctatcagtttaaaaaattccgtaccaaagtgagcaatgttgaacctttagctaaacagtcttgtttgaagttgcgtaacgaagcgcacgatgatttggctgtcgtgaaaggtcaatataaaaatggtatggtggaagtgcaaaaaaatgaagatggcacaccaaaaaattttgatggcattgcaaccaatcaaaataaattattctttgatattatcaaatggggatcgtatgttgttactttagtactaaaattggatgcaataaaaaaccgcaggggatnnnnnttaattaat

SEQ ID NO: 4942 - protein, 206 aa, Haemophilus influenzae
  Xaa 202, 203: Xaa is any amino acid
  Name: NTH2754
VKLIATLGMAALLSGCSMFDSQQSAIPAEFAGADYQLSDQHAKQWAIASKQVEQCVYPNLTRILQQHFSKEDSYIHSQYVFFYPLEKIIGEQYVKIIQADEKSMNYASYQFKKFRTKVSNVEPLAKQSCLKLRNEAHDDLAVVKGQYKNGMVEVQKNEDGTPKNFDGIATNQNKLFFDIIKWGSYVVTLVLKLDAIKNRRGXXLIN

SEQ ID NO: 4943 - DNA, 114 bp, Haemophilus influenzae
  Name: NTH2755
atggtatacgaatatcggactcggtacccacttggtatggcatcaccaaatcgagtcattctctcttttgtattaattgcggtattgatttccgtgatgttatttaatgaaaag

SEQ ID NO: 4944 - protein, 38 aa, Haemophilus influenzae
  Name: NTH2755
MVYEYRTRYPLGMASPNRVILSFVLIAVLISVMLFNEK

SEQ ID NO: 4945 - DNA, 651 bp, Haemophilus influenzae
  Name: NTH2756
gtgatgttaaaaatcacagaatggcttgtttatccgttagtcttaattttatttgttctttctatttacttaattcctgaatggaatagtgccgtattatatgaatttccaacaacaggtggtttcttaaccactttatggctaaccattcccgtattagtattttcatttaaccattcgccagcgacttcatcgttcacttgctcacaattccgtgaatacaaaacgtttgagggtgcagaacgccatatcagccatacagaaaaaggcgcttcaacgattttattattcttcgtaatgttcttcgtatttagctgtgtattaacactaacacctgaagaattagtggcagcaaaagaacagaatattagtatcttgtctttcttagcaaataaatttgataatccatatatctcttattttggcccgcttgttgcattcttagcgattacaagttcattcttcggtcactatatgggggcacgtgaaggattagaaggcttatatttgaaaatgaaaggcgaatctgtaaatcgtaaaaaactcaattatgcgaccgcacttttcttcttattaaccttatggggcgttgcgattattaatccaagtatcttaggcttaattgaatctcttggcgccccatcattgcga

SEQ ID NO: 4946 - protein, 217 aa, Haemophilus influenzae
  Name: NTH2756
VMLKITEWLVYPLVLILFVLSIYLIPEWNSAVLYEFPTTGGFLTTLWLTIPVLVFSFNHSPATSSFTCSQFREYKTFEGAERHISHTEKGASTILLFFVMFFVFSCVLTLTPEELVAAKEQNISILSFLANKFDNPYISYFGPLVAFLAITSSFFGHYMGAREGLEGLYLKMKGESVNRKKLNYATALFFLLTLWGVAIINPSILGLIESLGAPSLR

SEQ ID NO: 4947 - DNA, 291 bp, Haemophilus influenzae
  n 148, 282, 283, 284, 285, 286: n is any nucleotide
  Name: NTH2757
ttgaaaaggttgtatatgattcaaaaattatttttattagttcgttcgttggtcattttatctattatgttatatctcggaaatcttattgcttattacattccatcaggtgttccaggaagtatttggggattgttattgctctttntaggtttaacaacacgagtgattcatttaaattggatttatttaggcgcaagtttgctaattcgttttatggcggtactttttgtaccagtgagcgtgggaattatcaaatattctgatttattgatagagcannnnnttaat

SEQ ID NO: 4948 - protein, 97 aa, Haemophilus influenzae
  Xaa 50, 94, 95, 96: Xaa is any amino acid
  Name: NTH2757
LKRLYMIQKLFLLVRSLVILSIMLYLGNLIAYYIPSGVPGSIWGLLLLFXGLTTRVIHLNWIYLGASLLIRFMAVLFVPVSVGIIKYSDLLIEXXXN

SEQ ID NO: 4949 - DNA, 225 bp, Haemophilus influenzae
  n 212, 213, 214, 215, 216: n is any nucleotide
  Name: NTH2758
atgataaatcgaaaaatactattggcgagtttattacttatttttaccgtactttctgcttgttctcgcgaaaaaaatacgtgtcgtgtggttaaaattagtgatggcgatacgctcacttgcctcactaaaggcaataaatccattaaagttcgtttagccgaaattgatgcgccagaaaaatctcaagccttgggcaaaaatcgaaaaannnnnttaattaat

SEQ ID NO: 4950 - protein, 75 aa, Haemophilus influenzae
  Xaa 71, 72: Xaa is any amino acid
  Name: NTH2758
MINRKILLASLLLIFTVLSACSREKNTCRVVKISDGDTLTCLTKGNKSIKVRLAEIDAPEKSQALGKNRKXXLIN

SEQ ID NO: 4951 - DNA, 192 bp, Haemophilus influenzae
  n 179, 180, 181, 182, 183: n is any nucleotide
  Name: NTH2759
atgaaaatacttcaacaagatgattttggttattggttgcttacacaaggttctaatctgtatttagtgaataatgaattgccttttggtatcgctaaagatatcgatttggaaggattacaggcaatgcaaatggagaaggaaaatctaccgggtaccgagtccgaattcgataacannnnnttaattaat

SEQ ID NO: 4952 - protein, 64 aa, Haemophilus influenzae
  Xaa 60, 61: Xaa is any amino acid
  Name: NTH2759
MKILQQDDFGYWLLTQGSNLYLVNNELPFGIAKDIDLEGLQAMQMEKENLPGTESEFDNXXLIN

SEQ ID NO: 4953 - DNA, 432 bp, Haemophilus influenzae
  Name: NTH2761
gtggaagaaagcgatattgaaatgaaatataatactttttctgcatttattgatgaagtgagtttgcctttcttagaagaagcagaaattgattatgttaccgaagagcttggtgcgcaactgaccttaaaagcaccgaatgccaaaatgcgtaaggtggctgatgatgcgccattgattgaacgtgttgaatatgtaattcaaactcaaattaacccacagcttgcaaatcacggtggacgtataaccttaattgaaattactgaagatggttacgcagttttacaatttggtggtggctgtaacggttgttcaatggtggatgttacgttaaaagatggcgtagaaaaacaacttgttagcttattcccgaatgaattaaaaggtgcaaaagatataactgagcatcaacgtggcgaacattcttattat

SEQ ID NO: 4954 - protein, 144 aa, Haemophilus influenzae
  Name: NTH2761
VEESDIEMKYNTFSAFIDEVSLPFLEEAEIDYVTEELGAQLTLKAPNAKMRKVADDAPLIERVEYVIQTQINPQLANHGGRITLIEITEDGYAVLQFGGGCNGCSMVDVTLKDGVEKQLVSLFPNELKGAKDITEHQRGEHSYY

SEQ ID NO: 4955 - DNA, 153 bp, Haemophilus influenzae
  Name: NTH2762
atgggagatggttggacagtaaaaaccaaagatcgcagccattcagcacaatacgaacatcaacttgttgtcacggaaactggttgtgaagtaatgactatccgcgatgaagaaattgcagaaggtcgaatttcgcggattatggtgaatgtg

SEQ ID NO: 4956 - protein, 51 aa, Haemophilus influenzae
  Name: NTH2762
MGDGWTVKTKDRSHSAQYEHQLVVTETGCEVMTIRDEEIAEGRISRIMVNV

SEQ ID NO: 4957 - DNA, 1029 bp, Haemophilus influenzae
  Name: NTH2763
atgctgttttctccgacactatcttctcctttaacgccaagtgcggtcaaaattgaacgagaaaatctcaagcaatttgagctcgagaatttttctcgttattccatttttgagcttattgaaaatcgctgtgatttttatgatgccttattgattcaactttggcaggaaatagaattaagtgaacaactggggattgctttaattgcggtgggcggttatggacggcgtgagatgtttcctttgtcggatttagattttttgattttagtcgagcaaaccccaagccctgagattgaagaaaagattactcaatttatccagtttttatgggattgcggttttgaggtgggaaatagtgttcgaaccttagaacaatgcgaatcggaagggaaacaagatattacgattgccaccaatttattagaagcaagatttcttgctggaaatcgaccgcactttgatgcattaaatgaattggtaaaacgtgcagatttttggtcgaaagaagatttttttaatgccaaagtgcaagagcaaatagaacgttatcagcgttatcacaatacggcttataaccttgagccagatattaagtacagccctggaggcttgcgtgatttgcatttgttgtattgggtggcgttgcgccattctggggctttgacccttgaggctattttacaaagtggttttatttatcctcaagaatatcagcaactacaagaaagtcgtgcatttttatttaaagtgcggttcgctttgcatttgattttgaaacgttacgataatcgtctgttgtttgatcgtcaaattaaagtcagtgaattattgggtttccgaggggaaggcaatccagctgtggaaaaaatgatgaaatgttctttccaagcattgcaccgaatttcgctgattagtaatttactgattcagcattatcgagaaaatgtgctttcatcaaatcaggatactgtaattgaccaattagacgatgattcccaactgattaaccaatgcccatgtttcgcg

SEQ ID NO: 4958 - protein, 343 aa, Haemophilus influenzae
  Name: NTH2763
MLFSPTLSSPLTPSAVKIERENLKQFELENFSRYSIFELIENRCDFYDALLIQLWQEIELSEQLGIALIAVGGYGRREMFPLSDLDFLILVEQTPSPEIEEKITQFIQFLWDCGFEVGNSVRTLEQCESEGKQDITIATNLLEARFLAGNRPHFDALNELVKRADFWSKEDFFNAKVQEQIERYQRYHNTAYNLEPDIKYSPGGLRDLHLLYWVALRHSGALTLEAILQSGFIYPQEYQQLQESRAFLFKVRFALHLILKRYDNRLLFDRQIKVSELLGFRGEGNPAVEKMMKCSFQALHRISLISNLLIQHYRENVLSSNQDTVIDQLDDDSQLINQCPCFA

SEQ ID NO: 4959 - DNA, 321 bp, Haemophilus influenzae
  Name: NTH2764
ttggcttttgcggtgggtctttcagttctcgtcccctatattggcgcagttattgtcacgattcctgttgcattggttgctttattccagtttggaatcagcccaacattttggtacatcattattgcttttgctgtaagccaacttttagatggaaatctccttgtgccttatttattttctgaagccgtcaatttacatccactaattattatcatttcagtattaatttttggcggtttatggggattttggggtgtattctttgccattcctttagccactttagtaaaggccgtaataaatgccttacctcaagat

SEQ ID NO: 4960 - protein, 107 aa, Haemophilus influenzae
  Name: NTH2764
LAFAVGLSVLVPYIGAVIVTIPVALVALFQFGISPTFWYIIIAFAVSQLLDGNLLVPYLFSEAVNLHPLIIIISVLIFGGLWGFWGVFFAIPLATLVKAVINALPQD

SEQ ID NO: 4961 - DNA, 846 bp, Haemophilus influenzae
  n 35: n is any nucleotide
  Name: NTH2765
atggtaatttctctattttttattattaccaaagnatttaactggggcttagattttactggtggagtggtatttgatactcacttctcgcagtccgctaaccttgaacaaattcgtagtaaacttcacgaaaatggaattgaaagtccagttgttcaaaccacaggatcggttcaggatgtgatgattcgtttacctgcaagtaataatgattctaccattggtgaacacgtcaaaagtatgctacagaatgtagataaagacattcaaattcgcagtattgagttcgttggcccaaatgttggtgaagaattagcacaaggtgcggtatatgcgactttagcgacattagcaatggtgcttatttatgtggggtcacgttttgaatggcgtttaggctttggcagtatcgcttctcttgcgcacgacgtaattattacgctaggggtattctctgcattacaaattgaaattgatcttacttttgtcgcagcgattttatctgtggtgggttactccatcaacgatagtattgtggtatttgaccgagttcgtgaaaatttccgaaaaattagacgattggatacgattgatattattgatatttctttaacgcaaactttatcaagaactatcattacttcggttactacattagttgtcgtgatggcattgttcttctttggtggtccttccattcataacttttcacttgctttactcgtaggtattggatttggtacttattcctcgatttttgttgccatcgccattgcatacgatgttggtttacgtcgtgaacatatgatcccacctaaagtagataaagaaattgatgaattacct

SEQ ID NO: 4962 - protein, 282 aa, Haemophilus influenzae
  Xaa 12: Xaa is any amino acid
  Name: NTH2765
MVISLFFIITKXFNWGLDFTGGVVFDTHFSQSANLEQIRSKLHENGIESPVVQTTGSVQDVMIRLPASNNDSTIGEHVKSMLQNVDKDIQIRSIEFVGPNVGEELAQGAVYATLATLAMVLIYVGSRFEWRLGFGSIASLAHDVIITLGVFSALQIEIDLTFVAAILSVVGYSINDSIVVFDRVRENFRKIRRLDTIDIIDISLTQTLSRTIITSVTTLVVVMALFFFGGPSIHNFSLALLVGIGFGTYSSIFVAIAIAYDVGLRREHMIPPKVDKEIDELP

SEQ ID NO: 4963 - DNA, 288 bp, Haemophilus influenzae
  Name: NTH2766
gtggatttccaaattctctatggagaaggcatttcaaaagcaggagaattattagaacttggtgtaaaacacaaacttgtagaaaaatcaggcgcatggtattcctataatggcgaaaaaattggtcaaggaaaggctaattcaatgaaatggcttaacgaaaatatagagaaatcagatgaattagaagctcgtttacgtgctgaattagtggccaatccagaacaagccttaatggcggatattgaacaatctgaaaataatactgaatcagaaagtgattttgaa

SEQ ID NO: 4964 - protein, 96 aa, Haemophilus influenzae
  Name: NTH2766
VDFQILYGEGISKAGELLELGVKHKLVEKSGAWYSYNGEKIGQGKANSMKWLNENIEKSDELEARLRAELVANPEQALMADIEQSENNTESESDFE

SEQ ID NO: 4965 - DNA, 456 bp, Haemophilus influenzae
  Name: NTH2768
ttgtcatctcttgcttttaattacatagttaatcttctttcccgcagagaatatagtgaattcgagctccgcaataaaatgcaggaaaagaacttttcggaagaagaaattgatgatgcattatctttatgccaagcaaaaaattggcaaagcgatcgtcgtttttcagaaaattatctaaattcacgctcacaaaaaggttgtggtgtaggaagaattcgacaagaattacgccaattaaaaggtgtgtcttctgatattattgatgaagttttaatggaatcagaaattgattggtatgaaatggctgagaacttgttacgtaaaaaattcccaaattataacgaacagcaaacgtctaaaatgaaacaaaaaatttggcaatatatgctatcacacggatttcgtagcgatgaatttgctgatttaattgggcaaaaccaaagtgaatgggat

SEQ ID NO: 4966 - protein, 152 aa, Haemophilus influenzae
  Name: NTH2768
LSSLAFNYIVNLLSRREYSEFELRNKMQEKNFSEEEIDDALSLCQAKNWQSDRRFSENYLNSRSQKGCGVGRIRQELRQLKGVSSDIIDEVLMESEIDWYEMAENLLRKKFPNYNEQQTSKMKQKIWQYMLSHGFRSDEFADLIGQNQSEWD

SEQ ID NO: 4967 - DNA, 333 bp, Haemophilus influenzae
  n 1: n is any nucleotide
  Name: NTH2769
ntgttcgattcggctcggtcccttattaatctttttttcctctttgcttttgggactttaatcgctaatttgcttggttgtttaattattggtgtattacttgggtttttttggcaatttccacaaattagttctgaatggcggttatttttaattacgggttttttaggatcgctaaccacattttcgtctttttcttccgaagttgtggaattattttttaatgacaagtggttaaatggattttgtgtattaatgatgcatttattcggatgtttagctatgactgtgttaggcatttggatatataaaatttgttctcaacttttatct

SEQ ID NO: 4968 - protein, 111 aa, Haemophilus influenzae
  Xaa 1: Xaa is any amino acid
  Name: NTH2769
XFDSARSLINLFFLFAFGTLIANLLGCLIIGVLLGFFWQFPQISSEWRLFLITGFLGSLTTFSSFSSEVVELFFNDKWLNGFCVLMMHLFGCLAMTVLGIWIYKICSQLLS

SEQ ID NO: 4969 - DNA, 309 bp, Haemophilus influenzae
  Name: NTH2770
ttgctgcctgcggtcgactctatgagaccccgtcatatcgcttttgctggagcaaccgaagtggcacaagatattggaatggattggctttctcaagatgtgacagcaaaattatctacacgtatcgctcaaggaattggtgtgggattactcactgctagattaggcgtgaaagcaatggaactttgtcgtccgttagcatttcaattaaacgaaaaaccaaaactctcacatattcaacaggaattacttagttcggtaaaagatattgttctcggtaaaaataaaatttacaaaaaggagcaaatc

SEQ ID NO: 4970 - protein, 103 aa, Haemophilus influenzae
  Name: NTH2770
LLPAVDSMRPRHIAFAGATEVAQDIGMDWLSQDVTAKLSTRIAQGIGVGLLTARLGVKAMELCRPLAFQLNEKPKLSHIQQELLSSVKDIVLGKNKIYKKEQI

SEQ ID NO: 4971 - DNA, 627 bp, Haemophilus influenzae
  Name: NTH2771
atggaaatcgaggttgtttatcaacatagcgattttattattatcaacaagtctgagggtattagcgttcataaagatcaagaagagcaaggcttaacagaacttgttgcaaaacaactgaatgtgcctaaagtatggttggttcatcgcttagataaagtaacttcaggtttgttaattctggcgttaaatgctgaaagtgcggctgaattttcacgacttttttctgaacataaaatacataaaacgtatctggcattaagtaaccaaaagcctaaaaagaaacaaggtttgattatcggggatatgaagaaatcccgagagggtgcatggaaactttgtcaaaccaaagaaaatccagcaattacacgttttgcaagtgtaagctgtgaacctaatttacgtttatttattttaaaaccacaaacggggaaaacgcatcaattacgtgttgcgatgaaaagtttaggtagcccgattttaggcgatgggctttatggtaaaaacacagaaaaaattgaccgcacttatttgcacgctactcaattggaatttgattatctaaatgattttatttcggtcacttgtttacctctcaaggtcaattttggattaagcctacagttt

SEQ ID NO: 4972 - protein, 209 aa, Haemophilus influenzae
  Name: NTH2771
MEIEVVYQHSDFIIINKSEGISVHKDQEEQGLTELVAKQLNVPKVWLVHRLDKVTSGLLILALNAESAAEFSRLFSEHKIHKTYLALSNQKPKKKQGLIIGDMKKSREGAWKLCQTKENPAITRFASVSCEPNLRLFILKPQTGKTHQLRVAMKSLGSPILGDGLYGKNTEKIDRTYLHATQLEFDYLNDFISVTCLPLKVNFGLSLQF

SEQ ID NO: 4973 - DNA, 489 bp, Haemophilus influenzae
  Name: NTH2772
ttgcttgttgagcaaggtaaagtacgtgctgatttatttcatcgcttaaatgttcttactcttaatgtgccgccattacgcgaacgcatgactgatattgagccactggcacaaggttttttacaggaaatcagcgaagaattaaaaattgcaaaaccaactttcgataaagattttcttctttatttgcagaaatatgactggaaagggaatgttcgtgagctttataacaccctttatcgtgcctgctctctggtacaagataatcatttgactatcgaaagtttaaatcttgctccgccacaaagtgcagtaatttctttggatgaatttggaaataaaaccttagatgaaatcatcggttcttatgaggcacaagttctaaaattattttatgcagaatatccaagcacgagaaaattggctcaacgtttaggcgtttcccatactgcgattgcgaataaattgaaacaatatggaattggaaaa

SEQ ID NO: 4974 - protein, 163 aa, Haemophilus influenzae
  Name: NTH2772
LLVEQGKVRADLFHRLNVLTLNVPPLRERMTDIEPLAQGFLQEISEELKIAKPTFDKDFLLYLQKYDWKGNVRELYNTLYRACSLVQDNHLTIESLNLAPPQSAVISLDEFGNKTLDEIIGSYEAQVLKLFYAEYPSTRKLAQRLGVSHTAIANKLKQYGIGK

SEQ ID NO: 4975 - DNA, 627 bp, Haemophilus influenzae
  Name: NTH2774
atgaaattatatggtttaattggtgcgtgttcatttgttccacatgtggcattagagtgggtaaaaatacgtgaaaatgctgattatgaatttgaacctgtcactcgtgagttaattaaatcacctgaatttttatcattgaatccacgcggggcagtacctgtattagttgatggcgatttagttctttcgcagaaccaagcgattttgcactatttagatgaactttatcctaattcaaaattatttggtagcaaaaccgtacgtgataaagccaaagcagctcgctggttagcattttttaattccgatgtgcataaatcatttgtgcctctgttccgtttgccaaactatgcaaaagataacgaaacacttgcacacactattcgccaacaagcagtagagcaaattttagatcaacttgcagtcgcaaatgagcatttagaaagtcacatttattttggagaagatatttccgttgcagatgcctatctttacattatgctcaattggtgtcgagcagtgggtatagatttcagccacttaacacaactttcggcttttatgcaacgtgttgagactgatcaagctgtcgaaaatgtgagaaaaagtgaagaactaaaagta

SEQ ID NO: 4976 - protein, 209 aa, Haemophilus influenzae
  Name: NTH2774
MKLYGLIGACSFVPHVALEWVKIRENADYEFEPVTRELIKSPEFLSLNPRGAVPVLVDGDLVLSQNQAILHYLDELYPNSKLFGSKTVRDKAKAARWLAFFNSDVHKSFVPLFRLPNYAKDNETLAHTIRQQAVEQILDQLAVANEHLESHIYFGEDISVADAYLYIMLNWCRAVGIDFSHLTQLSAFMQRVETDQAVENVRKSEELKV

SEQ ID NO: 4977 - DNA, 1245 bp, Haemophilus influenzae
  Name: NTH2775
atgcaaatcgaagcattatggcgtgataactggattgcaaataaggtttgtattaaacgttcggaagatatggtgcgtaattggcgcgatattttctcgaatgacttgaaatctgaacagctagacgagttcactaagctcgagcgcagattaaaactgcgtgagacattaactaaagcgttgcaatggtctagtttgtatggggcagtgggtttattacttgtcactgacacaattaacatcacttcgccattgcagcctacagaacgattaaagcggttgattatcttacctaaatggaaaatttcacctacaggacaacgagatgatgatgtgttttcgccaaactttggtcgatatagtgaatataccattattggcggcacacaatctgttttagtgcatcattcacgtttattaattatcaatgccaatgatgcacctttatctgataatgatgtttggggtgtgtcagactttgaaaagattattgatgtacttaaacgctttgatagtgcctcagcgaatgtcggcgaccttatttttgaaagtaaaatcgatattttcaaaattgcagggttatctgacaagatttcagctgggttagaaaatgatgtggctcacgttatttcagcggtgcagtcgattaaatcagcaaccaatagtctgttgcttgatgcggaaaatgagtacgaccgaaaagaattatcttttggtgggttaaaagatttattgacagagtttcgcaatgcggtggcaggtgcggcagatatgccagtcaccattttgtttgggcaatctgtttcgggattggcaagtggagatgaggatattcaaaactaccacgaatccattcatcgattgcaagaaacaagattgcgtcctgtgcttgaagtgcttgatacattactatgcaatgaattatttggtgggcaacctgatgactggtggtttgagtttttaccattgacggtggttaaacaagaacaacaagtcaatatgcttaatacctttgctacagcggcaaatacgttaattcaaaatggcgtagtaaatgaatatcaagtagcaaacgaactgcgcgaaagtggcttgtttgccaatatctccgctgaagacattgaggaaatgaaaaatgttattgaatttgccggaaattttgaagagccacgaaacacggaagaagccccagtttcagccagtgaagatgacccggagaacggcgctttggtattgacacagctt

SEQ ID NO: 4978 - protein, 415 aa, Haemophilus influenzae
  Name: NTH2775
MQIEALWRDNWIANKVCIKRSEDMVRNWRDIFSNDLKSEQLDEFTKLERRLKLRETLTKALQWSSLYGAVGLLLVTDTINITSPLQPTERLKRLIILPKWKISPTGQRDDDVFSPNFGRYSEYTIIGGTQSVLVHHSRLLIINANDAPLSDNDVWGVSDFEKIIDVLKRFDSASANVGDLIFESKIDIFKIAGLSDKISAGLENDVAHVISAVQSIKSATNSLLLDAENEYDRKELSFGGLKDLLTEFRNAVAGAADMPVTILFGQSVSGLASGDEDIQNYHESIHRLQETRLRPVLEVLDTLLCNELFGGQPDDWWFEFLPLTVVKQEQQVNMLNTFATAANTLIQNGVVNEYQVANELRESGLFANISAEDIEEMKNVIEFAGNFEEPRNTEEAPVSASEDDPENGALVLTQL

SEQ ID NO: 4979 - DNA, 933 bp, Haemophilus influenzae
  Name: NTH2776
atggaactcggtgtgggctttgctactgatggcggcgttcacggacaaataggctggacaaaaccttggattaatagccgtggacatagtttgcgttcaaatctttatctctctgcaccaaaacaaactctagaggcaacttatcgaatgccactgcttaaaaatccattaaattattactatgattttgccgtcggttgggaaggggaaaaagagaacgataccaatacgagagtgcttacgttgtcagcgttacgttattggaataatgcgcatggttggcaatattttggcggacttcgtacgcgatacgacagttttacacaagcggatatcactgataaaaccttacttctttatccaactgttggatttactcgtactcgattacgtggtggttcctttgccacttggggcgatgtgcaaaaaattacttttgatttaagcaaacgaatttggctatcagaatcttcttttataaaagtgcaagcatctagcgcgtgggttcgtacttatgcagaaaatcatcgtatcgttgctcgtgctgaaatcgggtatttacatacaaaaggtattgaaaaaattccgcctacactgcgtttctttgctggtggcgatcgtagtgtgcgcggttacggctataaaaaaattgcgcctaaaaataaaaacggaaaattagttggtggttcgcgattgcttaccgcttctttagaatatcaatatcaagtctatccaaattggtgggcggcaacttttgcagatagtggattagctgccgataattacacggcaaaagaattgcgttatggtgcaggcgttggtgtgcgttgggcatcgccagttggtgcgattaaatttgatattgccacacccattcgtgataaagataacagcaaaaatattcaattttacattggacttggtacagaaatt

SEQ ID NO: 4980 - protein, 311 aa, Haemophilus influenzae
  Name: NTH2776
MELGVGFATDGGVHGQIGWTKPWINSRGHSLRSNLYLSAPKQTLEATYRMPLLKNPLNYYYDFAVGWEGEKENDTNTRVLTLSALRYWNNAHGWQYFGGLRTRYDSFTQADITDKTLLLYPTVGFTRTRLRGGSFATWGDVQKITFDLSKRIWLSESSFIKVQASSAWVRTYAENHRIVARAEIGYLHTKGIEKIPPTLRFFAGGDRSVRGYGYKKIAPKNKNGKLVGGSRLLTASLEYQYQVYPNWWAATFADSGLAADNYTAKELRYGAGVGVRWASPVGAIKFDIATPIRDKDNSKNIQFYIGLGTEI

SEQ ID NO: 4981 - DNA, 870 bp, Haemophilus influenzae
  Name: NTH2777
atgctctatcaaattctcgcgctacttatttggagcagttcattaatcgtcggtaagctcacttattcgatgatggatcctgtgcttgttgtgcaagtgcggttaattattgcaatgattttggtaatgccactttttttgcgtcgttggaaaaaaatcgataaaccaatgcgtaaacaactttggtggttggcattctttaactataccgcggtctttttattacaatttattggtctgaaatacacctctgcgtctagtgccgttacgatgattgggctagaaccgctacttgttatatttgttggacatttcttttttaaagacaaagcaaaatggtttcactggctattcggcgcaatggcatttattggcgttgcaattttaatcaatggtggaaaaaataatgaaggcattgataatgttagtttattaggttgcttattagtgctaagcgcagggattatttttgcgactgtattacgttggacgcggcgagttgttgccaaagtttcaacgcaagtttacacatccatcagtattgttcttggtgttataacaacattaccttttaccttattactgacagaaaactggcaaatatcattaaattccacgggaattgtaggtttattatatcttgcgcttggttgtagctggcttgcttattggttatggcataaaggactcaataccgttgatgctaatatctctggtattttacttgcacttgaaccattattcggaatcttatttgccgtatcattacttggcgaaacgctgtcattttcagccgtacttggcataacaattattatggtagccacccttggcttgatgttactaccggaacttttgaaaaaatcggga

SEQ ID NO: 4982 - protein, 290 aa, Haemophilus influenzae
  Name: NTH2777
MLYQILALLIWSSSLIVGKLTYSMMDPVLVVQVRLIIAMILVMPLFLRRWKKIDKPMRKQLWWLAFFNYTAVFLLQFIGLKYTSASSAVTMIGLEPLLVIFVGHFFFKDKAKWFHWLFGAMAFIGVAILINGGKNNEGIDNVSLLGCLLVLSAGIIFATVLRWTRRVVAKVSTQVYTSISIVLGVITTLPFTLLLTENWQISLNSTGIVGLLYLALGCSWLAYWLWHKGLNTVDANISGILLALEPLFGILFAVSLLGETLSFSAVLGITIIMVATLGLMLLPELLKKSG

SEQ ID NO: 4983 - DNA, 270 bp, Haemophilus influenzae
  n 261, 262, 263, 264, 265: n is any nucleotide
  Name: NTH2778
gtgatctatcctttatgtcaccgacggttctatttgatgttccccttattattctgctgcctagctgaccgcagcactatatatttttccactttcgcattccctttcccatccccccttacccttcgttttattccttcccccccttttcattttcccctctcccccgttcttcccccccctcccccccatttgttttttttacctccctattcccccgtccttttttcttgttcccccccccctttatcctcccccccnnnnnttaat

SEQ ID NO: 4984 - protein, 90 aa, Haemophilus influenzae
  Xaa 88, 89: Xaa is any amino acid
  Name: NTH2778
VIYPLCHRRFYLMFPLLFCCLADRSTIYFSTFAFPFPSPLTLRFIPSPPFHFPLSPVLPPPPPHLFFLPPYSPVLFSCSPPPLSSPPXXN

SEQ ID NO: 4985 - DNA, 519 bp, Haemophilus influenzae
  Name: NTH2779
gtggtattggtaagtaaaggtaaaattagtaattatttctttggattgatttttgcctatacttatttttatgttgcttggggatcgaatttcttaggcgaaatgaacaccgtactttacgtatatttgccctctcaatttattggttactttatgtggaaagccaatatgcaaaatagcgatggtggagaaagcgtgattgcaaaagcattaactgttaaaggatggatgacattaattgttatgactacggttggcactttgctttttgttcaagcattacaagctgctggtggtagttcaacaggtttagatggtctaactacaattattacggttgcggcacagattttaatgattttacgttatcgtgaacagtggttgttatggattggattaaatattctttctattttcttatgggcagagacacctgcaatatacttaatgtattcagcctacttacttaactcgttgtatggttattataactggacgaaattagttaagcgtactaac

SEQ ID NO: 4986 - protein, 173 aa, Haemophilus influenzae
  Name: NTH2779
VVLVSKGKISNYFFGLIFAYTYFYVAWGSNFLGEMNTVLYVYLPSQFIGYFMWKANMQNSDGGESVIAKALTVKGWMTLIVMTTVGTLLFVQALQAAGGSSTGLDGLTTIITVAAQILMILRYREQWLLWIGLNILSIFLWAETPAIYLMYSAYLLNSLYGYYNWTKLVKRTN

SEQ ID NO: 4987 - DNA, 129 bp, Haemophilus influenzae
  Name: NTH2780
gtgccaaatcatccttggtttgtcgcttgtcaattccatccagaatttacttctacgcctcgtgatggtcatccgttgtttgcaggctttgtaaaagcagcctatgaaaatcacaaaaaatctgtgaag

SEQ ID NO: 4988 - protein, 43 aa, Haemophilus influenzae
  Name: NTH2780
VPNHPWFVACQFHPEFTSTPRDGHPLFAGFVKAAYENHKKSVK

SEQ ID NO: 4989 - DNA, 492 bp, Haemophilus influenzae
  n 319, 348, 353, 382: n is any nucleotide
  Name: NTH2781
ttgtggaagcaaggtattgttcacttcatagcgatgacgatgacgttcttcaatgggtttctttgccataaagctcacgagcgtggctacctgataccaaatgacattggttgtgcgcctaaacgcattgttccgccaagatctgattcatcggtacgcacttcagtattaccctccgcatcttgccattctgtgattaatgccaccacaggttgttcacaatctttatcaaattcagatgaattggctttagttaaacccgctacattacgtgcatattcatcaaatgcgatctgcatacctaagcaatacccagtanagggaatttttgttttctcggcatatggngcggnaccgaatttacctctacacacgataccanatccctggaacagatgcatcacgcctttatactcaaccctttggttcacatctggatcatatattatgctacttaaccggtgtaacccgcggtttaagctcattctgata

SEQ ID NO: 4990 - protein, 164 aa, Haemophilus influenzae
  Xaa 107, 118, 128: Xaa is any amino acid
  Name: NTH2781
LWKQGIVHFIAMTMTFFNGFLCHKAHERGYLIPNDIGCAPKRIVPPRSDSSVRTSVLPSASCHSVINATTGCSQSLSNSDELALVKPATLRAYSSNAICIPKQYPVXGIFVFSAYGAXPNLPLHTIPXPWNRCITPLYSTLWFTSGSYIMLLNRCNPRFKLILI

SEQ ID NO: 4991 - DNA, 414 bp, Haemophilus influenzae
  n 3, 122, 151, 156, 185: n is any nucleotide
  Name: NTH2782
gtnccgagctatatcagaatgagcttaaaccgcgggttacaccggttaagtagcataatatatgatccagatgtgaaccaaagggttgagtataaaggcgtgatgcatctgttccagggatntggtatcgtgtgtagaggtaaattcggtnccgcnccatatgccgagaaaacaaaaattccctntactgggtattgcttaggtatgcagatcgcatttgatgaatatgcacgtaatgtagcgggtttaactaaagccaattcatctgaatttgataaagattgtgaacaacctgtggtggcattaatcacagaatggcaagatgcggagggtaatactgaagtgcgtaccgatgaatcagatcttggcggaacaatgcgtttaggcgcacaaccaatgtcatttggtatcagg

SEQ ID NO: 4992 - protein, 138 aa, Haemophilus influenzae
  Xaa 41, 51, 62: Xaa is any amino acid
  Name: NTH2782
VPSYIRMSLNRGLHRLSSIIYDPDVNQRVEYKGVMHLFQGXGIVCRGKFGXAPYAEKTKIPXTGYCLGMQIAFDEYARNVAGLTKANSSEFDKDCEQPVVALITEWQDAEGNTEVRTDESDLGGTMRLGAQPMSFGIR

SEQ ID NO: 4993 - DNA, 438 bp, Haemophilus influenzae
  Name: NTH2783
atggaaatgaagaaagttattatcgaaatggttgatcggattcctggggggagaagtgcggtagctggattcctaggttttaccgaaagtgaattaaagaatcgtctttatcaaacaaagggtcagcgattcaaaaatgaagaattaattgcgattcagcaagaatatggctgcacgcaatttattgatgaactatgccgtttggctggtgggcgttttgtacctgatgtagcagagaatgaattagacaaggttgagcttgctaatttacaactgcacgagctttccgcacgaggcttgttatttgctgcattagaaacagcgttagaagacggcgaaatcacttcgaaagaagaagacaaaatacgtcaagcattgagtaaacatttggcagcgacgcaacattcgattgaatgtgcgattgtgttacacaagaaa

SEQ ID NO: 4994 - protein, 146 aa, Haemophilus influenzae
  Name: NTH2783
MEMKKVIIEMVDRIPGGRSAVAGFLGFTESELKNRLYQTKGQRFKNEELIAIQQEYGCTQFIDELCRLAGGRFVPDVAENELDKVELANLQLHELSARGLLFAALETALEDGEITSKEEDKIRQALSKHLAATQHSIECAIVLHKK

SEQ ID NO: 4995 - DNA, 186 bp, Haemophilus influenzae
  Name: NTH2784
atgctaccaatcgaaaaagcttatgaaatcgtgggcggtatttcggctatggctcgacatttcaatcttaccccttgggctgtttccaagtggcgtgaaaaagtacctgcggaacgttgcgcaaagattgaagaacttacagatggaaaagtcaagaaatccgaattacgtcctgatttgtgggat

SEQ ID NO: 4996 - protein, 62 aa, Haemophilus influenzae
  Name: NTH2784
MLPIEKAYEIVGGISAMARHFNLTPWAVSKWREKVPAERCAKIEELTDGKVKKSELRPDLWD

SEQ ID NO: 4997 - DNA, 501 bp, Haemophilus influenzae
  Name: NTH2785
gtgtctatgacagatttagcaagccgacttaatgaattaatggctaaacaaggcaaaaatattgtggatttacaaaaagctgttggcgtaacctatgaaatggctagacgttacactttaggcactgcaaccccgagagataataaaattgaagctatagcgaagtactttggagttacccctgctcatttgaaatacggaacagtcgattctttagaaaatcaagtaacttctaatgtgaaagacgttggctcattcgacttatgggatcgcaatactccactaaatagcgatgaatacgccgttccgttttatcaagacattcgccttgctgctggaaacggatttgctgatgacatagcggactataacaacttcaaattgcgtttttccaaatcaacactacgtaaacaagggcgtacagtacgaaaatgcggtatgtgtgatttgctgacggaaactcgatggagcctgttattcccgatggaacacagttggcat

SEQ ID NO: 4998 - protein, 167 aa, Haemophilus influenzae
  Name: NTH2785
VSMTDLASRLNELMAKQGKNIVDLQKAVGVTYEMARRYTLGTATPRDNKIEAIAKYFGVTPAHLKYGTVDSLENQVTSNVKDVGSFDLWDRNTPLNSDEYAVPFYQDIRLAAGNGFADDIADYNNFKLRFSKSTLRKQGRTVRKCGMCDLLTETRWSLLFPMEHSWH

SEQ ID NO: 4999 - DNA, 279 bp, Haemophilus influenzae
  Name: NTH2786
gtgccttcagtaaaaagcatttttattttaccgccttcattgcctgaattagagcgtcgtttaattggtcgtgggcaagatagtgaagaggttattgccgaacgaatgtcaaaagcgataagtgaaatttcgcattatgacgaatatgattatgtcattgtgaatgatgattttgagaaaacattaaaagatttacaaagtattttgcaatcggaacgcttaactaaagattatcaacaaaaacaaaatgcaatgttaattcaacagctactagcaaaa

SEQ ID NO: 5000 - protein, 93 aa, Haemophilus influenzae
  Name: NTH2786
VPSVKSIFILPPSLPELERRLIGRGQDSEEVIAERMSKAISEISHYDEYDYVIVNDDFEKTLKDLQSILQSERLTKDYQQKQNAMLIQQLLAK

SEQ ID NO: 5001 - DNA, 264 bp, Haemophilus influenzae
  Name: NTH2788
atggctcgtgttactgtgcaagatgcagtagaaaaaattggtaaccgttttgatttaattttaacggctgcacgtcgtgcaagacaattacaacttaatcaaagtgcaccattagtgccagaagataatgacaaaccaacagtaatcgcattacgtgaaatcgaaaaaggtttgattaatcaagatattatggatgcacaagaattccaaaaaatggcgaaagtgcaagaaacggaagaagcagctgttgcattaattacagaa

SEQ ID NO: 5002 - protein, 88 aa, Haemophilus influenzae
  Name: NTH2788
MARVTVQDAVEKIGNRFDLILTAARRARQLQLNQSAPLVPEDNDKPTVIALREIEKGLINQDIMDAQEFQKMAKVQETEEAAVALITE

SEQ ID NO: 5003 - DNA, 252 bp, Haemophilus influenzae
  Name: NTH2789
ttggaactgtttgcggatttagatcgaattattcaagggtatttgcccgcagataaaattgaactcatcaagcgtgcgtttgtgattgcaagagatgcgcacgaaggacaatttcgctccagcggcgaaccttacattacccatcctgtggcggtagcctccattattgctcaacttcacttagatcacgaagcggtaatggctgcgcttttgcacgatgttattgaagaacaccttatacggaaaaccaac

SEQ ID NO: 5004 - protein, 84 aa, Haemophilus influenzae
  Name: NTH2789
LELFADLDRIIQGYLPADKIELIKRAFVIARDAHEGQFRSSGEPYITHPVAVASIIAQLHLDHEAVMAALLHDVIEEHLIRKTN

SEQ ID NO: 5005 - DNA, 114 bp, Haemophilus influenzae
  n 74: n is any nucleotide
  Name: NTH2790
gtggacggtgtatcaaaactcgataagttgaaatttcgtactcgccaagaagcacaagtcgagaattttcgcanaatgatttttggcgatgacgcgcgatattcggggtggggg

SEQ ID NO: 5006 - protein, 38 aa, Haemophilus influenzae
  Xaa 25: Xaa is any amino acid
  Name: NTH2790
VDGVSKLDKLKFRTRQEAQVENFRXMIFGDDARYSGWG

SEQ ID NO: 5007 - DNA, 324 bp, Haemophilus influenzae
  n 201: n is any nucleotide
  Name: NTH2791
atgctgaaaagaaagtcttctattcattttgaagggccaaacctaaaaacgagagcagcggacaatagtttcaagcgtttctttcgcaatacggcgacggtatctggtcgtaacgaacccaagcgtgcgcatatatgcgtgcggtcagcaagcttgattacccccaccccgaatatcgcgcgtcatcgccaaaaatcattntgcgaaaattctcgacttgtgcttcttggcgagtacgaaatttcaacttatcgagttttgatacaccgtccacaatttcagctacactggcaccgaacttcttctatcagttggttttccgta

SEQ ID NO: 5008 - protein, 108 aa, Haemophilus influenzae
  Xaa 67: Xaa is any amino acid
  Name: NTH2791
MLKRKSSIHFEGPNLKTRAADNSFKRFFRNTATVSGRNEPKRAHICVRSASLITPTPNIARHRQKSXCENSRLVLLGEYEISTYRVLIHRPQFQLHWHRTSSISWFSV

SEQ ID NO: 5009 - DNA, 270 bp, Haemophilus influenzae
  Name: NTH2792
ttgattgatgcagaattggctcaacttgccgttgataatggttgggaaggcattattgtatatggtgcagtacgccaaattcagcaattagaaaacctcgatattggtattcatgcccttgcgccaattccagtcagtgcagatgaaagcagtgctggcgagagtgatattccagtgaattttggtggcgtaacctttttcccagaagattatatttacgcagatctgacaggaattatactttcgcaagagcctctagatttagaagat

SEQ ID NO: 5010 - protein, 90 aa, Haemophilus influenzae
  Name: NTH2792
LIDAELAQLAVDNGWEGIIVYGAVRQIQQLENLDIGIHALAPIPVSADESSAGESDIPVNFGGVTFFPEDYIYADLTGIILSQEPLDLED

SEQ ID NO: 5011 - DNA, 174 bp, Haemophilus influenzae
  Name: NTH2793
atgtctattatcggcatttcatctatccatatgttgcaaacttttgtgaatgcaagcaatatgccagaaaaaacgatgatgtggcaattattgttgcacttgggctttttagtgtcggcaattgctttagcttatacggacaaaattttgtatagcacaagccataaaacacat

SEQ ID NO: 5012 - protein, 58 aa, Haemophilus influenzae
  Name: NTH2793
MSIIGISSIHMLQTFVNASNMPEKTMMWQLLLHLGFLVSAIALAYTDKILYSTSHKTH

SEQ ID NO: 5013 - DNA, 528 bp, Haemophilus influenzae
  Name: NTH2794
atgaaagaaaacaaacctgttgatccttatgcgaaatataacgaacaatcgaatattatcgcgaaaataatttttgctagtcgctggttgcaagtgccgatttatttgggcttgattgtcacccttgcaatctactcttataaatttatcaaaggattatgggagttagtgattaatgtaaatgatatggattccaacacaattatgttaggcgtgttgaatttgattgatgtcgtgatgatcgccaacttacttgtgatggtgactatcggtggctatgaaatctttgtatctaaattgcgtacacgtaatcaccccgatcaacctgaatggatgagccacgtaaatgccaccgtgttgaaagttaaacttttctatgtctattatcggcatttcatctatccatatgttgcaaacttttgtgaatgcaagcaatatgccagaaaaaacgatgatgtggcaattattgttgcacttgggctttttagtgtcggcaattgctttagcttatacggacaaaattttgta

SEQ ID NO: 5014 - protein, 176 aa, Haemophilus influenzae
  Name: NTH2794
MKENKPVDPYAKYNEQSNIIAKIIFASRWLQVPIYLGLIVTLAIYSYKFIKGLWELVINVNDMDSNTIMLGVLNLIDVVMIANLLVMVTIGGYEIFVSKLRTRNHPDQPEWMSHVNATVLKVKLFYVYYRHFIYPYVANFCECKQYARKNDDVAIIVALGLFSVGNCFSLYGQNFV

SEQ ID NO: 5015 - DNA, 360 bp, Haemophilus influenzae
  n 179: n is any nucleotide
  Name: NTH2795
atgcgctgtgggaaaacaaaaattgcgttaaatccctcatggattgtgaaagtccattttgcctttaaagccggtgtacttggcaaacaatctttacttactccaatctttcacgtcaaacagcagttttttgttgtagtgacaccattgctgtcggtgcataccaagctattcagcancaaggcttacgtattccgcaagatctttcaattatgggctatgatgacattgaattggctcgttatctctcgcctcctctctccaccatttgccaaccgaaaagctgaacttggcaaactcgctgttgaaacactattgcaacgaattaaaaatcctaatgaaaattacctcactttggtg

SEQ ID NO: 5016 - protein, 120 aa, Haemophilus influenzae
  Xaa 60: Xaa is any amino acid
  Name: NTH2795
MRCGKTKIALNPSWIVKVHFAFKAGVLGKQSLLTPIFHVKQQFFVVVTPLLSVHTKLFSXKAYVFRKIFQLWAMMTLNWLVISRLLSPPFANRKAELGKLAVETLLQRIKNPNENYLTLV

SEQ ID NO: 5017 - DNA, 864 bp, Haemophilus influenzae
  Name: NTH2796
atgaaaaaatataaaactgggctcgtgttattagtgattgcactcgccttacttgtctatttttccccttggtttttcttacatattgccagttggcaaaaagagtttaatcagcttatttcggaaaatttacatcaaattcaaaataatagcatcaaggcaggcatcacacttattttcgtcagctttatttatggcgtactccatgccctcgggccaggacacggcaaatttattattgccagctatctttccacgcatgaaagccaattaaaacaaagcactatcttgagcttactttcatccttaatgcaaggcattgtcgcgattacagcaacaacattgcttgttgtagtgctaaatctttcatcacgttatttcaaattaagccagctttggttagaacgaactgccttgctattattggtatttctcggctgttattggatttggcaaggtctacgtgcctatcgtaaaaaagctaaattaaccattaaatccctcaatcccctccctctacacgaaaaaagtgcggtgaaaaataaccgcacttttcagccaaacacttgtagctgtggacaccaacatttgccaagccccacgcaaactgcacaagcaaccaatctaaaatcacaattcctcgtgattctaacaattggcatgcgcccatgtagcggtgcaattttcgttttatttttagcttatatgcttgatctttatagctggggaattttagctgtattagccatgtctttcggcacggggcttatgctgtcagccttcgcaggaattgtacgttatgcacgaaataccgcaatccacttagggcattggtatagttcaaaaaatacgaaggggatttcc

SEQ ID NO: 5018 - protein, 288 aa, Haemophilus influenzae
  Name: NTH2796
MKKYKTGLVLLVIALALLVYFSPWFFLHIASWQKEFNQLISENLHQIQNNSIKAGITLIFVSFIYGVLHALGPGHGKFIIASYLSTHESQLKQSTILSLLSSLMQGIVAITATTLLVVVLNLSSRYFKLSQLWLERTALLLLVFLGCYWIWQGLRAYRKKAKLTIKSLNPLPLHEKSAVKNNRTFQPNTCSCGHQHLPSPTQTAQATNLKSQFLVILTIGMRPCSGAIFVLFLAYMLDLYSWGILAVLAMSFGTGLMLSAFAGIVRYARNTAIHLGHWYSSKNTKGIS

SEQ ID NO: 5019 - DNA, 381 bp, Haemophilus influenzae
  n 14: n is any nucleotide
  Name: NTH2797
gtgagcatatttcnagctatctatatgatgcccagaataataaaatcaaaatatccccttcgcccaaaaaattacggcattaatgttcaaggcttacaactgcaattatattttgatgtgccactcgcccatccgcaaaagttagaaaaaaacacatttagcttacaaacttacgatcccacttattatgtggcgatgacttacgcttcaaaaagtgcggtagatttttccgcactttcgaaaaattgccaaggaaaattaattgaacctaatgtggatgaaaaaatccaagcctacgcatcttcacttgataaatcccaaaagaacgaagatgattccttaggcgtaatgttcgcgcaaaaaataataattcaatgtgag

SEQ ID NO: 5020 - protein, 127 aa, Haemophilus influenzae
  Xaa 5: Xaa is any amino acid
  Name: NTH2797
VSIFXAIYMMPRIIKSKYPLRPKNYGINVQGLQLQLYFDVPLAHPQKLEKNTFSLQTYDPTYYVAMTYASKSAVDFSALSKNCQGKLIEPNVDEKIQAYASSLDKSQKNEDDSLGVMFAQKIIIQCE

SEQ ID NO: 5021 - DNA, 612 bp, Haemophilus influenzae
  Name: NTH2798
atggcttattccattgaagaagaacaagagattaaccagttaaaagactggtggaaagagaatggcaaaacaattattgtcgcttttatcttaggtgtgggtggtatgtttggatggcgttattggcaatcgcaccaagcagaacaaatcgctcaagcttctgcacaatacgatactttaattaattctgtgcaacaagacgaacaggctaaaaaagcaaatatagaacaatttgtgcaagcgaatagcaaaactgcatacgctgtatttgctttgttagatgaagcgaaaaaagccactcaaaaacaagatttttcagcagcagaagcaaatttaaaccaagcattaacccaatctcaagatgaagtattaacatctattgttgcattacgtctcagtgcagtacaatttcaattgggtcaattagacaatgctttaaccaccttaaaccaagtgaaaggcgaaagttttaatgctcgcaaagcgattttaacgggcgatatccaagttgcaaaaggagataaagttgcggcgaaaaacagctttgagcaagcacaacaaagtggtagccaattagaacaacaaatggcaaaaatgaaattaaacaacctt

SEQ ID NO: 5022 - protein, 204 aa, Haemophilus influenzae
  Name: NTH2798
MAYSIEEEQEINQLKDWWKENGKTIIVAFILGVGGMFGWRYWQSHQAEQIAQASAQYDTLINSVQQDEQAKKANIEQFVQANSKTAYAVFALLDEAKKATQKQDFSAAEANLNQALTQSQDEVLTSIVALRLSAVQFQLGQLDNALTTLNQVKGESFNARKAILTGDIQVAKGDKVAAKNSFEQAQQSGSQLEQQMAKMKLNNL

SEQ ID NO: 5023 - DNA, 192 bp, Haemophilus influenzae
  Name: NTH2800
atgaaatggacagacgcccaattaattgcagaagaactttacgatcgtaatccagatttagatccaaaaacagttcgttttactgatttacataaatggatttgtgaacttgaagattttgatgacgatccgaataaatcaaatgaatcaattcttgaggctattttattaaaatggctggatgaatttgaa

SEQ ID NO: 5024 - protein, 64 aa, Haemophilus influenzae
  Name: NTH2800
MKWTDAQLIAEELYDRNPDLDPKTVRFTDLHKWICELEDFDDDPNKSNESILEAILLKWLDEFE

SEQ ID NO: 5025 - DNA, 339 bp, Haemophilus influenzae
  Name: NTH2801
atgccaaaagtgatttttttacctaatgaagatttttgtcctgaaggtatggtcgttgatgctgcaacaggagataacttattagaagttgctcacaatgcgggagtagaaattcatcacgcttgtgatggttcttgtgcttgtacaacttgccacgtgattgttcgtgaggggtttgattctttaaatgaaacgagtgatcaagaagaagatatgctagataaggcttggggattagaaatggatagccgtttatcttgtcaatgcgtcgtgggaaatgaagatcttgtggtagaaattccaaaatataaccttaatcacgcaaatgaggcggctcac

SEQ ID NO: 5026 - protein, 113 aa, Haemophilus influenzae
  Name: NTH2801
MPKVIFLPNEDFCPEGMVVDAATGDNLLEVAHNAGVEIHHACDGSCACTTCHVIVREGFDSLNETSDQEEDMLDKAWGLEMDSRLSCQCVVGNEDLVVEIPKYNLNHANEAAH

SEQ ID NO: 5027 - DNA, 720 bp, Haemophilus influenzae
  n 711, 712, 713, 714, 715: n is any nucleotide
  Name: NTH2802
atggaagatatggagcagatgcgtgagcgtgattatgaactttatcgtcacgtttatgagggcgagcctgtggctgattccgatttagccattattaagcctgtatggattgaatgtgcggtggatgcgcatctcaagctcggttttaccgctaaaggaatgaagaaagttggctttgatgtggctgatgagggtgcggatagtaacgataatgcatttgttcacggttctgtggtgcttgacattgaagtttggaagaatggcgatgtgattgattccgccaaccgaacaaatcaaagtgcggtcaaatttaaagctgatttgattatattcgatagtattggcgtgggggcgggagtaaaagctcactttaaacgcttgccaaaatctttacaagtggaaggatttaatgctggtggtgcagttgcttatcccgagcgtgaatatatcaaaggaaaaaagaatcaagatatgttttcgaacattaaagcccaatcttggtgggcgttgcgagatagattctataaaacctatcgagcagtaaagcatggggatgtttaccctgacgatgaactgataagcctatcgagcaatatcaaagagcttgagtatttgaaagcagaattatcacgtcctcgtgttgattatgacaataacgggcgggtaaaggttgaaagcaaaaaggatatgaaaaaacgtggcatacttttnnnnnttaat

SEQ ID NO: 5028 - protein, 240 aa, Haemophilus influenzae
  Xaa 237, 238, 239: Xaa is any amino acid
  Name: NTH2802
MEDMEQMRERDYELYRHVYEGEPVADSDLAIIKPVWIECAVDAHLKLGFTAKGMKKVGFDVADEGADSNDNAFVHGSVVLDIEVWKNGDVIDSANRTNQSAVKFKADLIIFDSIGVGAGVKAHFKRLPKSLQVEGFNAGGAVAYPEREYIKGKKNQDMFSNIKAQSWWALRDRFYKTYRAVKHGDVYPDDELISLSSNIKELEYLKAELSRPRVDYDNNGRVKVESKKDMKKRGILXXXN

SEQ ID NO: 5029 - DNA, 147 bp, Haemophilus influenzae
  n 34, 102: n is any nucleotide
  Name: NTH2803
gtgagctttaacccgaagaatattcttgatgatncctatcagcgttttgtgattcatccgcctgagcggtgtaaatcggtcttagtgaattggcaagacaancccatattttccgaaagaattaatggaagatatggagcagatgcg

SEQ ID NO: 5030 - protein, 49 aa, Haemophilus influenzae
  Xaa 12, 34: Xaa is any amino acid
  Name: NTH2803
VSFNPKNILDDXYQRFVIHPPERCKSVLVNWQDXPIFSERINGRYGADA

SEQ ID NO: 5031 - DNA, 120 bp, Haemophilus influenzae
  n 115, 116, 117, 118, 119: n is any nucleotide
  Name: NTH2804
atgaaaccttccgatgattactactatcaactcgatgctgcacaccaacgtaaagtggattggcaagcaggctatgaaatcgctttagatgaagtcgccacggaaatcgacaatnnnnnt

SEQ ID NO: 5032 - protein, 40 aa, Haemophilus influenzae
  Xaa 39, 40: Xaa is any amino acid
  Name: NTH2804
MKPSDDYYYQLDAAHQRKVDWQAGYEIALDEVATEIDNXX

SEQ ID NO: 5033 - DNA, 342 bp, Haemophilus influenzae
  Name: NTH2806
atgaaacactcgaaaaccccattacgccaagaaaaacaaagcttcacgcactttatgaaaggcagtgaaaaatggctaaacagaatctgctattttctcgccgccttgattattgccatgattgtgggtgggattagcctacacgccaatgcccaccccaccgattggcacgataacgaattaagccaacaaatccaacaagaaacccgatgtgaactgaaagggggcatatatgaaaacggtgtatgtttaccgcctaatcttacactggcagcagaaaaagaactgcaggcttacaccgcacaaaagcaagccgaaattaaccgcacttggagtaaacaa

SEQ ID NO: 5034 - protein, 114 aa, Haemophilus influenzae
  Name: NTH2806
MKHSKTPLRQEKQSFTHFMKGSEKWLNRICYFLAALIIAMIVGGISLHANAHPTDWHDNELSQQIQQETRCELKGGIYENGVCLPPNLTLAAEKELQAYTAQKQAEINRTWSKQ

SEQ ID NO: 5035 - DNA, 798 bp, Haemophilus influenzae
  n 45, 47, 55, 69, 70, 98: n is any nucleotide
  Name: NTH2807
gtgggtaataaggagaaacgaaaaaagccggaatttgtgaaaacnantaaaaaancaccaaaaatgaannccggattattaaacaatcacttccaaanctacaaacgctaccacatcccaaaagcgcagctagtcatcgccgacattccctacaatctcggtaataatgcttacgcttcaaaccctgaatggtatgtaaacggcgataacaaaaacggcgaaagcgacaaagccaacagtagtttttttgatacagataaagatttccgcattgccgaatttatgcatttttgttcaaaaatgctcatcaaagaaccgaaagaacgcggcaaagccccttgtatgattgtgttctgcgctttccagcaaatctcaatggtgattgattacgccaagcagcacggctttaaaaatcacatccctttggtgtttattaaatcatcatcaccacaggtgctcaaagcgaatatgaaagtcgtcggcgcaacagaatatgccttgattttataccgcgataaactgccgaaatttaacaacaacggcaaaatgattaaaaactggttcgaatgggaaaaggacaaccgcaaggaaatccctaaactgcacccgacacaaaagcccattgccgtgttaaaacgcctcatcgaaatctttaccgatgagggcgatgtagtgattgatccagttgctggcagtgcatccacgctacgcgccgcacgagagcttaaccgcccgtcctatggctttgaaatcaaaaaagacagctgcaaaatcgcaaaagaaaaaatgcttaatatc

SEQ ID NO: 5036 - protein, 266 aa, Haemophilus influenzae
  Xaa 16, 19, 23, 24, 33: Xaa is any amino acid
  Name: NTH2807
VGNKEKRKKPEFVKTXKKXPKMXXGLLNNHFQXYKRYHIPKAQLVIADIPYNLGNNAYASNPEWYVNGDNKNGESDKANSSFFDTDKDFRIAEFMHFCSKMLIKEPKERGKAPCMIVFCAFQQISMVIDYAKQHGFKNHIPLVFIKSSSPQVLKANMKVVGATEYALILYRDKLPKFNNNGKMIKNWFEWEKDNRKEIPKLHPTQKPIAVLKRLIEIFTDEGDVVIDPVAGSASTLRAARELNRPSYGFEIKKDSCKIAKEKMLNI

SEQ ID NO: 5037 - DNA, 96 bp, Haemophilus influenzae
  n 52: n is any nucleotide
  Name: NTH2809
gtgcgatctgtttttacagaagcgttaaatatccacaaaaagacacaatcanatttaagtgatgaaatggattaccacctttatgattgcatttca

SEQ ID NO: 5038 - protein, 32 aa, Haemophilus influenzae
  Xaa 18: Xaa is any amino acid
  Name: NTH2809
VRSVFTEALNIHKKTQSXLSDEMDYHLYDCIS

SEQ ID NO: 5039 - DNA, 333 bp, Haemophilus influenzae
  Name: NTH2810
atgcaaactatttatgtaaaagatttcagccaatatccaggtccacgttacattaaagatggtaaagctagtggagaggaatttagagattctattcttatcccagcaataaaaagggatcctgatatcattcttaatttagatgacacagaaggatatggctcttcatttcttgaagaaacttttggaggagcaattagaaaaggtatttctccagaggttgttttaaatcttgttaaaaaccttatttcaaatgacgaccatgatattattgacgaaattaaaagttatgtagaaaaagagattgagattttatctttgaaggataataaa

SEQ ID NO: 5040 - protein, 111 aa, Haemophilus influenzae
  Name: NTH2810
MQTIYVKDFSQYPGPRYIKDGKASGEEFRDSILIPAIKRDPDIILNLDDTEGYGSSFLEETFGGAIRKGISPEVVLNLVKNLISNDDHDIIDEIKSYVEKEIEILSLKDNK

SEQ ID NO: 5041 - DNA, 1050 bp, Haemophilus influenzae
  n 1045, 1046, 1047, 1048, 1049: n is any nucleotide
  Name: NTH2811
ttgttcatagcccgcaccaacactatatttttatggaaaatttcctttattaaggtaaactgtcggcaattttatgtgaattacattcagttacagaggtttaatatgtctaaagtggcatcaattgttgatgtattacaagggaaagtggcgattggtgaaaccgtcactgtgcgtggttgggttcgtacccgtcgcgattctaaagcaggcttatctttcttagcggtttatgacggttcttgctttgatccaattcaagcaattattaataacgatattaaaaattacgaaagcgaaattttacgtttaacaacaggctgttctgtgattgtaactggtaaagtcgttgaatcaccttctgaaggacaagcggttgaattacaagcagaaaaagtggaagtgacagggtttgttgaagatccagatacttacccaatggcagcaaaacgccactctatcgaatatttacgcgaagtagctcacttacgccctcgtaccaatattattggcgcggtcgcgcgtgttcgtcattgcttgtctcaagcaattcaccgtttcttccatgagcaaggtttctactgggtggcaaccccattaattactgcatcagacactgaaggtgcgggtgaaatgttccgtgtttctacacttgatttagaaaatcttccacgtagtgaaaatggaaaagtggatttcagccaagatttcttcggtaaagaatcatttttaacggtttcaggtcagttaaacggcgaaacctatgcttgtgcattaagcaaaatttatacttttggcccaacattccgtgcagaaaactcgaatactacccgtcacttagctgaattctggatggttgaacctgaagttgcatttgcaaccttagcggataacgcaaaacttgcagaagatatgttgaaatacgtatttcgtgcagtattagcagagcgtaaagacgacttacaattctttgaaaaacatgtagataaagatgttattactcgtttagaaaactttgaaatcagatggggtaccgagccgaatnnnnnt

SEQ ID NO: 5042 - protein, 350 aa, Haemophilus influenzae
  Xaa 349, 350: Xaa is any amino acid
  Name: NTH2811
LFIARTNTIFLWKISFIKVNCRQFYVNYIQLQRFNMSKVASIVDVLQGKVAIGETVTVRGWVRTRRDSKAGLSFLAVYDGSCFDPIQAIINNDIKNYESEILRLTTGCSVIVTGKVVESPSEGQAVELQAEKVEVTGFVEDPDTYPMAAKRHSIEYLREVAHLRPRTNIIGAVARVRHCLSQAIHRFFHEQGFYWVATPLITASDTEGAGEMFRVSTLDLENLPRSENGKVDFSQDFFGKESFLTVSGQLNGETYACALSKIYTFGPTFRAENSNTTRHLAEFWMVEPEVAFATLADNAKLAEDMLKYVFRAVLAERKDDLQFFEKHVDKDVITRLENFEIRWGTEPNXX

SEQ ID NO: 5043 - DNA, 93 bp, Haemophilus influenzae
  n 84, 85, 86, 87, 88: n is any nucleotide
  Name: NTH2812
atgaaagttttagaaggctcagttgcagcacctaatgcaaaagttgcagtagcaattgctcgttttaacagttttattaatgannnnnttaat

SEQ ID NO: 5044 - protein, 31 aa, Haemophilus influenzae
  Xaa 28, 29, 30: Xaa is any amino acid
  Name: NTH2812
MKVLEGSVAAPNAKVAVAIARFNSFINXXXN

SEQ ID NO: 5045 - DNA, 684 bp, Haemophilus influenzae
  Name: NTH2813
ttgctttttatcaaacttaatctttccgccttatggcaggaattttatcctgaatgcacttcagtttatacaaaacaagctgttgaattatgtcctgcttgccactacacctttacgcaaaaatctatctattacgatcatcaacaaaagatttgttgtccccgctgccaatcgcctcttaatacatcggataagctaaaattacaagcaacttgggcaaccttaattgcagggattattatgctttttcctgcaaatttattacctatatctggcatttatttaacaggcgcattatctgaagatactttaatttctggggttatttcatttgttaaatcaggtagttattttgttgcttttgttgtattttttgccagtattttcgtgcctatcagcaaaatttttattatgctttacttacttgcttgcgtgcattttaaatggcaacattctattaaatggcaaatgcgtttattgcatctagtacattttgttggacgctggtctatgcttgatttatttgtattagccttaatgatgtcgcttgtcacacgcggagaaatcattaattttaccgtagggccaggtgcattttattttggtgcagccgtattttgcactatgctttccacctcacaatttgatagcaaattaatttggaaaatttatgacagagaaaaa

SEQ ID NO: 5046 - protein, 228 aa, Haemophilus influenzae
  Name: NTH2813
LLFIKLNLSALWQEFYPECTSVYTKQAVELCPACHYTFTQKSIYYDHQQKICCPRCQSPLNTSDKLKLQATWATLIAGIIMLFPANLLPISGIYLTGALSEDTLISGVISFVKSGSYFVAFVVFFASIFVPISKIFIMLYLLACVHFKWQHSIKWQMRLLHLVHFVGRWSMLDLFVLALMMSLVTRGEIINFTVGPGAFYFGAAVFCTMLSTSQFDSKLIWKIYDREK

SEQ ID NO: 5047 - DNA, 846 bp, Haemophilus influenzae
  n 837, 838, 839, 840, 841: n is any nucleotide
  Name: NTH2814
atgacagagaaaaataattcctcctcaatagaagaaaaatatcaagaaataacagcgaacttacgtaaaacaaaacgcatttcgcctttttggctattgccttttatcgcattatgtatcggggcaattttattcttccaaattgtgaaagaacgtggtactagcattacgattacctttaccaatggttcaggtatcgttgcggataaaactcaaattcgttatcaaggattacaaattggcatagtaaaagaagttcatttcactgataacctgcaaaaagtggaagttgttgccaatatcaatcctgaagcatcaagtattttgcgtgaaaatacaaaattttggcttgtgcaaccaaatgtttctcttgctggcatttcaggattagattctctcgtgtcaggtaattacatcactcttcaaccgggtgatggcgatcgtgaagatgaatttatagcagaagaacaaggccctattgcacaagtttccgcaggagatttattgattcacttaatttctgatgatttaggttcgatttctattggtgcgtctgtgtattttaaaaaattacctgtaggaaaaatctatgattaccgtattaataaaaacaataaagtagaaatagatgtggtcattgataaagcctatgccaagtttgtgaaaaaagattcacgcttttggaatgttagtggcattaacgcgaacattagcccatcaggcttaaacctaaatgtagaaagtttaaatgccgttgtacagggggcggtttcttttgactctccagctgacagcccaaaagcagatgagggtaccgagtccgatattcggtaccannnnnttaat

SEQ ID NO: 5048 - protein, 282 aa, Haemophilus influenzae
  Xaa 279, 280, 281: Xaa is any amino acid
  Name: NTH2814
MTEKNNSSSIEEKYQEITANLRKTKRISPFWLLPFIALCIGAILFFQIVKERGTSITITFTNGSGIVADKTQIRYQGLQIGIVKEVHFTDNLQKVEVVANINPEASSILRENTKFWLVQPNVSLAGISGLDSLVSGNYITLQPGDGDREDEFIAEEQGPIAQVSAGDLLIHLISDDLGSISIGASVYFKKLPVGKIYDYRINKNNKVEIDVVIDKAYAKFVKKDSRFWNVSGINANISPSGLNLNVESLNAVVQGAVSFDSPADSPKADEGTESDIRYXXXN

SEQ ID NO: 5049 - DNA, 336 bp, Haemophilus influenzae
  Name: NTH2815
gtggtgaaaaactatccaaaagacattaaagcattctatatgcgtttaaatgatgatggaaaaactgtggcggcaatggacgtgttagctccaggaattggtgaaatcatcggtggttcacaacgtgaagaacgtttagaggtgcttgataaacgcatggaagaaatgggattaaatccagatgattattggtggtatcgcgatcttcgtaaatacggcagtgttccacattctggttttggtcttggttttgaacgtttaatcgtctatgtaactggcgttcaaaatattcgtgatgtaattccattcccacgcgcgccaagaaatgcgaatttc

SEQ ID NO: 5050 - protein, 112 aa, Haemophilus influenzae
  Name: NTH2815
VVKNYPKDIKAFYMRLNDDGKTVAAMDVLAPGIGEIIGGSQREERLEVLDKRMEEMGLNPDDYWWYRDLRKYGSVPHSGFGLGFERLIVYVTGVQNIRDVIPFPRAPRNANF

SEQ ID NO: 5051 - DNA, 108 bp, Haemophilus influenzae
  Name: NTH2816
ttgtgcccaactgtaattgttggcaaagagttgtttaattttatccattttactttccttaaaattctgaaaaaattaaccgcactttggcgtaagtgcggtcaatat

SEQ ID NO: 5052 - protein, 36 aa, Haemophilus influenzae
  Name: NTH2816
LCPTVIVGKELFNFIHFTFLKILKKLTALWRKCGQY

SEQ ID NO: 5053 - DNA, 384 bp, Haemophilus influenzae
  Name: NTH2817
atgaaagaagaaaattctacttacttcaaagaacttgcggatcatcaaacgccacattacctttggattggttgctctgatagccgtgtacccgctgagaaattgacgaatcttgaaccaggtgagctttttgtacatcgtaatgttgctaaccaagtaattcacacagattttaattgcctttctgttgtgcaatatgccgtcgatgtgcttaaaattgaacatattattatctgtggtcacaccaactgcgggggaattcacgctgctatggcagataaagatttagggcttatcaacaactggcttcttcatattcgtgatatttggtttaaacacggtcatcttctcggtaaacttctccagaaaaacgtgccgatatgc

SEQ ID NO: 5054 - protein, 128 aa, Haemophilus influenzae
  Name: NTH2817
MKEENSTYFKELADHQTPHYLWIGCSDSRVPAEKLTNLEPGELFVHRNVANQVIHTDFNCLSVVQYAVDVLKIEHIIICGHTNCGGIHAAMADKDLGLINNWLLHIRDIWFKHGHLLGKLLQKNVPIC

SEQ ID NO: 5055 - DNA, 366 bp, Haemophilus influenzae
  Name: NTH2818
atgacgatttctaaatttaatccacaaaaacctttcgagtgttttattgtacaaagtgaagcgatgaaaagtgcggtagaaaacgcgaaacgttttgctatgtttgatgtgcctttgttaattcaaggcgaaacggggacaggaaaggatttgttagcgaaagcctgccattatcagagtttacgtcgtgataaaaaatttatcgcagtaaattgtgctgggttgcctgatgaagatgccgaaagtgaaatgtttggtcgaaaagttggcgacagcgaaaccatggtttttttgaatacgcaaatgagggtacagttttactcgatggtattgctgaactttcattgggtttgcaggctaaattat

SEQ ID NO: 5056 - protein, 122 aa, Haemophilus influenzae
  Name: NTH2818
MTISKFNPQKPFECFIVQSEAMKSAVENAKRFAMFDVPLLIQGETGTGKDLLAKACHYQSLRRDKKFIAVNCAGLPDEDAESEMFGRKVGDSETMVFLNTQMRVQFYSMVLLNFHWVCRLNY

SEQ ID NO: 5057 - DNA, 666 bp, Haemophilus influenzae
  Name: NTH2820
gtgagtttacgaaaactaaaaaaaggcactcaatttgccattatagtttctcgtgaatatttaggcgataaacttacaggtcaaggtaatgttgaagcgttacgtatttcatctggtggtaaaaattattatgcagtgcaagcggcaaatggtcgttattataatcagcaaggggaaactttaggcaaaggttttgctcgttatccattgcagcgacaagcgcgagtttcctccccttttaatccaaatcgtcgccatccagtaacaggacgtgttcgtccccataaaggcgtggatttctctgtttctcaaggcacaccagttattgcaccagcagatggtacagttgaaaaggtcgcttatcaggctggcggtgctgggcgttatgttatgttgcgtcacgggcgtgaatatcaaactgtttatatgcacttgagcaaatccttagtaaaagcagggcaaaccgttaaaaaaggcgaacgtattgcgctttctggtaacacgggcatttctacggggccgcatttacattatgaatttcgtattaacggtcgagcagtgaatcctcttactgttaaattacccggtactagcagtggtatgacttcagctgaacggaaacaattccttgttcgtgttcgtgaagctgaaaaaatgttaaaacct

SEQ ID NO: 5058 - protein, 222 aa, Haemophilus influenzae
  Name: NTH2820
VSLRKLKKGTQFAIIVSREYLGDKLTGQGNVEALRISSGGKNYYAVQAANGRYYNQQGETLGKGFARYPLQRQARVSSPFNPNRRHPVTGRVRPHKGVDFSVSQGTPVIAPADGTVEKVAYQAGGAGRYVMLRHGREYQTVYMHLSKSLVKAGQTVKKGERIALSGNTGISTGPHLHYEFRINGRAVNPLTVKLPGTSSGMTSAERKQFLVRVREAEKMLKP

SEQ ID NO: 5059 - DNA, 204 bp, Haemophilus influenzae
  n 166: n is any nucleotide
  Name: NTH2821
atgattctcagtccacccttgattagcttgatccgaattagccacttaaaacaggtcagcatttttctgattttaaataaaaatgaaacctggaatattaattgggcggtttctgaaaaaaaagaacgtatttatgaacgtctcgagaatggaaaattaaacgccnagttattgaaaagaaaagtatttggcgaaaagaagtat

SEQ ID NO: 5060 - protein, 68 aa, Haemophilus influenzae
  Xaa 56: Xaa is any amino acid
  Name: NTH2821
MILSPPLISLIRISHLKQVSIFLILNKNETWNINWAVSEKKERIYERLENGKLNAXLLKRKVFGEKKY

SEQ ID NO: 5061 - DNA, 270 bp, Haemophilus influenzae
  Name: NTH2823
atgtcatttttatcaagcgcaatgttcgcattatttattgtgttattgcttggtatggtggcgagtttcttcttccaaattcctgcgttatcggtcgcaattagtgcattatttgtagtgttctcaacaatgaccattttgtatgaaaccagtaatattattcacggtggagaaacaaattacattcgcgcaaccgtgaacatctatgtttcaatctacaatttattcttgagtttattaagattactttctatcttttcaagtgatgaa

SEQ ID NO: 5062 - protein, 90 aa, Haemophilus influenzae
  Name: NTH2823
MSFLSSAMFALFIVLLLGMVASFFFQIPALSVAISALFVVFSTMTILYETSNIIHGGETNYIRATVNIYVSIYNLFLSLLRLLSIFSSDE

SEQ ID NO: 5063 - DNA, 528 bp, Haemophilus influenzae
  Name: NTH2824
atggaaaaacaaatttttgaacattcagttaatgtagaggaagaacactatcagcccaagcaagaattccataatatggaagcaaagctagatgaagcgttggatggagagttacttgatgctcaacttgaacaagcattgaaaccaaaatccagttttagaaaaactttattaaaatttaccgcacttttatttggcttggcgacggttgcacaatccatgcagtggatttgggatagctatcaacaacatcaatggatttatcttgcttttgctttagtcagtttgattatcattttattggggattaaagagattattggcgagtgccgacgtttagttcgtttaaaaaaacgtgagcaatggcaacaacatagtcagcagatttggttagaaagtgcggtaaaaaagggcgatgttttttccgttcataacgcacaaaaaggaaaaaatctctgtttagatattgcagattctttatgcttgggaaatgattctccagccggcatttcattggccacccccttt

SEQ ID NO: 5064 - protein, 176 aa, Haemophilus influenzae
  Name: NTH2824
MEKQIFEHSVNVEEEHYQPKQEFHNMEAKLDEALDGELLDAQLEQALKPKSSFRKTLLKFTALLFGLATVAQSMQWIWDSYQQHQWIYLAFALVSLIIILLGIKEIIGECRRLVRLKKREQWQQHSQQIWLESAVKKGDVFSVHNAQKGKNLCLDIADSLCLGNDSPAGISLATPF

SEQ ID NO: 5065 - DNA, 645 bp, Haemophilus influenzae
  n 632, 633, 634, 635, 636: n is any nucleotide
  Name: NTH2825
ttgtttaaagcaaatagtaaaattgtcctacgcaataaaaaaatggatctaggcaatttagcagaaccaaaaaaattctttcgtgacgaatattttgatgtgattgcgggagacggcgaaactaaacatcaatttaacgtgattaaagaaaatgaattattactcaatgcgcctaacacgttagttttaaccctcactgcgccagagaattacggcgtcagcgaagggcaaaatgtgttttataacaatatgataattgggcaaattgtttcacaaacaattgatgtaaatggcgtgcaatttaaagcagcaattgcctctgaataccgtaatttaattcacgaagatactcaatttgtggctgcaaccaatttcgatataagcattggattagatggattgcgttttgaatccgcgacaccagaaaaatggttacaaggtggtgttcgagtactaacaaaacaagctcagggaaaagctaaaaccagttatccactttatcaaaatattagcaatgcagaacacggtattacaggcgatattcttacgccaacaataaccttacatacccaaacattaccaagtattgataaaggttctctcgtactatatcgtcaatttgaagtaggaannnnnttaattaat

SEQ ID NO: 5066 - protein, 215 aa, Haemophilus influenzae
  Xaa 211, 212: Xaa is any amino acid
  Name: NTH2825
LFKANSKIVLRNKKMDLGNLAEPKKFFRDEYFDVIAGDGETKHQFNVIKENELLLNAPNTLVLTLTAPENYGVSEGQNVFYNNMIIGQIVSQTIDVNGVQFKAAIASEYRNLIHEDTQFVAATNFDISIGLDGLRFESATPEKWLQGGVRVLTKQAQGKAKTSYPLYQNISNAEHGITGDILTPTITLHTQTLPSIDKGSLVLYRQFEVGXXLIN

SEQ ID NO: 5067 - DNA, 126 bp, Haemophilus influenzae
  n 16, 116: n is any nucleotide
  Name: NTH2826
atgaaattaaaggtancaatcctgccatcatccgctcttatgcaggggcaaacggaagtttattctcaagataatgctatagggattctcgccaagctaagtgcggtggaaaatancgatgaaatt

SEQ ID NO: 5068 - protein, 42 aa, Haemophilus influenzae
  Xaa 6, 39: Xaa is any amino acid
  Name: NTH2826
MKLKVXILPSSALMQGQTEVYSQDNAIGILAKLSAVENXDEI

SEQ ID NO: 5069 - DNA, 582 bp, Haemophilus influenzae
  Name: NTH2827
atgttacaaaaagtaaaagatatttatagcgaaagtattcaaattcaaattgcagcatctagcatgctttctgaaaatattaccaatgccacacaaatggtaatgcaatgtttattaggcggtaataaggttatcgcctgtggcgtgtcgcgttcttatgccaatgcacagtttctcgtctcaaacttacttaatcgatatgatttagttagaccaagcttcccgtctgtgttattgagcttagaaagtgcagtgggttcttcacttgtttttgaacaaccgcctgaagaattgtattgtcatcaatttaatgccattgcaaaatcgggcgacttacttattgcttttgcacctttggggacagaaaaaatcgtgctaaatattatttctcatgctgtcagcaaagaagttaatgttattgtgctaactggctctaacaacgatgccattcaaggaattttagcagataaggatctagaaatatcaatcccagccaccaaagaaagtcgtatcttagagaaccatctttttgtgattaatgcactttgtgaattggttgatcagactttattcccaagtgct

SEQ ID NO: 5070 - protein, 194 aa, Haemophilus influenzae
  Name: NTH2827
MLQKVKDIYSESIQIQIAASSMLSENITNATQMVMQCLLGGNKVIACGVSRSYANAQFLVSNLLNRYDLVRPSFPSVLLSLESAVGSSLVFEQPPEELYCHQFNAIAKSGDLLIAFAPLGTEKIVLNIISHAVSKEVNVIVLTGSNNDAIQGILADKDLEISIPATKESRILENHLFVINALCELVDQTLFPSA

SEQ ID NO: 5071 - DNA, 357 bp, Haemophilus influenzae
  Name: NTH2828
atgttttctttaaaacgtcagcaaggggcgagctttgagcatcaagctcgcctttttttagaatcaaaaggcttaacatttattgcggctaatcaaaatttcaaatgtggtgaacttgatctaataatgaatgacaaagaaactatcgtctttgttgaagttcgccaacgaagtcattccgcctatggttctgctatagaaagcgtagattggcgaaaacaacaaaaatggttagatgccgcaaatttatggcttgcaaaacaaaatatgagcttagaagatgctaattgccgctttgatttaatcgcttttggcaaaacacctcaagatattcaatggattcctaattttctcgat

SEQ ID NO: 5072 - protein, 119 aa, Haemophilus influenzae
  Name: NTH2828
MFSLKRQQGASFEHQARLFLESKGLTFIAANQNFKCGELDLIMNDKETIVFVEVRQRSHSAYGSAIESVDWRKQQKWLDAANLWLAKQNMSLEDANCRFDLIAFGKTPQDIQWIPNFLD

SEQ ID NO: 5073 - DNA, 162 bp, Haemophilus influenzae
  Name: NTH2829
atgcgtggttgctcattaatcaatttaaatgaattacgccaagtgccaggctatcgcttgagtggcttaacagggattttaagtgctgataccaactgtaatgttgaacgcgatatgacttggtatcaatatcaagatggtgcaattgtaccagttgcaaac

SEQ ID NO: 5074 - protein, 54 aa, Haemophilus influenzae
  Name: NTH2829
MRGCSLINLNELRQVPGYRLSGLTGILSADTNCNVERDMTWYQYQDGAIVPVAN

SEQ ID NO: 5075 - DNA, 105 bp, Haemophilus influenzae
  Name: NTH2830
ttgtcccaaatatcagaagtagcaaaatccgcgggggggagatatcaattgatgcgttataatgcaatgggtgcagatgcgtggttgctcattaatcaatttaaa

SEQ ID NO: 5076 - protein, 35 aa, Haemophilus influenzae
  Name: NTH2830
LSQISEVAKSAGGRYQLMRYNAMGADAWLLINQFK

SEQ ID NO: 5077 - DNA, 699 bp, Haemophilus influenzae
  Name: NTH2831
atgtctggtcctgagcatcaagttgcagaaattgcagcaaaagtcgctaaagaaaaatacggtttagacgttcaattcgttgaattcaatgactacgcattaccaaatgaagctgtatctaaaggtgatttagatgcaaacgcaatgcaacataaaccttatttagatgaagatgcaaaagcgaaaaatttaaataacttagttatcgtgggtaatactttcgtctatccattagcgggttattctaaaaaaatcaaaaatgtgaatgaattacaagacggtgctaaagttgttgttcctaacgatccaacaaaccgtggtcgtgcattaattcttcttgaaaaacaaggtttaatcaaattaaaagatgcaaataaccttctttcaactgtattagatattgttgaaaatccgaaaaaattaaacatcactgaagtagatacttctgttgcggcacgcgcattagacgacgttgatttagctgtagtaaacaatacttatgcgggtcaagtaggcttaaatgctcaagatgacggtgtatttgtagaagataaagattcgccatatgtgaacattatcgtttctcgtaccgataacaaagacagcaaagctgttcaagatttcgtaaaatcttaccaaacagaagaagtttaccaagaagctcaaaaacactttaaagatggcgttgtaaaaggttgg

SEQ ID NO: 5078 - protein, 233 aa, Haemophilus influenzae
  Name: NTH2831
MSGPEHQVAEIAAKVAKEKYGLDVQFVEFNDYALPNEAVSKGDLDANAMQHKPYLDEDAKAKNLNNLVIVGNTFVYPLAGYSKKIKNVNELQDGAKVVVPNDPTNRGRALILLEKQGLIKLKDANNLLSTVLDIVENPKKLNITEVDTSVAARALDDVDLAVVNNTYAGQVGLNAQDDGVFVEDKDSPYVNIIVSRTDNKDSKAVQDFVKSYQTEEVYQEAQKHFKDGVVKGW

SEQ ID NO: 5079 - DNA, 99 bp, Haemophilus influenzae
  n 10: n is any nucleotide
  Name: NTH2832
gtggaatatntgtttacaggtgatgttcctgagggcatgtcaaattatttgaaaagagcagaaaaacgaaatttggttttatgtaatggtaaagtgcgg

SEQ ID NO: 5080 - protein, 33 aa, Haemophilus influenzae
  Xaa 4: Xaa is any amino acid
  Name: NTH2832
VEYXFTGDVPEGMSNYLKRAEKRNLVLCNGKVR

SEQ ID NO: 5081 - DNA, 2790 bp, Haemophilus influenzae
  n 29, 2065, 2072, 2169, 2222, 2223, 2273, 2288: n is any nucleotide
gccagcttgctgcctgcggtcgactctangagacccctacaacaaaacataatgctaaacaaaaaatgtttggttgtttcaattgttgattaataaatggacgatttctatgcgattcacaaaaacactttttaccaccgcacttttaggtgcttctatcttttcttttcaatccaccgcttgggcggatacgctggaacagcaattccaacaaggttctgaagccactacgagaggcgattatcaaaccacctttaaatttttgttacctctggcggagcagggaaatgcagaggctcaattgatgttgggcgtgatgtatgcaagaggaataggcgtcaaacaagatgattttgaagcggtgaagtggtatcgccaagcggcggagcagggatatgcaaatgctcaagctatattgggattctcatatcttttaggacaaagcggtgttcaagtaaataaatctttagccaaagaatggtttggtaaggcttgtgataatggtgatcaaaatggttgcgaatattatggcaagttaaatagaggggagctctaatgccaactttacaatgcgaattttggaatgtagggcaagggttattttcaagtgggcgtattcaaatgggagacgccccagcctttcattgggtttatggtttgcaagttcctcatcatggttcaaagccaattttagtgaataaaaataaaagattatccattcattcaatttaataggaaaacaaatgaaactcacaaaaacacttcttaccaccgcacttttcggtgcttctattttttcttttcaatccaccgcttgggcggatacgccggaacagcaattccaacaaggtttaaccgcttatgagcaaagcaactatcaaaccgcctttaaactttggttacctctggcggagcagggagatgcacaggctcaaggtggtttgggcatgatgtatgaaagaggacttggcgtaaaacaagatgatttcaaagcagtgaactggtatcgcaaagcggcggagcagggggatgcagatgctcaattaaatttgggtgcgatgtatgcaatcggacgtggcgtaaaacaagatggtgttgaagcggtgaagtggtttcgcaaagcggcagagcagggaaatgcaaaggctcaaaatggtttgggcatgatgtatgacggaggacttggcataaaacaagattatttcaaagcggtgaaatggcatcgcaaagcggcggagcagggatatggaggtgctcaagttatgttgggattctcatatctttcgggaaaaggtgttcaagtaaataaatctttagccaaagaatggtttggtaaggcttgtgataatggtgaacaagtgggttgtgaatattatggcaagctaaatagaggggaacgctaatgccaactttacaatgcgaattttggaatgtagggcaagggttattttcaagtgggcgtattcaaatgggagacgcccaagcctttcattgggtttatggtttgcaagttcctcatcatggttcaaagccaattttagtgaataaaaataaaagattatccattcattcaatttaataggaaaacaaaatgaaactcacaaaaacacttcttaccaccgcacttttcggtgcttctgtattttcttttcaatccaccgcttgggcggatacgctggaacagcaattccaacaaggtttaaccgcttatgagcaaagcaactatcaaaccgcctttaaactttggttacctatggcagagcagggatatgcaaaggctcaatttaatttgggcgtgatgtatgctaaggggcaaggcgtcaaacaagatgattttgaagcggtgaagtggtttcgcaaagcggcggagcagggatatgcagaggctaaatttaatttgggccatatgtattctaagggacgaggcgtcaaacaagatgattttgaagcagtgaactggtatcgcaaagcggcggagcagggagatgcagatgctcaagctatattgggattcttatatcttttaggagaaagaggtgtcaagtaaataattctttagccaagnaatggtntggtaaggcttgtgataatggtaatcaaaatggctgcgaatattatggcaagctaaatagaggggagctctaatgcccacttttacaatgcgaattntggaatgtagggcaagggttattttcaagtgggcgtattcaagtggagacgcnnccaagcctttcattgggtttatggtttgcaagttcctcatcatggttcanagcccaatttagtgnaataaaaataaaagattatccattcattcaatttaataggaaaacaaaatgaaactcacaaaaacacttcttaccaccgcacttttaggtgcttctgtattatcttttcaatccaccgcttgggcggatacgctggaacagcaattccaacaaggtttaaccgcttatgagcaaagcaactatcaaaccgcctttaaactttggttacctctggcggagcagggagatgcaaatgttcaatttaatttgggcgtgatgtatgctgaggggcaaggcgtcaaacaagatgattttgaagcggtgaaatggtatcgcaaagcggcggagcagggagatgcaaatgctcaggcttatttaggtttggcttatactgaagggcgtggtgtaagacaagattataccgaagcggtgaagtggtttcgcaaagcggcggagcagggacatgcaaatgctcaagctatatgggatctctttctttagggtaccgagccgaatcgatcca

SEQ ID NO: 5082 - DNA, 745 bp, Haemophilus influenzae
  n 474, 481, 578, 631, 632, 682, 697: n is any nucleotide
atgaaactcacaaaaacacttcttaccaccgcacttttcggtgcttctgtattttcttttcaatccaccgcttgggcggatacgctggaacagcaattccaacaaggtttaaccgcttatgagcaaagcaactatcaaaccgcctttaaactttggttacctatggcagagcagggatatgcaaaggctcaatttaatttgggcgtgatgtatgctaaggggcaaggcgtcaaacaagatgattttgaagcggtgaagtggtttcgcaaagcggcggagcagggatatgcagaggctaaatttaatttgggccatatgtattctaagggacgaggcgtcaaacaagatgattttgaagcagtgaactggtatcgcaaagcggcggagcagggagatgcagatgctcaagctatattgggattcttatatcttttaggagaaagaggtgtcaagtaaataattctttagccaagnaatggtntggtaaggcttgtgataatggtaatcaaaatggctgcgaatattatggcaagctaaatagaggggagctctaatgcccacttttacaatgcgaattntggaatgtagggcaagggttattttcaagtgggcgtattcaagtggagacgcnnccaagcctttcattgggtttatggtttgcaagttcctcatcatggttcanagcccaatttagtgnaataaaaataaaagattatccattcattcaatttaataggaaaacaaa

SEQ ID NO: 5083 - DNA, 634 bp, Haemophilus influenzae
atgcgattcacaaaaacactttttaccaccgcacttttaggtgcttctatcttttcttttcaatccaccgcttgggcggatacgctggaacagcaattccaacaaggttctgaagccactacgagaggcgattatcaaaccacctttaaatttttgttacctctggcggagcagggaaatgcagaggctcaattgatgttgggcgtgatgtatgcaagaggaataggcgtcaaacaagatgattttgaagcggtgaagtggtatcgccaagcggcggagcagggatatgcaaatgctcaagctatattgggattctcatatcttttaggacaaagcggtgttcaagtaaataaatctttagccaaagaatggtttggtaaggcttgtgataatggtgatcaaaatggttgcgaatattatggcaagttaaatagaggggagctctaatgccaactttacaatgcgaattttggaatgtagggcaagggttattttcaagtgggcgtattcaaatgggagacgccccagcctttcattgggtttatggtttgcaagttcctcatcatggttcaaagccaattttagtgaataaaaataaaagattatccattcattcaatttaataggaaaacaa

SEQ ID NO: 5084 - DNA, 848 bp, Haemophilus influenzae
atgaaactcacaaaaacacttcttaccaccgcacttttcggtgcttctattttttcttttcaatccaccgcttgggcggatacgccggaacagcaattccaacaaggtttaaccgcttatgagcaaagcaactatcaaaccgcctttaaactttggttacctctggcggagcagggagatgcacaggctcaaggtggtttgggcatgatgtatgaaagaggacttggcgtaaaacaagatgatttcaaagcagtgaactggtatcgcaaagcggcggagcagggggatgcagatgctcaattaaatttgggtgcgatgtatgcaatcggacgtggcgtaaaacaagatggtgttgaagcggtgaagtggtttcgcaaagcggcagagcagggaaatgcaaaggctcaaaatggtttgggcatgatgtatgacggaggacttggcataaaacaagattatttcaaagcggtgaaatggcatcgcaaagcggcggagcagggatatggaggtgctcaagttatgttgggattctcatatctttcgggaaaaggtgttcaagtaaataaatctttagccaaagaatggtttggtaaggcttgtgataatggtgaacaagtgggttgtgaatattatggcaagctaaatagaggggaacgctaatgccaactttacaatgcgaattttggaatgtagggcaagggttattttcaagtgggcgtattcaaatgggagacgcccaagcctttcattgggtttatggtttgcaagttcctcatcatggttcaaagccaattttagtgaataaaaataaaagattatccattcattcaatttaataggaaaacaaa

SEQ ID NO: 5085 - DNA, 454 bp, Haemophilus influenzae
atgaaactcacaaaaacacttcttaccaccgcacttttaggtgcttctgtattatcttttcaatccaccgcttgggcggatacgctggaacagcaattccaacaaggtttaaccgcttatgagcaaagcaactatcaaaccgcctttaaactttggttacctctggcggagcagggagatgcaaatgttcaatttaatttgggcgtgatgtatgctgaggggcaaggcgtcaaacaagatgattttgaagcggtgaaatggtatcgcaaagcggcggagcagggagatgcaaatgctcaggcttatttaggtttggcttatactgaagggcgtggtgtaagacaagattataccgaagcggtgaagtggtttcgcaaagcggcggagcagggacatgcaaatgctcaagctatatgggatctctttctttagggtaccgagccgaatcgatcca

SEQ ID NO: 5086 - protein, 195 aa, Haemophilus influenzae
MKLTKTLFTSALLGASILSFHPTVAAMDFGTQVGIDAYRKNDFAQAAEQFKDAGIVRGDPTAQLFLGRMYYNGEFFKQDYVEAAKWYRKAAEQGEEFGLLFLGETYEDGEGVEKDYAEAAKLYRKAAEQGSAEGQMALGKMYRFGNGVEKDYAEAIKLYRKSAEQGNFTALFFLGEMYDNGVGVKQNKAESQRII

SEQ ID NO: 5087 - protein, 198 aa, Neisseria meningitidis
MKQTVKWLAAALIALGLNRAVWADDVSDFRENLQAAAQGNAAAQYNLGAMYYKGRGVRRDDAEAVRWYRQAAEQGLAQAQYNLGWMYANGRGVRQDDTEAVRWYRQAAAQGVVQAQYNLGVIYAEGRGVRQDDVEAVRWFRQAAAQGVAQAQNNLGVMYAERRGVRQDRALAQEWFGKACQNGDQDGCDNDQRLKAGY

SEQ ID NO: 5088 - protein, 197 aa, Haemophilus influenzae
  Name: NTH1069
MNNQNPIEIYQTQDGTTQVEVRFENDTVWLSQAQMAMLFGKDIRTINEHITNIFDDEELEKESTIRKFRIVRQEGKRQVNREIEHYDLDMIISVGYRVKSKQGISFRRWATARLKEYLTQGYTINQKRLQQNAHELEQALALIQKTANSSELTLESGRGLVDIVSRYTHTFLWLQQYDEGLLAEPQTQQGRYITDLC

SEQ ID NO: 5089 - protein, 205 aa, Haemophilus influenzae
  Name: NTH1069
MLVIKENNMNNQNPIEIYQTQDGTTQVEVRFENDTVWLSQAQMAMLFGKDIRTINEHITNIFDDEELEKESTIRKFRIVRQEGKRQVNREIEHYDLDMIISVGYRVKSKQGISFRRWATARLKEYLTQGYTINQKRLQQNAHELEQALALIQKTANSSELTLESGRGLVDIVSRYTHTFLWLQQYDEGLLAEPQTQQGRYITDLC

SEQ ID NO: 5090 - protein, 695 aa, Haemophilus influenzae
  Name: NTH1845
MKLEASKQASKQASKQASKQASKQASKQASKQKFKKSFIISLFFSILYTSPLLAVVDYTYDNSKLTNEQIERLKKLRDRNSEYWKKETYLLKSPPSNFPDIPVLFPKDSSVPFENIDNSKAISFYDQKYTEDYLVGFAQGFGVAKRNGDTEEPVRKYFKECLNTGNYNNDNCKANPLASSVSIKSDIFTPRPTIKNSHINSEILAVGNYTELMLAAQPSASSWAEHLYSDPGLSLTVQDNSHVIGQTIDLGFLQLTNSLWEPRWNSNIDYLVTENAEIRFNTKNESLLVEGYYAGGARFRFAYDLKDKAPETPVLTFEQNITGTSDIIFENPIDDLKSLDGHQIVKVNGTADKNAFRLSGKYRKGIYTLSLQQRLEGFFTKLQERDDIAIYAQQAQAANTLFALRLNDKNSDIFDRTLPRKGLWLRVIDGHSSQWVQGKTAPLEGYRKGVQLGGEVFTWQNESNQFSVGLMGGQAEQRSTFRNPDTDNLTTGNMKGLGAGVYATWHQLQDKQTGAYVDSWAQYQRFRHRINTEDGTERFTSKGITASIEAGYNALLAEHLTGKGTQIRFYLQPQAQLTYLGVNGKFSDSENSQVNLLGSRQLQSRVGVQAKAQFLLNKNIVIQPFAAVNTLYHSKPFGVEIDGERRVINNKTAIESQFGIAVKIKSHLTLQATFNRQTGKHHHAKQGALNLQWTF

SEQ ID NO: 5091 - protein, 1096 aa, Haemophilus influenzae
MNKIFNVIWNVVTQTWVVVSELTRTHTKCASATVAVAVLATLLSATVEANNNTPVTNKLKAYGDANFNFTNNSIADAEKQVQEAYKGLLNLNEKNASDKLLVEDNTAATVGNLRKLGWVLSSKNGTRNEKSQQVKHADEVLFEGKGGVQVTSTSENGKHTITFALAKDLGVKTATVSDTLTIGGGAAGATTTPKVNVTSTTDGLKFAKDAAGANGDTTVHLNGIGSTLTDTLVGSPATHIDGGDQSTHYTRAASIKDVLNAGWNIKGVKAGSTTGQSENVDFVHTYDTVEFLSADTETTTVTVDSKENGKRTEVKIGAKTSVIKEKDGKLFTGKANKETNKVDGANATEDADEGKGLVTAKDVIDAVNKTGWRIKTTDANGQNGDFATVASGTNVTFASGNGTTATVTNGTDGITVKYDVKVGDGLKLDGDKIAADTTALTVNDGKNANNPKGKVADVASTDEKKLVTAKGLVTALNSLSWTTTAAEADGGTLDGNASEQEVKAGDKVTFKAGKNLKVKQEGANFTYSLQDALTGLTSITLGTGNNGAKTEINKDGLTITPANGAGANNANTISVTKDGISAGGQSVKNVVSGLKKFGDANFDPLTSSVDNLTKQNDDAYKGLTNLDEKGTDKQTPVVADNTAATVGDLRGLGWVISADKTTGGSTEYHDQVRNANEVKFKSGNGINVSGKTVNGRREITFELAKGEVVKSNEFTVKETNGKETSLVKVGDKYYSKEDIDLTTGQPKLKDGNTVAAKYQDKGGKVVSVTDNTEATITNKGSGYVTGNQVADAISKSGFELGLADAEKAKAAFGDETKALSSDKLETVNANDKVRFANGLNTKVSAATMESTDANGDKVTTTFVKTDVELPLTQIYNTDANGKKITKVVKDGQTKWYELKDDGSTDMTKEVTLGNVDSDGKKVVKEDNKWYHTKADGTADKTKGEVSNDKVSTDEKHVVRLDPNNQSNGKGVVIDNVANGDISATSTDAINGSQLYAVAKEVTNLAGQVNNLEGKVNKVGKRADAGTASALAASQLPQASMSGKSMVSIAGSSYQGQSGLAIGVSRISDNGKVIIRLSGTTNSQGKTGVAAGVGYQW

SEQ ID NO: 5092 - protein, 148 aa, Haemophilus influenzae
  Name: NTH0867
MRFTKTLFTTALLGASVFSFQSTAWADTLEQQFQQGSEATTRGDYQTTFKFLLPLAEQGNALAQMMLGVMYAKGQGVKQDDVEAVKWYRKAAEQGYADAQAMLGFSYLLGQSGVQVNKSLAKEWFGKACDNGDQNGCEYYGKLNRGEL

SEQ ID NO: 5093 - protein, 219 aa, Haemophilus influenzae
  Name: NTH0865
MKLTKTLLTTALFGASIFSFQSTAWADTPEQQFQQGLTAYEQSDYQTAFKLWLPMAEQGYAQAQGGLGMMYERGLGVKQDDFKAVNWYRKAAEQGDADAQLNLGAMYAIGHGVKQDGVEAVKWFRKAAEQGNAKAQNGLGMMYRGRLGIKQDYFKAVKWYRKAAEQGYGGAQVMLGFSYLSGKGVQVNKSLAKEWFGKACDNGEQVGCEYYSKLNRGER

SEQ ID NO: 5094 - protein, 148 aa, Haemophilus influenzae
  Name: NTH0863
MKLTKTLLTTALLGASVFSFQSTAWADTPEQQFQQGSTAYEQSDYQTAFKLWLPMAEQGDANVQFNLGVMYAKGQGVKQDDFEAVKWFRKAAEQGHAKAQAILGFSYLLGERGVQVNKSLAKEWFGKACDNGNQDGCEYYGKLNRGGF

SEQ ID NO: 5095 - protein, 219 aa, Haemophilus influenzae
  Name: NTH0861
MKLTKTLLTTALLGASVFSFQSTAWADTPEQQFQQGSTAYEQSDYQTAFKLWLPMAEQGDANVQFNLGVMYAKGQGVKQDDFEAVKWYRKAAEQGHAKAQFNLGVMYAKGQGVKQDDFKAVKWYRKAAEQGYADAQANLGSAYSAGRGVRQDYIEAVKWFKKAAENGSADGQFKLGLVYLIGQSIQKDRTLAKEWFGKACDNGEQRGCEYYGKLNRGEL

The invention claimed is:

1. An isolated, immunogenic polypeptide comprising an amino acid sequence with at least 95% sequence identity to the sequence of SEQ ID NO:2368.

2. The polypeptide of claim 1, wherein said polypeptide comprises the amino acid sequence of SEQ ID NO:2368.

3. A composition comprising: (a) polypeptide of claim 1; and (b) a pharmaceutically acceptable carrier.

4. The composition of claim 3, further comprising an adjuvant.

5. A composition comprising: (a) polypeptide of claim 2; and (b) a pharmaceutically acceptable carrier.

6. The composition of claim 5, further comprising an adjuvant.

* * * * *